United States Patent 8,937,215 (POLYNUCLEOTIDES AND POLYPEPTIDES FOR INCREASING DESIRABLE PLANT QUALITIES) - sequence listing, part 2

SEQ ID NO: 1235 - DNA, 2772 bp, Saccharum officinarum
  misc_feature (913)..(913): n is a, c, g, or t
  misc_feature (1727)..(1727): n is a, c, g, or t
agcgattctgtgttcgcaccagcgccggcacaggcaacgcagcgccgcaccgagccgagccacttagcgaggaagcagcagcctccacggcgaggagagaatggggagaggagggatcggaggctcggcgggcatgaccatggagaacgccgattccgcccgcgcattcgtgaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatacatagcagctttgcagatctacaaaatcctcagatgaactttgatggaaaggcctgcgctgctgttggtcaaagtggtctgatggctatctatgacacattatttagccaacttgatgtaacgtcatctcaacttcttgtaaccgatcgtgatttcaaggatccaagttttggggaccagctccgcgagactgttttttcactattaaatcttaaagtaataccgttgttcaatgagaatgatgccataagtacccggagacaaccatatgaggattcatctggtatattctgggataatgacagtctagcagctctgttggcagccgaacttaatgctgatcttcttatcatgcttagtgatgtggagggactctatagtggtccaccaagcgatcctcagtcaaagattatccacacatatgtcaatgaaaagcatgggaagctaattagttttggagagaagtctaatgttggaagaggtggcatgcaagctaaagtggctgctgctgctaatgctgcatcaaaaggtgtacctgttgtcatngcaagtggatttgcaacggatagcatcattaaagttctcaaaggagaaaagattggtacacttttccacaatgaagcaaatttgtgggaatgttccaaggaagctacagcccgagagatggcagttgcggcaagagactgttcgagacgtctacagaagttgtcgtcagaggaacgcaaaaagattttgctagatattgctgatgctctggaagcaaatgaggatgcaattaggtctgaaaatgaagccgatgttgaggcagcacaagctgctggttatgaaaagtcgttggttgctagaatgaccctaaagccaggaaagataacaaaccttgcaagatccattcgtgccattgctgacatggaggaccctatttcccatacattgaaaagaacagaggttgctaaagatctggtttttgagaaagcatattgcccattgggtgttctgctcattatttttgagtctcgtcctgatgcattggtccagattgcatctctggcaatccgaagtggtaatggtcttcttttgaaaggaggaaaagaagctatgagatcaaacacaatattacacaaggtcataactggggttattccagatattgttggtaaaaagctcataggccatgtgactagcaaagatgaaattgctgatttgctagcgcttgatgatgtgattgatcttgtcattcctagaggcagtaagaatctagtctcccaaatcaaagcaacaactaagattccagttctaggtcatgctgatggtatctgccatgtttacattgacaaatcagccgacatggatatggcaaaanggatagtattggacgctaaggttgattatccagcagcatgtaatgcaatggaaacactacttgttcataaagatcttaacaagagtgagggccttgatgatctattagtggaacttgaaaaggaaggagtagttatttatggtgggcctgttgcacatgacaaattgaaagtaccaaaggtagattcatttcgtcatgagtatagctcaatggcatgcactcttgaatttgttgatgatgtgcagtcagccatcgatcacataaatcgttatggaagtgcacacacagactgcatcatcacaactgatgaaagtgctgcagaggcttttctgcagcaagtcgatagtgccgctgtgtttcataacgcaagcacaaggttctgtgacgggacgcgctttgggctaggtgcagaggttggcataagtacagggcgcatacatgcccgcggacctgttggagttgatggacttctaactactcgctgcattttacgcggtagtggacaagtggtgaatggtgacaagggagtggtttacacccacaaggatcttcctttgcaatgaggcaaagaacctctgttgtagtacaattgctcgtaacgaatggctgaactaccttttaagtaccattttctttattccatgcaacaaagataggtgtcgtaacaagcagaaggacctgatactttctcggcggtgcctatttattagaaaatgatgtattcagaccatttcggtacgaggcttgtaagctgtgtttgtcgttgtgttcttgtcgtataagccctagaacttccgagacatctgtattagaggcgttttagctggttgatatgcgatggttttggatgaaacttgaatctgttcccatgcaatgataatgcatgtgtgatgagatctcttctgtatcgttcattaaaacggggggggcgttttagaggtccacagtttactaccggtgcatgcaacgtattagtcttttaagtggccactaaaattaatcacttggccgtggttaaaaacggcgggaatgggaaaaaccctgt

SEQ ID NO: 1236 - DNA, 2902 bp, Zea mays
gtcaaggatattttaggcaatgcgttgcccaattccacaggccacgtcacacgtggtgcggctctaaccgtatcgtccctgcccggtggggccgcggtcgcgtagcagacaccgacgggccgtcacgggccctgctcgccgcagacgatccaggggccaggcggcgcgcgggtgatctcgccacggcgcgttttgtgtggcccgcccgtgacgggaggcggaagagggaagaggcgacgcgacgcgacgcggctctataaaaccgcgcctccaaccagtactcccccggcaccctagagagattctgttttcgcaccagcgccggcacaggcaacgcagcaccgcaccgagccgagccacttagcgagcgagggaacagcctccacggcgaggagagaatggggagaggagggatcggaggcgcggcggccatggccatggccatggagaccgccgatcctgcccgtgcattcgtgaaggacgtcaagcgaatcattatcaaggtgggcacggctgttgtcactggcatgaatggccgattggccatggggaggctcggttctctctgtgaacaggtgaagcaactgaattttcaagggtatgaggtgattctggtaacctcaggagctgttggtgttgggaggcagaggctccaataccgtaaacttatccatagcagcttcgcagatctgcaaaatcctcagatgaactttgatggaaaggcatgtgctgctgttggtcaaagtgtcctgatggcgatctatgacacattatttagccaacttgatgtaacgtcatctcaacttcttgtgacggatcgtgatttcaaggatccaagttttggggaccagctccgtgagactgttttttcactgttagatcttaaagtagtacccttatttaatgagaatgatgccatcagtacccggagacagccatatgaggattcatctggtatattctgggataatgacagtctagcagctctgttggcagcagaacttaatgctgatcttcttatcatgcttagtgatgtggaaggactctatagtggtccaccaagcgatcctcagtcaaagattatccacacatatgtcaatgaaaagcatgggaagctaattagttttggagagaaatctagtgttggaagaggtggcatgcaagctaaagtgactgctgctgctaatgctgcatcaaaaggtgtacctgttgttattgcaagtggatttgcaacggatagcatcattacagttctcaaaggcgaaaagatcggtacacttttccacaacgaagcaaatttgtgggcatgttccaaggaagctacagcccgagagatggcagttgcggcaagagactgttcgaggcgtctacagaagttgtcatcagaggaacgcaaacagattttgctagatattgctgatgctctggaagcaaatgaggatgcaattaggtctgaaaatgatgccgatgttgaggcagcacaagttgctggttatgaaaagtcgttggttgctaggatgaccctaaagccaggaaagataacaaatcttgcaagatccattcgtaaaactgctgacatggaggaccctatttcccatacattgaaaagaacagaggttgctaaagatctggtttttgagaaagcatattgcccattgggtgttcttctcattatttttgagtctcgtcctgatgcattggtccagattgcatctctagcgatccgaagtggtaatggtctccttttgaaaggagggaaagaagttatgagatcaaatgcaatattacacaaggtcataactggagttattcccgatactgttggcaaaaagctcataggccttgtgactagcaaagaggaaattgctgatctactagcgcttgatgatgtaattgatcttgtcattccgagaggtagtaagtctctagtttcccaaatcaaagcaacaactaagattccagttttaggtcatgctgatggtatctgccatgtttacattgacaaatcagccgacatggatatggcaaaacggatagtattggatgctaagattgattatccagcagcatgtaatgcaatggaaacactacttgttcataaagatcttaacaagagtgagggacttgatgatctattagtggaacttgaaaaggaaggagtagttatttatggtggacctgttgcacatgacaagttgaaagtaccaaaggtagactcatttcgtcatgagtatagctcaatggcatgcacagtcgaatttgttgatgatgtgcagtcagctatcgatcacataaatcgttatggaagtgcacacacagactgcatcatcacaactgatagaagtgctgcagaggcctttctgcagcaagttgatagtgccgctgtgtttcataatgcaagcacaaggttttgtgatgggacgcgttttgggctaggtgctgaggttggcataagtacagagcgcatacatgcccgcggacctgttggagttgatggacttctaactactcgctgcattttgcgcggtagtggacaagtggtgaatggtgacaagggagtggtttacacccacaaggatcttcctttgcaatgaggcaaataacctccgttgtggtcgtaacgaatggctggactccccttttaagtacccttttctttattccatgctacaaagtttggtgtcgtaacaagcagaatgcctatttagtaggcattgatgtaatcagaccattttgtcgtggtgttccttgtcgtataaaacatccgagacatctgtattagaggcgcggtagctagttgatacgcgattgttctggatgaaatttggatctgttccaatgcaatgataatgcatgtgtgatgaggtcctaaaaatctctgaatcgggattttggctcaagg

SEQ ID NO: 1237 - DNA, 2723 bp, Panicum virgatum
cccgcagcgcctctctgttgttgttcggcgtcggccctccgcaccagcgccggcggcacaggcaggcaggcagccccgcggggagccagccactcgcgagcgaggggagaatatggggaggggagggatcggcggcgcggcggccatggagaccgccgactccacccgcgcattcgtcaaggacgtcaagcgcatcatcatcaaggtgggcacagctgttgtcactgggcagaatggccgattggctatgggcaggcttgggtctctgtgtgaacaggtgaagcaactgaattttcaagggtatgaggtgattctggtaacatcaggcgctgttggtgttgggaggcagaggctgcagtaccggaaacttatccacagcagcttcgctgatctgcagaacccgcagatggattttgatgggaaggcttgtgctgccgttggtcaaagtggtttgatggcgatctatgacacgttgtttagccaacttgatgtaacgtcatctcaacttcttgtaacggaccgtgactttaaggatccaagttttggggaccagcttcgtgagactgttttcgcgctattggatcttaaagtaataccgctatttaatgagaatgatgccattagtaccaggagacaaccatatgaggatccttctggtatattctgggataacgacagtctggcagctctgttggcagcagaacttagtgctgacattcttatcatgcttagtgacgtggaaggactttatagtggtccaccaagtgatcctcaatcaaagattatccacacatatgttaatgaaaaacatgggaagttaattagttttggagagaaatcttgtgtaggaagaggtggcatgcaagctaaagtggttgctgctgttaatgctgcatcaaaaggtgtacctgttgtcattgcaagtggatttgcaacggatagcattattaaagttctcaaaggagaaaaaattggtacgcttttccacaacgaagcaaattcatgggaatgtaccaaggaagctacagctcgagagatggcagttgcagcaagagactgttcaagatggttgcagaagttgtcctcagaggagcgcaagaagattttgctggatattgctgatgctctagaagcaaacgaagatgcaattaggagagaaaatgaagctgatgtggaggctgcacaagatgctggttatgagaaatcattggttgctaggatgaccctaaagccaggaaagataacaaaccttgcaagatccattcgtgcaattgctgacatggaggaccctatttcccacacattgaaaagaacagaggttgctaaggatctagtttttgagaaagcatattgccctttgggtgttctcctcattatttttgagtctcgccctgatgcattggtccagattgcatctttggcaatccgtagtgggaatggccttcttttgaaaggcggaaaagaagctatgaggtcaaacgcaatattacacaaggtcataacaggggcaattccagattctgttggtaaaaagctcattggccttgtgactaccaaagatgaaattgctgatttgctagcgcttgatgatgtgattgatcttgtcattccaaggggcagtaagaatctcgtctcccaaatcaaagcaacaaccaagattccagttttaggtcatgctgatggtatctgccatgtttacattgataaatcagctgacatggatatggcaaaacgaatagtattggacgcaaaggttgattacccagcagcgtgcaatgcaatggaaacactacttgttcataaagatctgaacaagactgagggccttgatgatttgttagtggaacttgagaaagaaggagtagttatttatggtgggcctgttgcacatgacaaattgaaagtaccaaaagtagagtcatttcggcatgagtatagctcaatggcatgcaccctcgaatttgttgatgatgtacactcagcaattgatcatataaatcgttatggaagtgctcatacggattgcatcatcacaactgatgaaaaggctgcagaggcttttctgcaacaagttgagagtgctgctgtgtttcataatgcgagcacaaggttttgtgatgggactcgctttggtctaggggcagaggttggcataagtacagggcgcatacatgctcgtggacctgttggtgttgacgggcttcttactacccgctgcatcctacgaggcagtggacaagtggtgaacggtgacaagggagtggtttacacccacagggatcttcctttgcaatgaggcaaagaccctctctgcagccgaacaatcgctgaactcccctttagtaccttttcttcattccatgttacaagataatgcctagtgtcgttaaaaaaaggaggggaaggatctgatactatctagttcggcgatgcctgctatttcatttcattatattggatttgcctagaccattttagtacgaggcctgtgtggtgtacttgttccttgttgtgtacttgccggtgtaaccgtggaacttccttcgagacgtctgtattagagatgtaagctagagatgtaccatggctccggctgaagtttgactctgtttctaggctatgatagtatgataatgcatgagtgatgtgcgcctgaaatctgtcaaattgggtccgtcttacagaatgattatgcaatgatgccatcataccgtgccgttcgg

SEQ ID NO: 1238 - DNA, 2691 bp, Hordeum vulgare
gcttccacccacctccaccttgacctcgcctcgcccacccgttctccctcgctccctcttcttttttttgtctctcccttcctcgcctcgcccgtctcgatccggagcgagcgagcgagcgagagcgggtcgccgcgccggggggagaagcgggagcggagaatgggcaggggtggcatcgggggcgccgttgcggcggcggacctcgagaacagcgactccacccgctgcttcgtcagggacgtcaagcgcatcgtcgtcaaggtcggcaccgctgttgtcaccgggcagaatggccgactcgccatgggcaggctcggagctctctgcgagcaggtgaaggagcttaatttccaggggtatgaggtgatcctggtcacctccggcgccgttggcgtcgggaggcagaggctcaagtaccggaagctaatcaacagcagctttgcggatctgcagaacccacagttggacctggacgggaaggcctgcgctgccgtcggccagagtggcctcatggctatctacgatacgctgtttagccaacttgatgtgacatcgtctcagcttcttgtcaccgatcgcgatttccgggatccaagttttgggcaccagcttcgtgagactgtcgtctctctgttagatcttaaagtgataccagtgtttaatgagaacgatgctatcagtacgaggagagcgccatacgaggattcatccggtatattctgggataacgacagtttggcgacgctgttggcaaaagaactggacgctgatcttcttatcatgcttagtgatgtggagggactctatagtggtccaccgagtgatcctcaatcaaagattatccacacgtacatcaatgaaaaacacgggaagctaattaattttggggagaagtctcgcgtgggaaggggtggaatgcaagctaaagtggcagctgctgttactgctgcatccaagggcgtacctgctgtcattgcaagtggatttgtaacagatagcattattaagattatgcgaggagagaaaattggtacgcttttccataatgaagcaaatgtctgggattgtaccaaggaagtgacaacccgtgagatggcagttgctgcaaaagattgctcgcggcatctccagaatttgtcatcagaggagcgtaagaaaattttgctagatattgctgatgctctggaagcaaatgtgggtttaattatagctgagaatgaggctgatctagccgcggcacaagatgcaggctatgagaaatctttggttgctaggatgaccctgaaggcaggaaagataacaagccttgctgaatccattcgtgcaattgcggacatggaggatcctatttcacatacactgaaaaaaacagaggttgctaaggatttagtatttgagaagatgtactgcccattgggcgttctcctaattattttcgagtctcgtcctgatgccctggtccagattgcagctctagcaatccgaagtggaaatggtcttcttctgaaaggaggaaaagaagctatgagatcaaacacaatattgcataaggtcataaccagcgtgattccagatggtgttggtaaaaagcttattggccttgtaaaaagcaaagaagaaattgctgatcttctaaagcttgacgatgtgattgatcttgttattccgagaggcagtaacaggctcgtttctcaaatcaaagcaacaactaagattcctgttcttggtcatgctgatggtatctgccatgtttatattgataaatcggctgacatggatatggcaaagcgtattgtattggatgcaaaggtggattatccggcagcatgtaatgctatggaaacactacttgttcataaagatctgaacaagacagagggtcttgatgatttgttgatggaactcgcgaaagaaggagttgttatttatggtggacctgttgcacatgacacattgaaagtaccaaaggtagattcatttcatcatgagtatagctcaatggcatgcacgctcgaatttgttgatgatatacagtcagcaattgaccatataaatcgttatggaagtgcacacacagattgtattatcacaaccgataagaagtcagcagatactttcctacaacaagttgatagtgctgctgtgttccataatgcaagcacaaggttctgtgatgggactcgcttcggtctaggtgcagaggttggcataagcacagggcgcatacatgcccgtggacctgttggtgtcgacggtcttctaaccactcggtgcattctacgagggagtggacaagtagtgaacggagacaagggagttgtgtacacccacaaggatcttcctttgcaatgagggtagaggattcttgctgtagttaaatcaatttttgtagaataatcctcttcaaagcccccttctctttgcgcgaggaatgaagaaagacaggagaacgttgttactgtgtcgctatctggttccgtgattgccttcggtttgctgtacaatgatttatccatacaatgtcgtagttatggcactggctgttgtaactgtagaattgcatcggtacatctatgctatatatgtgaagcagctgtactgtttctgatgaagtctcaaatccctttgtcatgttgtctttgtaggcatgggtacgcaaagagcacctaaacaatggaccgtatacgc

SEQ ID NO: 1239 - DNA, 2709 bp, Hordeum vulgare
attcggcacgaggcgccgcttccacccacctccaccttgacctcgcctcgcccacccgttctccctcgctccctcttcttttttttgtctctcccttcctcgcctcgcccgtctcgatccggagcgagcgagcgagcgagagcgggtcgccgcgccggggggagaagcgggagcggagaatgggcaggggtggcatcgggggcgccgttgcggcggcggacctcgagaacagcgactccacccgctgcttcgtcagggacgtcaagcgcatcgtcgtcaaggtcggcaccgctgttgtcaccgggcagaatggccgactcgccatgggcaggctcggagctctctgcgagcaggtgaaggagcttaatttccaggggtatgaggtgatcctggtcacctccggcgccgttggcgtcgggaggcagaggctcaagtaccggaagctaatcaacagcagctttgcggatctgcagaacccacagttggacctggacgggaaggcctgcgctgccgtcggccagagtggcctcatggctatctacgatacgctgtttagccaacttgatgtgacatcgtctcagcttcttgtcaccgatcgcgatttccgggatccaagttttgggcaccagcttcgtgagactgtcgtctctctgttagatcttaaagtgataccagtgtttaatgagaacgatgctatcagtacgaggagagcgccatacgaggattcatccggtatattctgggataacgacagtttggcgacgctgttggcaaaagaactggacgctgatcttcttatcatgcttagtgatgtggagggactctatagtggtccaccgagtgatcctcaatcaaagattatccacacgtacatcaatgaaaaacacgggaagctaattaattttggggagaagtctcgcgtgggaaggggtggaatgcaagctaaagtggcagctgctgttactgctgcatccaagggcgtacctgctgtcattgcaagtggatttgtaacagatagcattattaagattatgcgaggagagaaaattggtacgcttttccataatgaagcaaatgtctgggattgtaccaaggaagtgacaacccgtgagatggcagttgctgcaaaagattgctcgcggcatctccagaatttgtcatcagaggagcgtaagaaaattttgctagatattgctgatgctctggaagcaaatgtgggtttaattatagctgagaatgaggctgatctagccgcggcacaagatgcaggctatgagaaatctttggttgctaggatgaccctgaaggcaggaaagataacaagccttgctgaatccattcgtgcaattgcggacatggaggatcctatttcacatacactgaaaaaaacagaggttgctaaggatttagtatttgagaagatgtactgcccattgggcgttctcctaattattttcgagtctcgtcctgatgccctggtccagattgcagctctagcaatccgaagtggaaatggtcttcttctgaaaggaggaaaagaagctatgagatcaaacacaatattgcataaggtcataaccagcgtgattccagatggtgttggtaaaaagcttattggccttgtaaaaagcaaagaagaaattgctgatcttctaaagcttgacgatgtgattgatcttgttattccgagaggcagtaacaggctcgtttctcaaatcaaagcaacaactaagattcctgttcttggtcatgctgatggtatctgccatgtttatattgataaatcggctgacatggatatggcaaagcgtattgtattggatgcaaaggtggattatccggcagcatgtaatgctatggaaacactacttgttcataaagatctgaacaagacagagggtcttgatgatttgttgatggaactcgcgaaagaaggagttgttatttatggtggacctgttgcacatgacacattgaaagtaccaaaggtagattcatttcatcatgagtatagctcaatggcatgcacgctcgaatttgttgatgatatacagtcagcaattgaccatataaatcgttatggaagtgcacacacagattgtattatcacaaccgataagaagtcagcagatactttcctacaacaagttgatagtgctgctgtgttccataatgcaagcacaaggttctgtgatgggactcgcttcggtctaggtgcagaggttggcataagcacagggcgcatacatgcccgtggacctgttggtgtcgacggtcttctaaccactcggtgcattctacgagggagtggacaagtagtgaacggagacaagggagttgtgtacacccacaaggatcttcctttgcaatgagggtagaggattcttgctgtagttaaatcaatttttgtagaataatcctcttcaaagcccccttctctttgcgcgaggaatgaagaaagacaggagaacgttgttactgtgtcgctatctggttccgtgattgccttcggtttgctgtacaatgatttatccatacaatgtcgtagttatggcactggctgttgtaactgtagaattgcatcggtacatctatgctatatatgtgaagcagctgtactgtttctgataagtctcaaatccctttgtcatgttgtctttgtaggcatgggtacgcaaagagcacctaaacaatggaccgtatacgcct

SEQ ID NO: 1240 - DNA, 3442 bp, Oryza sativa
caccacctcccttcctctcccccttttaaagccgtcgcaccctggcggtgtgtaagcctccgcccctccccgtatctctcgcgtttctggtctaagttccacgccacttgttgccgcattccttctccctccctgcaaatccaatccaatccaatcccaccccaagctcgcggaggaggaggaggaggagatggggagaggagggatcggcggcgcggggctggtggcggcggtcgcgaaggcggacgtggagaacaccgactccacccgcggcttcgtcaaggacgtgaagcgcatcatcatcaaggtcggcaccgctgttgtgactgggccgaatggccggttggctatgggcaggctcggtgctctgtgtgaacaggtgaagcagctaaattttgaggggtacgaggtgattctggtcacctctggtgctgttggtgttgggaggcagaggctcaagtaccggaagctcgtcaatagcagtttcgctgatctgcagaacccacagatggacatggacgggaaggcctgcgctgccgtcggtcagagtgtgctgatggcgatctatgacacgttatttagccagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccagtggatttgcaatcgatagcattattaaggtcatgcgaggagagaaaatcggtacgcttttccatagggaagcaaaccagtggggttgttccaaggaagcaacagcgcgtgagatggccgttgctgcaagagattgctccagacatctacagaaattgtcgtctgaggagcgtaagaagattttgctagacatcgccgatgctctagaagcaaatgaagatctaattacatccgagaaccaagctgatctggatttggcgcaagatattggttacgataaatcattggttgctcggatgaccataaagccaggaaagataaaaagcctcgcaggatcaattcgtgaaatcgctgatatggaggaccctatttcccatacactgaaaagaacagaggttgctaaagatcttgtttttgagaaaacatattgcccattgggtgttctcctaattatttttgagtcccgtcctgatgccttggtacagattgcatctttagcaatccgaagtggaaatggtcttctcttgaaaggaggaaaagaagctatgagatcaaacacaatactgcataaggtcataactggtgcaattccagatgttgttggtaaaaaacttattggcctagtgaaaaacaaagatgaaattgctgatttgctcaagcttgatgatgtgattgatcttgtaataccaagaggtagcaataagctcgtttcccagatcaaagcagcaaccaagattcctgttcttggtcatgctgacggtatctgccatgtttatattgacaaatcagctgacatggacatggcaaaacgtattgtattggacgcaaaggttgattatccagcagcgtgtaatgccatggaaacgttacttgttcataaagatctgaacaggacagaaggccttgacgatttattggtggagcttgaaaaggaaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaagtgcacacacagattgcattatcactactgatggaaaggcagcagagacttttctacagcaagttgatagtgctgcggtattccataatgcaagcacacggttctgtgatggggctcgctttggtctaggtgctgaggttggcataagcacagggcgcatacatgctcgggggcctgttggcgttgatggactcctaacaactcgatgcattttacgaggaagtggacaagtagtgaacggcgacaagggagttgtttacacccacagggagctccctttgcagtgaggtgaagtggcttgtgaaggagctgttgtagagcaattttttgcagacgctcaccgtgctcctccttgagagctgcttctcttcatgacatgcaatgggagcacgaaagcatgtcaaagcaggaagtaatgaagggcgaagtaggtcagaaacttatagtactatgtactatggtgttgctacgtagttgtgtggtattccttattattcattgtaccatgaataatttatgccaatgtcgtagtagctacatgtaactatattggctttcatggacacgtctatggtactagatgtaaaactgctagatggctttagatgaacatctcagatttattttccatagaatgcacatatgaaagtacctgagcgtggcgacgctggtgctttccatgataaagatctggctggtgtagggcggtctgctgctgaagccggagacatgcacatcgcagaagcctaatcatcagactggagcctcaactgaaccatcccgtatctgatctgtttagataaagacagttatattagaaatcgccaataagtctcggacgaaaattcccagcatttcacaacttaagaagttcagaattctagcagctattcgtaatgcatcccattgcagtattgcataacaaattacagagatgaatatcaatctcccagctcagggcctctaaccatgacagatggtagatactctcgtatcagtgtcaacattaggtggggatattacaatattacatccatgtctggtatccacagtaccatcaccattccaaatgtgtcaggataccgttactactactgatgtgttaaacagggatccatcacaaatgtatcaaaattgtctggcagagattccaattctctccaaacaaacaactcagcaatcttttgaggtacctcctgaaagactgagtcatgatggctagtctaatcaatatgttaggctatacaacaattcctacgtcttcagtggttattctgtataaatcagtaaagctcccaaaaaacattaatagagtccgcagcatcttcacc

SEQ ID NO: 1241 - DNA, 2657 bp, Brachypodium distachyon
gttatccatctcacggttccgttcgccacttccacccaccccaaccctcattgcttccttcctttttttttcgatccaccgcgacgcggagcgcctccgggtcgccgcagcgaaagggaatgggtaggggaggcatcggaggagccggggcggcgagcgccgcggccatggagaacagcgactccacccgctgcttcgtcagggacgtcaagcgcatcgtcatcaaggtgggcaccgccgttgttaccgggcagaatggccgattggctatgggcaggctcggggctctctgtgagcaggtgaaggaactgaatttccaggggtatgaggtgattctggtcacctccggggctgttggtgtcgggaggcagaggctcaagtaccgaaagcttatcaatagcagttttgcggatctgcagaatccacagttggacctggatgggaaggcctgtgctgctgtcggtcagagcggcctaatggccatctacgacacactgtttagccaacttgatgtaacatcatctcaacttcttgttacggatcgtgattttctggatccaagtttcgggcaccagctccgcgagactgtcatctctctgttagatcttaaagtaataccggtctttaatgagaatgacgctatcagtaccaggaaacagccatacgaggattcatctggtatattctgggataacgacagtttggcgacactattggcgcaagaactgaatgctgatcttcttatcatgcttagtgatgtggagggactctatagtggtccaccaagtgatcctcaatcaaagattatccacacatacattactgaaaaacacgggagactgattaattttggggagaagtctcgtgtaggaagaggtggaatgcaagctaaagtggcggctgctgttactgctgcatcaaagggcgtacctgctgtaattgcaagtggatttgcaatagatagcatcatcaaggttatgcgcggagagaaaatcggtacacttttccataatgaagcaaatttctgggattgctcgaaggaagtgacaacccgtgagatggcggttgctgcaaaagattgctcaagacatctacagaatttgtcatcagaggagcgtaagaaaattcttctagacattgctgacgctctagaagcaaatgaggatttgattacatctgaaaatgaagctgatctagctgcggcacaagatgctggttatgagaaatctttggtagctaggatgaccttgaaggcaggaaagataacaagtcttgcgagatccattcgtgcaattgcggacatggaggaccctatttcccatacactgaaaaaaacagagattgcaaaggatttagtttatgagaagatgtactgcccactgggtgttctcctaattatttttgagtctcgtcctgatgccctggtccagattgcagctctagcaatccgaagtggaaatgggcttcttttgaaaggagggaaagaagctatgagatcaaacacaatattacataaggtcataactggcgtgattccagatgttgttggtaaaaagcttattggccttgtaaaaagcaaagatgaaattgctgatttgctaaagcttgatgatgtgattgatcttgttattccgagaggcagtaataagcttgtttctcaaatcaaagcagcaactaagattcccgttcttggtcatgctgatggtatctgccatgtttatattgataaatcagctgacatggatatggcaaaacgtattgtactggatgcaaaggttgattatccggcagcgtgtaatgctatggaaacactgcttgttcataaagatctgaacaagacagagggtcttgatgatttattgatggaacttgcaaaagaaggagttgttatttatggtgggcctgttgcacatgacacgttgaaagtaccaaaggtagattcatttcaccatgagtatagttcaatggcatgcacccttgaatttgttgatgatgtacaatcagcgattgaccatataaatcgttatggaagtgcacacacggattgtattatcacgactgataagaagtcagcagatacttttctgcaacaagttgatagtgctgctgtgttccataatgcaagcacaaggttctgtgatgggacccgctttggtcttggtgcagaggttggcataagtacagggcgcatacatgctcggggacctgttggtgtcgatgggcttctaactactcgatgcattctgcgagggagtggacaagtagtgaacggtgacaagggagtcatgtatacccacagggagcttcctttgcaatgagtaacagactccttctgtagagcaatttttgtagacaagtcgctggactccctcttcaatgctcgtctttatgcctagaatgaactcaaaaacggatgctatgttgttatgtagttctgtgatgtcacctattcgttgtacaacgatttatcgatacaatgttgttattgctctagtcgtacctattggattgcatgggtgcatctattatggtagatgtttgagatgaagtaccagatctcttgtcatgttgtctttttacggcatgcgtacacaatgagcacaggtcgtcttctgaaatggctatttaaatcatgtggctgaaaaactgcccacttc

SEQ ID NO: 1242 - DNA, 2276 bp, Brachypodium distachyon
cctcattgcttccttcctttttttttcgatccaccgcgacgcggagcgcctccgggtcgccgcagcgaaagggaatgggtaggggaggcatcggaggagccggggcggcgagcgccgcggccatggagaacagcgactccacccgctgcttcgtcagggacgtcaagcgcatcgtcatcaaggtgggcaccgccgttgttaccgggcagaatggccgattggctatgggcaggctcggggctctctgtgagcaggtgaaggaactgaatttccaggggtatgaggtgattctggtcacctccggggctgttggtgtcgggaggcagaggctcaagtaccgaaagcttatcaatagcagttttgcggatctgcagaatccacagttggacctggatgggaaggcctgtgctgctgtcggtcagagcggcctaatggccatctacgacacactgtttagccaacttgatgtaacatcatctcaacttcttgttacggatcgtgattttctggatccaagtttcgggcaccagctccgcgagactgtcatctctctgttagatcttaaagtaataccggtctttaatgagaatgacgctatcagtaccaggaaacagccatacgaggattcatctggtatattctgggataacgacagtttggcgacactattggcgcaagaactgaatgctgatcttcttatcatgcttagtgatgtggagggactctatagtggtccaccaagtgatcctcaatcaaagattatccacacatacattactgaaaaacacgggagactgattaattttggggagaagtctcgtgtaggaagaggtggaatgcaagctaaagtggcggctgctgttactgctgcatcaaagggcgtacctgctgtaattgcaagtggatttgcaatagatagcatcatcaaggttatgcgcggagagaaaatcggtacacttttccataatgaagcaaatttctgggattgctcgaaggaagtgacaacccgtgagatggcggttgctgcaaaagattgctcaagacatctacagaatttgtcatcagaggagcgtaagaaaattcttctagacattgctgacgctctagaagcaaatgaggatttgattacatctgaaaatgaagctgatctagctgcggcacaagatgctggttatgagaaatctttggtagctaggatgaccttgaaggcaggaaagataacaagtcttgcgagatccattcgtgcaattgcggacatggaggaccctatttcccatacactgaaaaaaacagagattgcaaaggatttagtttatgagaagatgtactgcccactgggtgttctcctaattatttttgagtctcgtcctgatgccctggtccagattgcagctctagcaatccgaagtggaaatgggcttcttttgaaaggagggaaagaagctatgagatcaaacacaatattacataaggtcataactggcgtgattccagatgttgttggtaaaaagcttattggccttgtaaaaagcaaagatgaaattgctgatttgctaaagcttgatgatgtgattgatcttgttattccgagaggcagtaataagcttgtttctcaaatcaaagcagcaactaagattcccgttcttggtcatgctgatggtatctgccatgtttatattgataaatcagctgacatggatatggcaaaacgtattgtactggatgcaaaggttgattatccggcagcgtgtaatgctatggaaacactgcttgttcataaagatctgaacaagacagagggtcttgatgatttattgatggaacttgcaaaagaaggagttgttatttatggtgggcctgttgcacatgacacgttgaaagtaccaaaggtagattcatttcaccatgagtatagttcaatggcatgcacccttgaatttgttgatgatgtacaatcagcgattgaccatataaatcgttatggaagtgcacacacggattgtattatcacgactgataagaagtcagcagatacttttctgcaacaagttgatagtgctgctgtgttccataatgcaagcacaaggttctgtgatgggacccgctttggtcttggtgcagaggttggcataagtacagggcgcatacatgctcggggacctgttggtgtcgatgggcttctaactactcgatgcattctgcgagggagtggacaagtagtgaacggtgacaagggagtcatgtatacccacagggagcttcctttgcaatgagta

SEQ ID NO: 1243 - DNA, 2663 bp, Triticum aestivum
ccacccacccaccttgacctcgcctcgcccacccgttttttttcatcgcccgtctcgatccggagcgagcgagcgcccgcgggtcgccacgccccggcggagcggagaatgggcaggggaggcatcggaggcgccgtcgcggcggcggacctcgagaacagcgactccacccgcggcttcgtcagggacgtcaagcgcatcgtcgtcaaggtcggcaccgctgttgtcaccgggcagaatggccgactggccatgggcaggctcggagctctctgcgagcaggtgaaggagctcaatttccaggggtatgaggtgattctggtcacctctggcgccgttggcgtcgggaggcagaggctcaagtaccggaagcttatcaacagcagtttcgccgatctgcagaacccacagttggacctggatgggaaggcctgcgctgccgtcggccagagtggcctaatggctatctatgatacgctgtttagccaacttgatgtaacatcgtctcagcttcttgttacggatcgtgatttccgggatccaagttttgggcaccagcttcgtgagactgttgtctccctgttagatcttaaggtgataccggtgttcaacgagaacgatgctatcagtacgaggagagcgccatacgaggattcatccggtatattctgggataacgacagtttggcgacgctgttggcaaaagaactggatgctgatcttcttatcatgcttagtgatgtggagggactctatagtggtccaccgagcgatcctcaatcaaagattatccacacctacatcaatgaaaaacacgggaagctaattaattttggggagaagtctcgtgtgggaagaggtggaatgcaagctaaggtggcagctgctgttactgctgcatcaaagggcgtacctgctgtaattgcaagtggatttgtaacagatagcattattaagattatgcgaggagagaaaattggtacacttttccataatgaagcaaatgtctgggattgttcgaaggaggtgacaacccgtgagatggcagttgctgcaaaagattgctcacggcatctccagaatttgtcatcggaggagcgtaagaagattttgctagatattgccggtgctctggatgcaaacgtggatttaattatatccgagaatgaagctgatctagctgcggcacaagattcaggttacgagaaatccttggttgctaggatgaccctgaaggcaggaaagataacaagccttgctgaatcgattcgtgcaattgcggacatggaggaccctatctcacatacactgaaaaaaacagaggttgctaaggatttagttttcgagaagatgtactgcccattaggtgttcttctaattatttttgagtctcgtcctgatgccctggtccagattgcagctctagcaatccgaagtggaaatggccttcttctgaaaggaggaaaagaagctatgagatcaaacacaatattacataaggtcataaccagtgtgattccagatgctgttggtaaaaagcttattggccttgtgaaaagcaaagatgaaattgctgatcttctaaagcttgacgatgtgattgatcttgttattccaagaggcagtaacaggcttgtttctcaaatcaaagcacaaaccaagattcccgttctgggtcatgctgatggtatctgccatgtttatattgataaatcagctgacatggacatggcaaaacgtatagtattggatgcaaaggttgattatcctgcagcgtgtaatgctatggaaacactacttgttcataaagatctgaacaagacagagggtcttgatgatttattgatggaacttgcgaaagaaggagttgttatttatggtgggcctgtcgcacatgacacattgaaagtaccaaaggtagattcatttcatcatgagtatagctcaatggcatgcaccctcgaatttgttgatgatgtgcagtcagcgattgaccatatcaatcgttatggaagtgcacacacagattgtattatcacaactgataagaagtcagcagatacttttctacaacaagttgacagtgctgctgtgttccataatgcaagcacaaggttctgtgatgggactcgcttcggtctaggtgcagaggttggcataagtacagggcgcatacatgctcgtggacctgttggcgtcgacggtcttttaaccactcggtgcattctgcgagggagtggacaagtagtgaacggcgacaagggagttgtgtacacccacaaggatcttcctttgcaatgagggtagaggattcctgctgtagagcaatttttgtagaagaatcctcttcaaagccccccttctctctgtgcgaggaatgaaggaagacaagagagcattgttgttactatgtttgcaggtagaggattcctgctgtagagcaatttttgtagaagaatcctcttcaaagccccccttctctctgtgcgaggaatgaaggaagacaagagagcattgttgttactatgtcgctatctagttccgtgattgttcgtgtacaatgatttatccatacaatgtcgtagttatggcactagttgttgtaactgtagaattgcatcggtacatctatgctacatatatgaagtagctgtactgtttct

SEQ ID NO: 1244 - DNA, 2288 bp, Pennisetum glaucum
ctgcagaaccacagatggacttgatggaaaggcctgtgctgctgtaggtcaaagtggtttgatggcgatctatgacacgttgttcagccaacttgatgtaacgtcatctcaacttcttgtaaccgaccgagactttaaggatccaagttttggggaccagctccgtgagactgtttttgcgctgttggatcttaaagtaataccactatttaatgagaacgatgccatcagtaccaggaaacaaccatatgaggatccatctggtatattctgggataatgacagtctggctgctctgttggcagcagaacttaatgctgaccttcttatcatgcttagcgatgtggagggactttatagtggcccaccaagtgatcctcaatcaaagatcatccacacatatgttaatgaaaagcatgcgaagctaattagtttcggagaaaagtctcgtgttggaagaggtggcatgcaagctaaagtgtttgctgctgctaatgctgcatcaaaaggcgtacctgttgtcattgcaagtggattcgcaactgatagcattatgaaagttctcaaaggagaaaagattggcacacttttccacaatgaagcaaatctgtgggagtgttccaaggaagctacagcccgagaaatggcagttgcagcaagggactgttcaagacgcctgcaaaagttgtcatcagaggagcgcaagaagattttactagatattgctgatgcccttgaagcaaatgaggatgcaattaggtctgaaaatgaagctgatgttgaagcagcacaatatgctggttatgagaaatcgttgattgctaggatgaccctaaagccaggaaagataacaaaccttgcaagatccattcgtgcaattgctgacatggaggaccctatttcccatacattgaaaagaacagaggttgctaaagaccttgtttttgagaaagcatattgcccattgggtgttctcctcattatttttgagtctcgtcctgatgccctggttcagattgcaactttagcaatccgaagtgggaatggtcttcttctgaaaggaggaaaagaagctatgagatcaaatgcaatattacacaagatcataactgaggtgattccagatgctgttggtaaaaagctcatcggccttgtgactagcaaagatgaaattgctgacttgctagcgcttgatgatgtcattgacctagtcattccaagaggcagtaagaatcttgtctcccagataaaagcaacaaccaagattccagttttaggccatgctgatggcatctgccatgtttacattgataaatcagctgatatggatatggcaaaacgtatagttttggatgctaaggttgattatccagctgcctgtaatgcaatggaaacattactaattcataatgacctgagcaagagtgagggccttgatgatctattagtggaacttgaaaaggaaggagtagtcatttatggtggtcctattgcacatgacaaactgaaactgcccaaggtagattcatttcgtcatgagtatagctcaatggcatgcacccttgaatttgttgatgatgtgcattcagcaattgatcatataaatcgttatggaagtgcacacacagattgcattatcacaactgatgaaaaggctgcagaagcttttctgcagcaagttgatagtgcggctgtgtttcataatgcaagcacaaggttctgtgatgggacacgctttggtctaggtgcagaggttggcataagtactgggcgcatacatgctcgtggacctgttggtgttgatgggcttctaactacccgctgcattctacgaggtagtggacaagtggtaaatggtgacaagggagtggtttacacccacagggatcttccgttgcaatgaggaatagaacctctgctggcgaacaatgcttggaacaaatggctggactcccctcgtttaagtaccttttattcattccatggtacaaagataatgccaggacctggtgtcgttggagagaggggaaggaactgatactattcagttctgtgatgcctggtgtgccttatgttccatttgcttagaccattttggtgcctgtaaggtgtacttgttgcttgttgtgtccttgccggtgtaaccgtggtacttccttcgagacatctgtattagaagtgtggtagctagagaggtgcgatggctccagatgaagtttgaatctattgctaggctaatgataatgtgttatgtgtgcctgaaatttgtcaaattagattcgtcttgt

SEQ ID NO: 1245 - DNA, 1328 bp, Zea mays
cgccaataaactgagccatccggtcccaaaagtagaaaagggcaagcgacgagcacagcacagcacagcacaagcacgccttccgttttgggaaggcgaggagaggggaaccccggcccagggagagttgtggggaggggatcggcggcggaggagatggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccaagtggcaaaacaagcatttgatgaggctcttactgagataaattctggtgagggagtttacaaggatagcacacttatgatgcagcttctgaaggacaacttagcattgtggacatcagaactaactggaggtgaagcatccaagggtaacgacgatgtcgacatggagggttgatacattctccatgttttaaggaaacacagaaagcacgcaaaaatatccaggctgtgatgctagcgaacctgggtcctcaagttttttctgcatcggaactaagaagagccttgtgtatttttctgaagtttctgtccgtctcggggttttttttttgaggtctgtttgttcctctcttttggccatcgtttggtcctggagtcagtcactcactaccaagtgtttcagaggtctgaactggtgagcatccagatctgttgttgcttttttttccttctgtgcttcagaggcatctttgtacaccgatggaaaactgtttctcttatcaacgcatagactgtcagtgctgttactaatcatgttcggtgactgaagcgtctctgtaatgttgagatcgagcataaacttctccacgaaattatgta

SEQ ID NO: 1246 - DNA, 1197 bp, Panicum virgatum
aagggatcggcgggggaggagatggaggagcgggagaaggtcgtgtgcctggccaagctcgccgagcaggcggagagatacgaccatatggtggaatttgtgaagaagcttgctaggatggatgtggatatgagtgctgaagaaaggcatttattctcagtaggtttcaagaacactattgggacaaagagggcatcatggagaatcatttgttcacttgagcaaaagttgacaagtggtgatcaggctggtgtgatgatagatgcctacaaaaagaaagtagaagatgaactaaggaaggtttgcaatgaagtattgtcaatcatcgctattcattgccttcccttggccaattcgggtgaaaatatcgtgttcttttataagatgaaaggcgactactatcattacttggctgaatttagcactggaactgaaaagaaggctgctgctgatcagtcacttatggcgtaccagcacgccatggttgtcgcctccagtgagctctcacctgctcaccaaatcaggcttggccttgccctcaatttttcggtcttcttttatgagataatgaactcgcatgagagagcttgccaagtggcaaaacaagcatttgatgaggctcttactgagattaattctgctggtgagggggtttacaaggatagtacgattatgatgcagcttctgaaggataatttagcattgtggacatcagaactaactggaggcgaagcatcgaaggataatgccatcgacatggagggttgattgagatgcactcggaattactaagcagcaatgctagcgaacccatgtccttagtttttctgcatcagaagaagagccttatgtatcttttctcctgcagtttctcttcctctctttttgccatcgtttggtcttggagtcagttatcctactaagtgtttcagtgtatggactatggaccggtgaccatccacccagctttggtgatatttttgggagcttggactggtgatcacccagctctgatgtcctgttgcctttttcggtgcttgagaggcgtctttgtacacttacgatgaactctctcatatccaatgcattaaggtcaaggacagtccctgtcaatattaatattgttcagtgactggagcagtctctgtaatgttgacattgagcatatgaaaaataaggtgagctgattcattacag

SEQ ID NO: 1247 - DNA, 1267 bp, Pennisetum glaucum
ggagaagatcgtgtgcctcgccaagctcgccgagcaggcggagcgatacgacgatatggtggaatttatgaagaagcttgctaggatggatgttgatatgaatgctgaagaaaggcatttattctcagtaggtttcaagaatattattggtgcaaagagggcatcatggagactcatttgttcacttgagcaaaagttgacaggtggtgaccaggctggtgtgatgatagatgcctacaaaaagaaagtagaagatgaactaaggaagctttgcaatgaagtattgtcaatcatcgctatccattgccttccgttgaccagttcgggtgaaaatgttgtgttcttttataagatgaaaggggactactatcgttacttggctgaatttagcactggaactgaaaagaaggctgctgctgatcagtcacttatggcatatcagcatgccatggttgttgcctccagtgatctctcacctgctcaccaaatcaggcttggccttgccctcaatttttcggtcttcttttatgagataatgaactctcatgaaagagcttgccaagtggcaaaacaagcatttgatgaagctcttgctgaaattaagtctgctggtgagggggtttacaaggacagcacacttatgatgcagtttctgaaggacaacttagcattgtggacgtcagaactaacaggaggtgaaccatcaagggataatgacatcgacatggagggttgattgaggtgcatgtggaattactaagcagcagtgctcgtgaacccgtgtctccctctagtttttctgcaccgaaggagccttatgtattctttcgctggcagtttctcttcctttcttttggccatcgtttggtctttggagtcagttaccctactaagtgtttcagtgtctggactggtgaccatccaccaagctttggtgatattttgggagcttggactgctgaccacccagctctgatgttctgttgcctttttcggtgcttgagaggcatatttgtacaccgacgataaactgcctcttatgaatgcattaaggactgccctgccattattaatcttgttctgtgactgaagcggtctctgtaatgttaacattcagtggcagtgatgagcttgtgaattctgaactgaatacatgggaaatattcagaatctgaaattttgtgaattaactagcatagacgcatgtcgtagaaagtcttgtaaatagaaattctatattcatagaaaatattactacaagatatat

SEQ ID NO: 1248 - DNA, 1060 bp, Panicum virgatum
aggagatggaggagcgggagaaggtcgtgtgcctggccaagctcgccgagcaggcggagcgatacgacgatatggttgaatttgtgaaaaagcttgctaggatggatgtggatatgagtgctgaagaaaggcatttattctcagtaggtttcaagaacactattggggcaaagagagcatcatggagaatcatttgttcatttgagcaaaaattgacaactggtgatcaggctggtgtgatgatagatgcctacaaaaataaagtagaagatgaactaaggaaggtttgcaatgaagtactgtcaatcatcgctattcattgccttcccttggccaattcgggtgaaaatgtcatgttcttttataagatgaaaggggactactatcgttacttggctgaatttagcactggaactgaaaagaaggctgctgctgatcagtcacttatggcgtatcagcacgccatggttgttgcctccagtgagctctcacctgctcaccaaatcagacttggccttgccctcaatttttcggtcttgttttatgagataatgaactcgcatgagagagcttgccaagtggcaaaacaagcatttgatgaggctcttgctgagattaattctgctggtgaggggatttacaaggatagcacgcttatgatgcagcttctcaaggataacttagcattgtggacatcagaactaactgcagggttgattgagatgcacgcggaattactaagcagcaatgctagcgaaccccgtgtccttagtttttctgcatcagaagaagagccttatgtatcttttctcctgcagtttctcttcctctcttttggccatcgtttggtcttggagtaagttatcctactaaatgtttcagtgtctggagtctggactggtgaccatccacccagctctggtgatatttttgggagcttggattggtgaccacccagctcggatgtcctgttgcctttttctgtgcttgagaggcgtctttgtacactgacgatgaattttctcttatcaatgcattaaggtcaaggaccgtccctgtc

SEQ ID NO: 1249 - DNA, 1079 bp, Brachypodium distachyon
gggaaggtgaggtctgtgaacttgtgaagacaaagggaggggagcagaagccaaactcccacagcagagagaggagtcaccagtccagggggaggagatggaggagagggtgaaggtggtgtgcatggcgaagcttgccgagcaggcagagagatacgatgatatggtggacttaatgaagaaacttgctaggatggatgtggatatgagcggtgaagagagacatctattttctgttggttttaagaatacgattggtgcaaagagggcatcatggagaatcctttcttcacttgagcaaaaggtgacaacgggtgagcaggctggtgggatgataaatgattacagaaagaaagttgaggatgagctaaggatggtttgcaacgaaatattgtcaattatcgctattcattgcctccccttggccaattcgggtgaaaacattgtgttcttttataaaatgaaaggtgactactaccgttacctggctgaatttagcacgggaactgaaaagaaggctgctgctgaccagtcacttgtggcctatcagcacgccatggttgtcgcctccactgagctttcacctgtccacccaatcaggcttggccttgcgctcaatttctcagtcttcttttatgagataatgaactgtcatgagagagcttgccaagtagcaaaacaagcatttgatgaggctactgctgagattaattccatgggtgtggagggctacaacgacagcacacttatgatgcagcttctgaaggacaacctaacattgtggacatcagagctaactggaggtgaatcctctaaggataacgacctcgatatggagggataactggaacgcgttgaagggccctagcatgtgcgcaaaataaccagaacacttgctactgaacctgtgaccttcgccagcatagaaaccgccttatgttacctgtagcttctttgtttttgggtccttgcttggtctgagcgttgccctggttctcatattttgagagctcggagtggtaattgtccatctttgctgctttttttttcttgtataccggcaaacaatactatgttac

SEQ ID NO: 1250 - DNA, 1075 bp, Avena sativa
ggggaaggtggtgtgcatggcgaagctggccgagcaggcggagagatacgatgatatggtggagtttatgaagaaccttgcgaggatggatgtggatatgagtgctgaagagaggcatttgttttcagttggttttaagaatacaattggtgcaaggagggcatcatggagaatcctttcatcacttgagcaaaaggtgacagcaggcgagcgggctagcaggatgataaatgtctacagaaagaaagttgaggatgaactaaggatggtttgcaatgaaatattgtcaatcatcgctattcattgccttcccttggccaatacgggtgaaaatgtcgtatttttttataaaatgaaaggcgactattaccgttacttggctgaatttagcactgaaactgaaaagaagtctgctgctgaccagtcactcatggcctatcagcacgccatggttgtcgcctccactgagctttcacctgctcaccctatcaggcttggccttgcactcaatttctcagtgttcttttatgagataatgaactgtcatgagagagcttgccaagtcgcaaaacaagcatttgatgaggctacacgtgagatcaagtccactggtgccgacggctacaacgacagcacacttatgatgcagcttctgaaggacaacctagcattgtggacctcagaaataaatgaaggtgaagcttctaaggataacgacatcgatatggagggataactggaatctgtacaaggccatagcatgtccagagggcaatggtactgtaaagcctctgcgtcaacctgtcgaaagcgcctcagtaatcctgtagcttcgtcgtttctgaatcctcacttaccgttgtcctatgttgttttatttttccatagtttggatcggtgaccatgttcccagctttgctcatatttcgagagcttgggtcggtaaccatccatctttgatgctgctgtttctagttttctccgatgctgctttccgggcattgttgtataatatactagggaattatatgttactagtatgtctgttatcaatgacgagaaactgtctttttac

SEQ ID NO: 1251 - DNA, 1526 bp, Saccharum officinarum
cgacggccgaccaccgcacacgcacacgttcagcgatttcgcgggggatttgcattcattccgtggaggtccatccgcccgcggtggccgcgattggggatcggggcttgcgggccgtggtggaggcaagaaggtagcggagaagcttgatccggggacggggcctggcctctggagactcgtccgtcgatcgggtttcatctgcggaagccgggtcagaaaaatcgttgcgactggaggcggcgcgggggcatgggggcgtgggtgtcggtcctgctcgggatggacgacggagcggcggcggcggctgccgggcctgctgctgtgggcctgggcgacctgccggagctctgcgccgcgcaggtgctgctccgcctcgacccgccggagatctgcaggctcgcgcggctcaaccacgcgttccgcggcgcggcgggggcggacttcgtctgggaggccaagctgccggagaactacagctacctgatggagttcgtcgggagcggcgacgagggcaggcggaggcggcggcgggccggcaagaaagagatctatgccaggctcgccaggcctgtgcctttcggtggcggccacaaggaattctggttggacaagagcaaaggcatgatctgtatggcactatcgtccaaagcactggtgataactgggattgatgacagaagatactggcaacacatgccaacttcagaatcaagattccagtctgtagcttaccttcagcaaatctggtggtttgaggtggttggtgaagtcgatttctgcttccctgttggaacatatagcttgtactttagggtccatcttgggaagttctacaaacgatttggccgccgccattgcacctcagagcatgttcatggttgggacaagaagcctgtccgcttccagctatcgacctccgacggtcagcaggcattgtctcaatgctacctggaggagcccgggagctgggtcctgtaccacgctggtgattttgtggcctcaaagcctgaccagccgatgaagctgaagttctccatggcacagatcgactgcacgcacacaaaaggcgggctgtgcatcgactcggtgctcatctatccgaaagggaaagggtttcagcaggagagggtgatcaggtctcagaaatgagactgtagatgttgtggaggtactcacattaggatgttagaccaaatgcagcttgcagcctgatcttatttttgctttgggctctagttcgcaacagaggtgaagtgtatatggttgtagaactcaagtttttgtgtggtcaggtgaccactaaagtgatctgtcagtcctttcccaaggtcgttttcgccccccttgagctgaattgggactttgagataaccatgaaactgtactgaaatgagtttgaagatgtcgttcccaatttctaatttgctatctactgctcagtttctgatgctttctgtttcctattcttctagttttttgtgatgtgcttttccactcttcagctgaattgagacagagtaagt

SEQ ID NO: 1252 - DNA, 1552 bp, Saccharum officinarum
cggacgcgtggggcggttttctctcgccgacggccgaccaccgcacacgcacacgttcagcgatttcgcgggggatttgcattcattccgtggaggtccatccgcccgcggtggccgcgattggggatcggggcttgcgggccgtggtggaggcaagaaggtagcggagaagcttgatccggggacggggcctggcctctggagactcgtccgtcgatcgggtttcatctgcggaagccgggtcagaaaaatcgttgcgactggaggcggcgcgggggcatgggggcgtgggtgtcggtcctgctcgggatggacgacggagcggcggcggcggctgccgggcctgctgctgtgggcctgggcgacctgccggagctctgcgccgcgcaggtgctgctccgcctcgacccgccggagatctgcaggctcgcgcggctcaaccacgcgttccgcggcgcggcgggggcggacttcgtctgggaggccaagctgccggagaactacagctacctgatggagttcgtcgggagcggcgacgagggcaggcggaggcggcggcgggccggcaagaaagagatctatgccaggctcgccaggcctgtgcctttcggtggcggccacaaggaattctggttggacaagagcaaaggcatgatctgtatggcactatcgtccaaagcactggtgataactgggattgatgacagaagatactggcaacacatgccaacttcagaatcaagattccagtctgtagcttaccttcagcaaatctggtggtttgaggtggttggtgaagtcgatttctgcttccctgttggaacatatagcttgtactttagggtccatcttgggaagttctacaaacgatttggccgccgccattgcacctcagagcatgttcatggttgggacaagaagcctgtccgcttccagctatcgacctccgacggtcagcaggcattgtctcaatgctacctggaggagcccgggagctgggtcctgtaccacgctggtgattttgtggcctcaaagcctgaccagccgatgaagctgaagttctccatggcacagatcgactgcacgcacacaaaaggcgggctgtgcatggactcggtgctcatctatccgaaagggaaagggtttcagcaggagagggtgatcaggtctcagaaatgagactgtagatgttgtggaggtactcacattaggatgttagaccaaatgcagcttgcagcctgatcttatttttgctttgggctctagttcgcaacagaggtgaagtgtatatggttgtagaactcaagtttttgtgtggtcaggtgaccactaaagtgatctgtcagtcctttcccaaggtcgttttcgcccccttgagctgaattgggactttgagataaccatgaaactgcactgaaatgagtttgaagatgtcgttcccaatttctaatttgctatctactgctcagtttctgatgctttctgtttcctattcttctagttttttgtgatgtgcttttccactcttcagctgaattgagacagagtaagt

SEQ ID NO: 1253 - DNA, 1576 bp, Zea mays
accttcctctttaaattgcccctcctattcccccgtcccgaagctagaggctctctggcgccgacggccgacccacacgcgcgtccagcgatttcgccggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggatgctccctttttcctatttgtcatgatccggtcttgacttggtcttaacttaatattaagaatcattattatgatt

SEQ ID NO: 1254 - DNA, 1458 bp, Brachypodium distachyon
tttagttccccacttctctcccttttccccaaagctcgccttttctttttgccggcggaggacgcgcatcgaacaagttcccggaggattccattcggacgcaggctgagaggctcaggttgtgattgcgaggagcgtgcggaatcgggtgctggtctggtcgagaggctcgctgtattggggatcgagttcgtgggatttggttcccatctacaaaggtggggggcggttaccctaggtcgttgcgactggaggaggcgagggtccatgggggcgggggtgtcgagccttttcttcgggattggcggcgaggcggcgcaggagccgggtgctccgggcctgggcgacctgccggagctgtgcgcggccgaggtgctgctccggctcgacgcgccggagatctgccggctagcgcggctcaaccacgcgttccgtggtgcggcgggggcggacttcgtgtgggaggccaagctgccggagaactacaggcacctgatgggttacgtggagggtggcggcgacgagggaaggcggcggcggcggcgggccgggaagaaagagatctacgccaggctctccaggcctgtgcctttcgatggtgggacaaaggaattttggctggagaagagcaaaggcagggtttgcatggcgctatcctccaaagctttggtgataactggcatcgatgacaggagatattggacacacatgccgacggccgaatcaagattccagtctgtggcgtaccttcagcaaatctggtggttcgaagtggttggggagcttgatttctgcttccctgtgggaacctacagtttatacttcaggattcatcttgggaagttctacaagcgatttggccgccgtgtttgcagctcagagcatgtccacggttgggacaagaagccggtgcgcttccaacttgccacctccgatggtcaacatgcattatctcaatgctacctggatgagcctgggagctgggtcctataccatgcaggtgactttgtggtctcgaagcctgaccaagcactgaagctgaagttctcgatggcacagatcgactgcacacacacgaaaggcggtctgtgtgtcgactcggtgcttgtataccccaagggctttcagcaggagaaagtgataactgctaagagttcagagatgagattgtagacgtgtcgacgctaccgctagagttgtagagaagtgcaggttgcagcccaatcctattatcaatttgggctgtgatattgcaacggaggaaacgtgtatagaactgtagactcagattttgtactgtcagtaacgtcacagcctgctttgtgtgtccattttccccatggttcttttttctctccctggaactaaaatgagacttaaagctacggattaacggtgttgaatgttgtttctagtttgctactagtaattgctactgaaacttctatgatgcttctg

SEQ ID NO: 1255 - DNA, 1164 bp, Brachypodium distachyon
tccccacttctctcccttttccccaaagctcgccttttctttttgccggcggaggacgcgcatcgaacaagttcccggaggattccattcggacgcaggctgagaggctcaggttgtgattgcgaggagcgtgcggaatcgggtgctggtctggtcgagaggctcgctgtattggggatcgagttcgtgggatttggttcccatctacaaaggtggggggcggttaccctaggtcgttgcgactggaggaggcgagggtccatgggggcgggggtgtcgagccttttcttcgggattggcggcgaggcggcgcaggagccgggtgctccgggcctgggcgacctgccggagctgtgcgcggccgaggtgctgctccggctcgacgcgccggagatctgccggctagcgcggctcaaccacgcgttccgtggtgcggcgggggcggacttcgtgtgggaggccaagctgccggagaactacaggcacctgatgggttacgtggagggtggcggcgacgagggaaggcggcggcggcggcgggccgggaagaaagagatctacgccaggctctccaggcctgtgcctttcgatggtgggacaaaggaattttggctggagaagagcaaaggcagggtttgcatggcgctatcctccaaagctttggtgataactggcatcgatgacaggagatattggacacacatgccgacggccgaatcaagattccagtctgtggcgtaccttcagcaaatctggtggttcgaagtggttggggagcttgatttctgcttccctgtgggaacctacagtttatacttcaggattcatcttgggaagttctacaagcgatttggccgccgtgtttgcagctcagagcatgtccacggttgggacaagaagccggtgcgcttccaacttgccacctccgatggtcaacatgcattatctcaatgctacctggatgagcctgggagctgggtcctataccatgcaggtgactttgtggtctcgaagcctgaccaagcactgaagctgaagttctcgatggcacagatcgactgcacacacacgaaaggcggtctgtgtgtcgactcggtgcttgtataccccaagggctttcagcaggagaaagtgataactgctaagagttcagagatgagattg

SEQ ID NO: 1256 - DNA, 1424 bp, Hordeum vulgare
tatctccccacctttcctctccgacgacgcattaattcatcgcttttccgtcaggcggaacaaattcccggaggattccattcgtagacgggcggctgtgatcacgagcttccattacgggcgcggaatcatcggtgatcggcttcttcgcgggattcggttccatctacatactactactactacaaagggtgtctgaggtcgttgcgactggaggaagcggggagccatgggggcgggggtctcgagctttttattcggcgttggcggcccggcggcggaggctgcgccgggtgctgcgggcctgggcgacctgccggagctctgcgccgcgcaggtgctgctccggctcgacgcgccggagatctgccgcctcgcgcggctcaaccacgcgttccgcggcgccgcgggggcagacttcgtgtgggaggccaagctgccggagaactaccgccacctcatcgggtacgtcgagggcgggggcgaggagggcaggcgccggcgccgccgggccggcaccaaggagatctacgccaggctctccaggcccgtctctttcgacgacggcaccaaggaattttggctagagaagagcaaaggtagggtttgtatggcgctatcctccaaagctctggtcataactggcatcgatgacaggagatattggacgcacatgccgaccacagaatcaaggttccagtccgtggcataccttcagcaaatctggtggtttgaagtggttggagagcttgatttctgcttccctgtgggaacctacagtttgtacttcagggttcatctcgggaagttcagcaagcggtttggacgccgtgtttgtagcactgagcacgtccatggttggaacaagaagccggtgcgcttccagctctccacctcggacggccagaatgcattatctcaatgctacctggacgagcccgggagttgggttctgtaccatgcaggcgattttgtttcctcgaagccaggccaatcacttaagctgaagttctccatggcgcagatcgactgcacgcacacgaaaggtggcctgtgcgtcgactcggtgctcgtgtaccccaagggctttcagcaggagaaggtggtgaccggcaagatctcggagatgagatcgtagttgtagtggtggtggcgcttgcaccgctagagttgtagagaaaatgcagcttgcagcccaatcctattatcaagttgggctctagtatgcaacggatgaaactgtctgtgtaaagaactgtagactcagggtctgtgtggtgaggtacgtcagtcagagtggtttgtgtgtcgtccagtcttcccatgggtaatttttttctctccctggtgctaaatgagactttgaagctacggatgcaacggttgtactgaaacgagatcagaggtttcgtttccatgttcca

SEQ ID NO: 1257 - DNA, 1546 bp, Pseudoroegneria spicata
cccttcctctccaacgacgcattcatcgcttttccgtcaagcggacgcggcgcgaacaaattcccggaggattcctattccattcgtgagcgggcgggcgctaaggttgtgatcgcgagcttacattacgggcgtggaatcgggtgctggtcgatcgggaagctccttcgattcggggatcggcttcttcgcgtgattcggttccatctactgctacaaagggtgtgcgcggggcgggcctctgaggccgttgcgactggaggaggcgaggagccatgggggcgggggtctcgagctttttgttcggcgttggcggcgcggcggcggaggctgcgccgggtgctgcgggcctgggcgacctgccggagctctgcgccgcgcaggtgctgctccggctcgacgcgccggagatctgccgcctcgcgcgcctgaaccacgcgttccgcggcgccgcgggggccgacttcgtgtgggaggccaagctgccggagaactaccgccacctgatcgggtacgtcgagggcgggggcgaggaaggcaggcggcggcgccgccgggccgggaccaaggagatctacgctaggctctccaggcccgtctctttcgacgacggcaccaaggaattttggctagagaagagcaaaggtagggtttgtatggcgctatcctccaaagctctggtcataacgggcatcgatgacaggagatattggacacacatgccgaccacagaatcaaggttccagtccgtggcataccttcagcaaatctggtggtttgaagtggttggcgagctcgatttctgcttccctgtgggaacctacagtttatacttcagggttcatcttgggaagttcagcaagcggtttggacgccgtgcttgtagcacggagcacgtccacggttggaacaagaagccggtgcgcttccagctctccacctcggatggccagaatgcattatctcaatgctacctggatgagcctgggagctgggtcctgtaccacgcaggcgattttgtttcctcgaatcccggccaggcactgaagctgaagttctcgatggcgcagattgactgcacgcacacaaaaggcggcctgtgcgtcgactcggtgcttgtgtaccccaagggctttcagcaagagaaggtggtgaccggcaagatctcggagatgagatcgtagttgtagtggtggtgtgcttacactactagagttgtagacgaacgcagcttgcagcccaatcctattatcaagttgggctctggtatgcaacggatgaaaggtctgtgtaaagaactgtagattcagggtctgcgtggtcagttacgtcgagagtggtttgtgtgtcgtcgagtcttcccatgggtaatttttttttctctccctggtgctaaatgagactttgaagctgcggatgaaacggttgtgttgaaacgagattttgttccattttcctagtttgtgttacttgtcaggaacttctgttttcttgctgctgttagcctagttacaagatgactggaatatctgtggtactactctca

SEQ ID NO: 1258 - DNA, 1436 bp, Triticum aestivum
aacaaattcccggaggattccattcgtgcgcgggggggcgtgatcgcgagcttccattgcgggcgcggaatcgggtgccggtcgatcgaggagctccttcgattcggggatcggcttctgcgcgggattcggttcccatctgctgctgctacaaagggtgtgcggggcgggcctctgaggtcgttgcgactggaggaggcgaggagccatgggggcgggggtctcgagctttttcttcggcgcggcggcggaggctgcgccgggtgctgcgggcctgggcgacctgccggagctctgcgccgcgcaggtgctgctccgcctcgacgcgccggagatctgccgcctcgcgcgcctcaaccacgccttccgcggcgccgcgggggcagacttcgtgtgggaggccaagctgccggagaactaccgccacctgatcgggtacgtcgagggcgggggcgaggagggcaggcgccggcggcgccgggccgggaccaaggagatctacgccaggctctccaggcccgtctctttcgacgacggcaccaaggaattttggctagagaagagcaagggtagggtttgcatggcgctatcctccaaagctctggtcataactggcatcgatgacaggagatattggacacacatgccgaccacagaatcgaggttccagtccgtggcataccttcagcaaatctggtggtttgaagtggttggggagctcgatttctgcttccctgttggaacctacagtttatactttagggttcatcttgggaagttcagcaagcggtttggacgtcgtgtttgtagcaccgagcacgtccacggctggaacaagaagccggtgcgcttccagctctccacctcagacggccagaatgcattatctcaatgctacctggatgagcctgggagctgggttctgtaccatgcaggcgattttgtttccacgaatccccgccaggcgctgaagctgaagttctcgatggcgcagatcgactgcacgcacacgaaaggtggcctgtgtgtcgactcggtgcttgtgtaccccaagggctttcagcaagagaaggtggtgaccggcaagatctcagagatgcgatcgtcgtagttgtagtggtggtgcttgcactgctagagttgtagacaaacgcagcttgcagcccaatcctattatcaagttgggctctggtatgcaacggatgaaacgtctgtgtaaagaactgtagtctcagggtctgtgtggtcagctacgtccgagagtggtttgtgtgtcgtccagtcttcccatgggtaattttttttctctccctggtgctaaatgagactttgaagctgcggatgaaacggttgtgttgaaacgagatcagagattttgtttccaatttcctagtttgtgttccttgtcagaaacttctgttttcttgctgctgttg

SEQ ID NO: 1259 - DNA, 1457 bp, Oryza sativa
cacgctttcctctcgtcctctttatatttctcttcttcttcctcccttccccttcctctcctctcctctcctctccgtcttccaaagctcgcggccttctcgctttcgatttctctctctcgcggacagcgtgaattcgagggatttcttggctggtttggttgtggattggattggattgggtttctgtgtgtggaggtgtgtgtgattagaagcttttgcgactggaggaggaggagagatgggggcgggggtgtcgggcctgttcggattgggcggcgacgagggggagacgtcggcggcggttggtggtgccgcggcggcgggtctgggcgacctgccggagctgtgcgcggcggaggtgctgctccggctcgacgcgccggagatctgccggctcgcgcggctcaaccacgcgttccgcggcgcggccggggcggatttcgtgtgggaggccaagctgccggagaactaccggtatctgatgagcttcgtggagggcggcggcggcggcgacgacgggaggcagctgcggcggcggcggtggcggccggctgggaagaaggagatctacgcgaggctggctaggcctgtgcccttcgatggcggctcaaaggagttctggctggagaagagcaaaggcagggtttgcatggcgctatcctccaaatctctggtgataactgggattgatgataggagatactggcaacacattccaactgccgaatcgagattttattctgtggcataccttcagcaaatctggtggtttgaagtggttggagagatcgatttcagcttccctgttggaacctacagcttatacttcaggattcatctcgggaagttctacaagcgatttggacgccgagtttgcagcactgagcatgtccatggttgggacaagaagcctgttcgcttccagctctccacctctgatgggcagcactcattatctcagtgctccctgggtgagcccgggagttgggtactttaccatgcaggcgattttgtggtctcaaagcctgaccaaacaatcaagctgaagttctcgatggcgcagatcgattgcacacacacaaaaggtggtctttgtgtcgactcggcgttcatatacccaaagggctttcagcaggagaggatggtcaggtctcagaaatgtagatgttgagaaggaacttacattagattgtagacaaatgcagcttgcagcctaattctatttttaatttgggctcatgtatgcgcggcgaaaggtgtatataattgtaggcttcaattttgtgtgatcggtaacatgaatgtgctttgtgtgtccattttcccatggtttttccccctccctggagctaaatgggtcttcaagttacccatgaaagattctaccaaattgagatcagaaaatgttgtttacctttctccaattgcgatacgttgttctggtgtttttttca

SEQ ID NO: 1260 - DNA, 1448 bp, Solanum phureja
catccttgtactaaacatggacaagaagcgtcatgcagtgtgtgtaccatttcctgcacaaggtcatgtaataccattcatgaaattagccaaaattttgcactcaagaggtttctatgtcacatttgtcaacactgaatataaccatagacgcctaattcgatcccaaggtcctgactttgtgaaaggcttccaggattttcagtttgaaactattccggaaggattgccaccctcagatcgcgatgcaacgcaagatccaacttcgttatgtgactcgataaggaagaactgcttgactccttttcgggatttactatcaaagcttggttcatcacccgtcgttccaccaatttcttgtgttatatcagatggtgtgatgacctttgctattaaggctgcacaagaatttggcatccttgatgtccaattttggacggcctcagcttgtggttatatgggataccttcaatttgatgaactaacaagaagagggattatcccatttaaagatgacagtttcatggaggatggtacacttgatacaattgtcgatgggattccaggaatgagaaacattaggttgaaggacttgccaagctttatcatgactactgatcctgatgatattctgttaaactatttgagtgatgaagcacataattgcttgaaatcttctgcaatgatcatcaacacattcattgaattggaacgtgaagtcctggaagcgattgaagctagattcccaaatatttatgttacaggtccactttcattgatggaaaaaactatcccagaaaacgaattgagttcatttaggccaagtttatggaaagaagaatttctatgtcttgagtggctgaacaaacaggaaccaagttcggtaatctatgtgaattatggatgtgtgacattaatgtcagaccatcacctaaaagaattcgcgtggggacttgcaaatagcaaacacccattcttgtggattgttaggcctgacatagtgatgggctattcagccgtattgcctgatgagtttcttgaagagattaaagacaggggattattagcaagttggtgcccacaagatcaagttctttcccacccatctattggcgtttttataacacattgtggatggaactctacaattgaaagcataagttcaggagttcctctaatttgctggccattctttgctgagcaacaaacaaattgtagatatgcttgtgcggagtggggaataggtgttgaggtcaataaagacgtaaagcgtcaagaaatcgaagcaattattaaggatatgttagaaggtaaaaaaggtaaggagttgaaagacaaggcgttggagtggaagaagaaagcagtagaagcaactgatattggagggccttcatggaaacactttgatacattcttggaaagacttctccttaatagggaatagtatt

SEQ ID NO: 1261 - DNA, 1524 bp, Solanum phureja
catggacaagaagcctcatgcagtgtgcataccatttcccgcacaaggtcaggtaatgccattcatgaaattagccaaaattttgcactcaagaggtttttatgtaacatttgtcaacactgaatataaccataaacgtctaatccgatcacaaggccctgactttgtgaaaggcttccaagatttccaatatgaaactatcccggaaggattgtcacaatcagatcgcgatgtaactcaagatcctgcttcgttatgtgactcaataaggaagaactgcttgactccttttcgggatttactatcaaagcttggttcatcaccggtcgttccaccaatttcttgtataatatcagatggactgatgagctttgccattaaggctgcacaagaatttggcatccttgatgtccaattttggacagcctcagcttgtggttatatgggatatcttcaatatgatgaactaacaagaagagggactatcccgtttaaagatgacagttttatggaggatggtacactggatagagttgttgatggaattccaggaatgagaaacattaggtttaaagacttgccaagctttatcatgactactgatccacatgatattctgttaaactatttaagtgatgaagcacaaaattgcttgaaatcttctgcgatgatcatcaacacattcactgaattggaacgtgaagtcctagaagcgattgaagctagattcccaaatatttatgttaccggtccactttcattgatggaaaaaaccatccatgaaaacaaattgagctcatttaggccaagtttatggaaagaagaattccaatgtcttgagtggctgaataaacaggaaccaagttcagtaatctatgtgaattatggatgtgtgacattaatgtcagaccatcacctaaaagaattcgcgtggggacttgcaaatagcaagcatccatttttgtggatcgttaggcccgacataatgatgggggattcagccgtgttgcctgatgagtttcttgaagagattaaagacagaggattattagcaagctggtgcccacaagatcaagttctttcccacccatctattggcgtttttctaacacattgtggatggaactctacgattgaaagcataagttcaggagttcctctaatttgctggccattctttgctgagcagcaaacaaattgtcgatatgcgtgtgtagagtggggaataggtgttgaggtcaataaagacgtaaagcgccaagaaatcgaagcaattatcaatgatatgttagaaggtgaaaaaggtaaggatttgaaagacaaggcgttggagtggaagaagaaagcagcagaagcaactgatactggagggtcttcatggaaacactttgatacattcttggaaaaacttctccttagtagggaatagtattgggatatactattaaccatgaggttaagttatagtattttatttaatcctttgtaaagactttgtattttattttatttattatagtaaag

SEQ ID NO: 1262 - DNA, 1382 bp, Solanum phureja
caaggtcatgtaataccattcatgaaattagccaaaattttgcactcaagaggtttttatgtaacatttgtcaacactgaatataaccataaacgtctaatccgatcacaaggccctgactttgtgaaaggcttccaagatttccaatttgatactatcccggaaggattgccaccatcagatcgtgatgtaactcaagatcctgcttccttatgtgactcgataaggaagaactgcttgactccttttcgggatttactatcaaagcttatttcatcaccggtcattccaccaatttcttgtataatatcagatgggatgatgagctttgccattaaggcagcacaagaatttggcatccttgatgtccaattttggacagcctcagcttgtggttatatgggataccttcaatatgatgaactaagaagaagagagattatcccgtttaaagataatagtttcatggaggatggtacacttgatacaattgtcgatgagattccaggaatgagaaacattaggttgaaggacttgccaagctttatcatgactactgatcctgatgatattctgttaaactatttaagcgatgaagcacaaaattgcttgaaatcttctgcgatgatcatcaatacattcactgaattggaacgtgaagtcctggaagagattcaagctaaattcccaaatatttatgttacagggccactttcgttgatggaaaaaaccatcccagaaaacgaattgagctcatttaggccaagtttatggaaagaagaatttcaatgtcttgagtggctgaataaacaggaaccaagttcggtaatctttgtgagttatggatgtgtgacattaatgtcagaccatcacctaaaagaattcgcgtggggacttgcaaatagcaaacacccattcttgtggatcgttaggcctgacatagtgatgggtgattcagccgtgttgcctgatgagtttcttgtagagattaaagacagaggattattagcaagttggtgcccacaagatcaagtactttcccacccatctattggcgtttttctaacacattgtggatggaactctacgattgaaagcataagttcaggagttcctctaatttgctggccattctttgctgagcagcaaacaaattgtagatatgcttgtgcagagtggggaataggtgttgaggtcaaacaagatgtcaagcgtcaagaaatcaaagcaattattaaggaaatgttagaaggtgaaagaagtaaggagttgaaagacaaggcgttggagtggaagaagaaagcagcagaagcaactgatattggagggtcttcatggaaacactttgatacattattggaaaaacttctccttaacaagga

SEQ ID NO: 1263 - DNA, 1396 bp, Solanum phureja
caaggtcatgtaataccattcatgaaattagccaaaattttgcactcaagaggtttctatgtaacatttgtcaacactgaatataaccatagacgtctaatccaatcccaaggccctgactttgagaaaagcttccaggatttcaaatttgaaactatcccggaaggattgccaccatcagatcgcgatgcaactcaagatcctgttttgttatgtgactcgataaggaagaactgcttgactccttttcaggatttactatcaaagcttatttcatcaccggtcattccaccaatttcttgtataatatcagatgggatgatgagctttgccattaaggcagcacaagaatttggcatccttgatgtccaattttggacagcctcagcttgtggttatatgggataccttcaatttgatgaactaagaagaagagggattatcccgtttaaagatgacagtttcatggaggatggtacactggatacaattgtcgatgggattccagtaaagagcaacattaggttgaaggacttgccaagctttatcaggactactgatccagatgatattctgttaaactatttaggcgatgaagcacaaaatagcttgaaatcttctgcagtgatcatcaacacattcactgaattggaatgcgaagtcctagaagcaattgaggctagattcccaaatatttatgttacaggtccactttcattgatggaaaaaactatcccagaaagcaaattgagctcatttaggccgagtttatggaaagaagaatttcaatgttattgaatcttacagagagaattgaacaaagttcagtaatttatgtgaattatggatgtatgactttaatgtcagaccatcacctgaaagaatttgcgtggggacttgccaatagcaaacacccattcttgtggatcgttaggcccgacataatgatgggggattcagccgtgttgcctgatgagtttcttgaagagattaaagacaggggactcttagcaagctggtgcccacaaaatcaagttctttcccatccatctattggcttttttctaacacattgtggatggaactctatgattgaaagcataggttcaggggttcctctaatttgctggccattctttgctgagcaacaaacaaattgtcaatatgcttgtgcagagtggggaataggtgtagaagtcaatcaagatgtcaagcgcgaagaaattgaagcaattattaaggatatgttggaaggtgaaaaaggtaaggagttgaaaggcaaggcggtggagtggaagaagaaagcagcagaagcaactgatattggagggccttcatggaaacattttgatacattcttggaaaaacttcttcttaacagggaatagcattgaat

SEQ ID NO: 1264 - DNA, 909 bp, Arabidopsis lyrata
agaattctgcttcggacattaagctcatgagtcatgacttcttcaatccatgagctttctgataacgttggaagtcatgagaagcaagaacagatagattctcatttccaaccaccaattcctcctggaagaaattatgaatcaattgctacaagtttagtctactcggaaccggttcctcacccggggagtacacattccatggcacctggacaatatccatatccagatccttactacagaagcatctttgcaccgcctccacaaccgtataccggggtacatctacagttgatgggaatacagcaacaaggtgttcctttaccatctgatgcagtcgaggaacctgtttttgttaacgcaaagcaataccacggtatactaaggcgaaggcaatctagagcaagacttgagtctcaaaataaagtcatcaagtcacgtaagccatatttgcatgaatctcggcatttgcatgcgataagacgaccaagaggatgtggcggtcggtttctaaatgccaagaaggacgacgagcatcacgaagacagtactcatgaagaaaattccaacctcagctctgataaatccgccatggctgcttctagtggtacatcttgagaaggtcatccaagtagctttgttgtattttggctctgtttggtctcagatcatctatgtctttagtctatgatatatacaaatctttgtagaaaggtatagataggttcttcggagcaattaggtaaacgtgaagtgggttttagacttgtgattattaaataaaccccactgaggaagaaaggaaataaataaatgtcataaagtttagttaaatagtacaatgctacttatattgttttgttgtaagaaattttggtaataaaacgaaaaatggaagaatccacaaac

SEQ ID NO: 1265 - DNA, 1433 bp, Arabidopsis lyrata
tttgttgagagaagaaaaaacataataaaggaaaaaaaaaagtgaaaaggagtcaagattagtcttttaagccatagccaatacccaatttgcagagacagaggaagagagaggaacgaaagaaacaaccatgttctgaggaaggagacatgcatcatcatcatcatcatcatcaagcatcataatcttattacttaacttctctttctctccatcttttaccaaatccaaaacaccaaagtttattgaagtaaagatttgaagacaatgcaagtgtttcaaaggaaagaatcatcttggggaaactcaataataccaacaaattcaaatattcaaggatctgaatcttttagcttgacaaaggatatgatgatgtctacaacacaattccccgggacgaaacattcgggtttgcagctgcaagatcaagattcaacctcatcacaatctactgaagaatcaggcggcggggaagttgcaagctttgaagaacataaccgttatggatgcagcattgttaataccaatctctcaggttacatcgaaaacccgggaaagcctattgaaaattatactaagtcaactactacctcgtcgatggtgtctcaagattctgtgtttcctgctcctacttctggtcaaatatcttggtctcttcaatgtgctgaaacatcacatttcaatggtttcttggctcctgaatatgcatcagcaccaacggtgctgccacatttagagatgatgggtttggtttcttcaagagtgccattgcctcataacattcaagagaatgaaccaatatttgtcaatgcaaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcagcaaactcactgtgttcttctcaaatggcaaatggacagaatttctctatgagctctcgcggtggtggaagcggactcgggtctagttcgatcacaccgagctccaattcgaaccgtatcaacatgttccaaaacccgcagttcagattctcaggttatccgtcaacacaccatgcgtcagctctcatgtcagggacttgaggcacctgagaaggatcttgctctgggagaactgcggcgactggtgatgatatatgacggaaagtcatccttggctacttttggttatcggttatttacaaaatttcttcctttaaaactttgctttcatatcctctgcaatctctcactctatatagagtggcttgaagaactttcaaatcattgtcaaactattttgttaattaaaactttccgattctctgagagtacaaattgcattaccc

SEQ ID NO: 1266 - DNA, 1687 bp, Arabidopsis lyrata
caacgtgaacacgcagcttatgctactcctccaatgatacgggtctcgaaatactcaaaactgtggcatgtctcaattccataaattatagtttaatcattctgcttctgcttattaattctctgcagataaactgcagaagaagaagcagccaaagcagaagaagatccgagcttgagccataataatcccttactatatagaatcacaaagaaaaaatgggattctggtcgttgttggaggtggcttctatgccggttattcaagttcttgtcatgagtcttgtgggagctttcttggcctctgatcgttgcaagctcttccctgttgaagcccgtaattccatgaacaaggtggtgtttgtactatttgcaccggctctcatgtttgccaatctagctcagacggtgacacttgaagacattatctcatggtggtttatgccggtgaacatgggacttacatttctaatcggaggacttcttgggtggatggttgttaagattttgaaaccacctccttatcttgaaggtcttattgttgcaacttgttctgcaggaaatatggggaacctaccaatcatacttgtcccagcaatctgcgacgaggacaagagtccgtttggtaaccgaagtgtatgtagaaccgtcgggctctcttacgcgtctttctccatggcgctagggggtttctacatatggacatacacatttcggttgataaaagggtccgcaatgagaattcaagccatagaagaatctgagagaacagcaattaaatcatccaatagcgacttagaggctgatcataagacccatctcctcggtgcacccgaagataaggaaaacaaagtggtaaaggaagagacagggttttggaggaaagtagtagacttcctccatgagatattggaggaacttctcgcaccacctacacttggtgcaattatcggtttcatcttcggtgcagttagatggctcagaaatcttatcataggtgatgatgctcctttacgaatagtacaaagcactgcaaaacttcttggagatgggaccattccttgtatgactattatactagggggcaacctcattcaaggattacgttcttcggcagtcaaaccagtggttgtacttggaatagtctgtgttcggtacataattatgccaattatcggtataggcattgtactaacagctgcaaatctcggatttcttccagcggatcctttgtttcagtatgttttgatgcttcagttcaccctcccacctgccatgaatatcggtaccatgacacagctgtacaatgttgcgcaagacgagtgctcagtgctcatgctttggacctacttggtcgcgatactggccctcactgtatggtccaccatcttccttcacttgttagtttaaagaacctgcaactctatgagaacaagaagattctttctctctactactacagagaccaaatatctgtgaagggatcttaccattctttttgtctatcacataaaatttgattgtaacttgatagatttttctggttgcatgtgtacctttctgcaaatcttcatttttctccatatccccatttgtaaaacgcaaatattgtatcaagtattacatcaagttaatgaaaaagcatattggatcaaaagtgatgcacctcccaaaactcgcatccatct

SEQ ID NO: 1267 - DNA, 763 bp, Arabidopsis lyrata
tttacttaaaaccaaaaaaaaaaaaagagcttaattcatttcttctccttcttcaaatggcgacgagcaagtgctactatccacggccaagccaccgtttcttcaccacagaccaacacgtcaccgccgcttccgatttcgagctagacgaatgggatctttacaataccggttcagattcaccttcaaatttcagctttagtgatcttacaatcacatccggtcgaaccggaactaaccggaaaattcacggtggttctggttccggttccggtacagctgcgtcttcgcttccggttaacgtaccggattggtctaagattcttggagacgagagtcgacgacagagacagatttataatgaggaagaagtcgacggagatgaaatttcatgcggcggaggaacacggcgtgttccgccgcatgaattgcttgcgaaccggaggatggcttcgttttcggttcatgaaggtgctgggaggacattgaaaggaagagatctgagtagggtgcgaaatactatttttaaaattagagggatcgaagattaattatcttttgggtacttcttttaatctttgtttaaattgggggttacatatagaaatatgaggggcttaaatcgaaatttgtaagagctgttttttttttggaattattttagtttctggattcgcatttcgtcttttttttacttaaaaagattgtattgaaattttgagacaccaaatatgaaaattgacttggtatttcttttataatt

SEQ ID NO: 1268 - DNA, 716 bp, Brassica napus
aaccaatatcttcttcttcatcatcttcttccttctcaaatggcgacgagcaaatgctactacccccggccaagccaccgattcttctccaccgaccaacacgtctcttctccttccgacttcgagctcgacgagtgggacctcttcaacaccggttcagattctgcttccggtttcaccttcagtgaccttacaatcacctccgatcgaaccggagctaaccggaagcctcgcggtggttcggtttcggagaaatttgccggttcagctgcgtcttctctcccggtcaacgtgcctgactggtccaagatcctcggggaagagagtccacggaggcagacttcgaacgaggaatacgacggtgacgaagttgctgcatgcggtggagagacacggcgggtgccgccgcatgagttgcttgcgagccggaggatggcttcgttttcggttcacgaaggtgctgggaggacgttgaaagggagagatctgagtagggtgcgaaatactattttcaaaattagagggatcgaagattaaactgttttaaatatggggggttgcaaattgaagaaattgtaatgggtggagttttttttaaattgtttttttttttgtaccttcgcttgttttactgttgcggctaagaatctcgacaactagtgattattataaagagacttgttaatttaagattgtattgaagttttgggacacca

SEQ ID NO: 1269 - DNA, 2157 bp, Arabidopsis lyrata
aggattttcttttctattgacgattataaagtaaaaagagcagctttgagaatttgattgttgatatccaaggatttggaagctagttttggttttaggacgttatccttttcgattatgagtgcatcatgggctgatgtggctgactcagagaacacgggttctgggtcttttaatcagaattctcatccctcacgacctgcttatgttcctccacatctaaggaacaggcctgcaacttctgagcctgttgctcctttgccagctaatgatcgtgtaggctttggtggtccaccttctgcctctcgatgggctcctggtggtagttctgttggtgttggtggtggttatagggctgatgcaggtcgccctggctctggctctggctatggtggacgaggaggtggtggttggaacaacagaagcggaggctgggaccgtagggaacgtgaagtaaacccctttgataatgatgattccgaaccagaaccagccttttctgagcaggataataccgtcattaattttgacgcctatgaagatattccaattgagaccagtggggataatgtgcctcctcctgttaacacattcgcagagatagatctcggggaggccttgaatctaaatatccgtagatgcaaatatgttaagccaacacctgtacagcgtcatgcgatcccgatattgcttgaagggagggatttgatggcctgtgctcagacagggtctgggaagacagctgctttttgctttccaattattagtgggataatgaaagatcagcatgtacagagaccccgtggttcacgaacagtctaccctcttgcagttattctctcaccaacaagagagttggcaagtcagatacatgatgaggctaaaaagttctcctaccaaactggtgtgaaggtggttgttgcatatggaggaacacctattaaccagcagctccgggaacttgagaggggagtcgatattcttgtggcaactcctggtcgattaaatgatttgctcgagagagctagagtctctatgcagatgattagatttttagctcttgatgaggccgatagaatgcttgacatgggttttgaaccacaaattagaaagattgtcgaacaaatggacatgcctccacgtggagttagacagacactgttgtttagtgctacttttcccagagaaattcagagactggcagctgacttcctagcgaattatatatttttggctgtgggtagagtgggttcaagtaccgatttaattgtccaaagggttgagtttgtccttgactctgacaaaagaagtcatctcatggacctgcttcacgctcagagagagaatggcatccaaggcaagcaagcgctgaccttagtttttgtggagacaaagaggggagctgactctttggaaaattggttgtgcatcaatgggtttccagcaacctccattcacggtgacagaacacaacaggaaagagaagtggcactgaaagccttcaagagtgggagaacaccgattttggttgcaaccgatgtagcagcacgtggccttgacattccccacgtggctcatgtggtcaacttcgatttaccaaatgacattgatgactatgtccaccgtattggacgaacaggacgtgctggcaagtcaggactagcaactgccttcttcaacgatggcaacacctcactggccagaccgctcgctgagctgatgcaagaagctaaccaggaagtccctgcgtggctcacacggtatgcatcacggtcttcttttggtggtggtaagaaccggaggtctggtggtcggtttggtggccgtgactttagaagggaagggtctttcggtagaggaggtggtggaggaggaggatatgggggcggaggaggctatggtggcggaggaggatatggtggcggaggaggctatggcggtggatatagtggtgctccaagtggaggatatggcggagaacctccaagtgcttgggactaagctcccaatgtttttttttttttgttttggttataacttttgacaaaaaaattcttctacattcacaaagagagagtatgtattgccccttacacctatgagatttcttcactcaagtgatggatatataacaattgttgatgttttaggtgtttt

SEQ ID NO: 1270 - DNA, 2530 bp, Arabidopsis lyrata
ttaacatgtctattttatcgcgttgtgtccgatccaaaaggtaaacatcgaatttagggtttttctctcccccgagcttttccgttgggtgaacgactaccgttgattttcttcgtttttgattcgattcgattctctctaccgatttttgaggttctttctctatatcctctcgttttttgtttccgcctacgtttatctctcgatttcgagctgtatcatcaactagctagggttccttaattgctccctgcttttggtttctttatttttgcggataagaaggataaagttatcgtttattgataagttttctgctgggaagttgcaactttttctagatttaggacgttacgaatttcaatcatgagtgcatcatgggcagatgtggctgattcagaaaaggccggttctaagccaaagacttcctacgttcccccacacctacggaacaggccatcagagcctgctgctgctcctttgccacaaaatgatcatgcagggtatggtggtcaaccagctgggtctcgatgggctcctcctagcagtgggggtggtggtggcaccggcggtggctataggaatgatggagggcgccctggctatggttatggtggaggaggaggtggtggtggtggctggaacaacagcagtggagggtggaaccgtaaggaacgtgaagtaaacccatttggagatgatgctgaactagaaccagtctttacagagcaagagaatacaggcattaattttgatgcctatgaagatattccagttgagaccagtgggggagacgtgccccctcctgttaacacatttgctgacatagatcttggggatgcattaaatctgaacatccggaggtgcaagtatgtgaggccaacaccggtacagcgtcatgctattccaatactgcttggacagagggatttgatggcctgtgcccagacagggtctgggaagacagctgctttttgctttccaataattagtggaatcatgaaagatcagcatgtacagagaccccgtggttcacgaacggtttaccctcttgcagtcatcctctcaccaacaagggagttggcatgccagatacatgatgaagccaaaaaattctcctaccaaactggtgtgaaggtcgttgttgcttatggaggaacacctattaaccagcagctcagggaactcgagaggggagttgatatccttgtggcaactcctggccggttaaatgatttgctagagagagctagagtctcaatgcagaggattaaatttttagctctagatgaggcagataggatgctggacatgggttttgagccacaaattagaaagattgttgaacagatggacatgcctccacgtggggagagacagacaatgttgttcagtgctacatttccaagggagatccagagacttgcagctgatttcatgtcaaactatatatttttggctgtgggaagagttggttcaagcactgatttaattacccaaaggattgagtttgtccaagagtctgacaagagaagccatctcatggacctgcttcacgcgcagagagagacccaagacaagcaatcattgacattggtttttgtggagacaaagaggggagctgatactttggaaaattggttgtgcatgaatgagtttccagcaacctccatacatggcgatagaacacaacaggaaagagaagtggcactgaggtccttcaaaagtgggaggacacctattttggttgcaacagatgtggcagcacgtggtcttgacattccccatgtggctcatgttgtgaactttgatctaccaaatgacattgatgactatgtccaccgtatcggacgaacaggacgtgccggcaaatctggaatagcaactgccttcttcaacgagaacaatgcacaaatggctaggttgcttgctgagctgatgcaagaagccaatcaagaggtgcccgagtggctcacacgatacgcttcacgtgcttcatttggtggtggtaagaaacggtctggtggtcggtttggtggccgtgacttcagaagggaaggctcttacagtagaggaggcggtggaggaggcggtggcaatgattactatggtggaggaggctatggtggtggtggatatggtggtgctccaagcggtgggtatggtgctggagtgaccagtgcttgggattagccgattaggctccccaatttttcctctttttaacccgactatttatttcttctcttctacattcccaagagagcacatgtattttcccccacctttgagatctctcattcaagagatggatttaactaatcttgcttttaggtggttctctctgttttttcaggctattttttttaggatttttcctaaaagataggcagtagttttttttccgattttgatcatgtgcttggtttcttctaacaatttcatttgttagtttgaaatccaatttgtctttttgtttccctttgttgttgacaatctttcttggtgaaatacaatctctctttatatc

SEQ ID NO: 1271 - DNA, 2576 bp, Arabidopsis thaliana
atatttttggcttaaggtcattttgaagattaataacatgtctattttatcgcgttgtgtccgatccagaaggtaaacatcgaatttagggtttttctctcccccgagcttgcttttccgttgggtgaacgactaccgttgattttcttcgtttttttggataccgattcgattctctctcaccgatttttgaggttctttctctatatcctctcgttttttgtttccgcctacgtttatctctcgatttcgagctgtatcaactagctagggttccttaattggtttatttcgtttgaggttctctatttttcgtggataagaagataaagttattgtttattgataagttttctgctgggaagttgcaactttttctagatttaggacgttacaaatttcaatcatgagtgcatcatgggcagatgtggctgattcagagaaggccgtttctcagtcaaagcctccttatgttcccccacacctacggaacaggccatcagagcctgttgctgctcctttgccacaaaatgatcatgcagggtatggtggtcaaccagctgggtctcgttgggctcctcctagcagtgggggtggtggtgccagcggcggtggctataggaatgatggagggcgcactggctatggttatggtgctggaggaggaggtggtggtggtggtggctggaacaacagaagtggagggtgggaccgtagggaacgtgaagtaaacccatttggagatgatgctgagttagaaccggtctttacagagcaggagaatactggcattaattttgatgcctatgaagatattccagttgagaccagtgggggagacgtgccccctcctgttaacacatttgctgacatagatcttggggatgcattaaatctgaacatccggaggtgcaagtatgtgaggccaacaccggtacagcgtcatgctattccaatactgcttgcagagagagatttgatggcctgtgcccagactgggtctgggaagactgctgctttttgctttccaataattagtggaatcatgaaagatcagcatgtagaaagaccccgtggttcacgggcggtttacccttttgcagtcatcctctcaccaacaagggaattggcatgccagatacatgatgaagccaaaaaattctcctaccaaactggtgtgaaggttgttgttgcttatggaggaacacccattcaccagcagctcagggaactcgagaggggatgtgatatccttgtggcaactcctggccggttaaatgatttgcttgaaagagctagagtctcaatgcagatgattaggtttttagctctagatgaggcagacaggatgctggacatgggttttgagccacagattagaaagattgttgagcagatggacatgcctccacgtggggtgagacagacaatgctgttcagtgctacatttccaagtcagattcagagacttgcagctgatttcatgtcaaactatatatttttggctgtgggaagagttggttcaagcactgatttaattacccaaagggttgagtttgtccaagagtctgacaagagaagccatctcatggacctgcttcacgcgcaaagagagacccaagacaagcaatcattgacattagtttttgtggagacaaagaggggagctgatactttggaaaattggctgtgcatgaatgagtttccagcaacctccattcatggcgatagaacacaacaggaaagagaagtggcactgaggtccttcaaaactgggaggacacctattttggttgcaacagacgtggcagcacgtggtcttgacattccccacgtggctcatgttgtaaacttcgatctaccaaatgacattgatgactatgtccaccgtatcggacgaacaggacgtgcaggcaaatctggaatagcaactgccttcttcaacgagaacaatgcacaactggctaggtcgcttgctgagctaatgcaagaagccaatcaagaggtccccgagtggctcacacgatatgcttcacgtgcttcatttggtggtggtaagaaacggtctggtggtcggtttggtggccgtgacttcagaagggaaggctcttacagtagaggaggaggcggcggcggcggaggaggcggcagtgattactatggcggaggaggctatggtggtggtggatacggtggtgctccaagcggtgggtatggtgctggagtgaccagtgcttgggattagccaattaggctccccaatttttcctctttttaacctgactatttatttcttctcttctacattcccaagagagcacgtgtatttgcccccacctttgagatctctcattcaagagatggatttaactaatcttgctattaggtggatctctctgttttttcaggctatttttaggatttgtcctaaaagatagacagtagtttttccgattttgatcttgttcttggtttcttctaacaatttcatttgttagtttgaaatccaatttgtctttttgtttccctttgttgttgacaatctttcttggtgaaatacaatctctctttatatc

SEQ ID NO: 1272 - DNA, 1594 bp, Arabidopsis lyrata
cattgcatttcctaacgctcaaaaatctctttctctctctctactaatatctctctcttgttgaagaagacgaagactcaaatcggagattgtttgtttggtttgctctggaattgaagaaaggttctgttgtggttgcttgagatcaaaatggctgggatttgttgcggtgttgttggagagactgaaccggcggcaccggttgattcaactactcgagcttctcttagacggaggttagatctacttccgtcgatcaagattgttgctgactccgccgttgctcctccgcttgagagttgtcgtaaaaggcagaagcgtgagacagtactgtcgagaaatctagatctggaatcgaatgtgaggagtgaacacaagaaggttaaatcagcggttacgaattcaaattccgttacggaagcagagagctgtttcttttccgatgtacctaggattggtacgacgtcggtttgtgggagaagaagagacatggaagacgctgtatctattcatccttcgtttcttcaacgaaactctgagaatcttcatttctacggtgtttttgacggccatggctgctctcatgttgcggagaagtgtagagaacggttgcatgatatagtgaagaaggaagttgaagttatggcttccgacgagtggaaagagacgatggtgaagagttttcaaaaaatggacaaagaagttagccagcgagagtgtaacttagttgttaatggtgcaaatcggagtatgaagaactcttgtagatgtgaattgcagtctcctcagtgcgatgccgtcggatccaccgctgttgtctctgttgtcacgccggagaagatcattgtttccaactgcggcgattctcgcgcggtactttgccgtaatggtgtagccattcctctatccgtagatcacaagccggatcgacccgatgaattgattcggatccagcaagcgggtgggcgggttatttattgggacggagctagggttcttggtgttcttgccatgtctagagcaattggtgacaattacttgaaaccatatgtgattccggatccggaggttacagtgacggatcgaaccgacgacgacgagtgtttgattttggcgagtgatggactatgggacgttgtaccaaatgagacggcatgtggtgtggctcgcatgtgccttcgaggtgctggtccgatggatggtgatgattctgatgcagctgcggcgcacaatgcgtgctccgatgctgcgttgctattgacgaagttggctctagcgagacagagctccgataacgtgagcgtcgtagtggttgacctgaggaagaggaggaataatcaatcgtcgtcttaattatataattagtgttttaattagtaatagtattagagaaattgttacataagcctaattgtaatttttcttattttttattttctattttagttttctcattgaaggtgttttttctttttttagttagctcttaattcaggctggggaagaaaaaaagctgattaaaaacttgcgtattttcttttatttttctcttaaggtactattttatatacatgtattcttttactatgggcgt

SEQ ID NO: 1273 - DNA, 1823 bp, Brassica napus
  misc_feature (1794)..(1795): n is a, c, g, or t
  misc_feature (1803)..(1803): n is a, c, g, or t
aacggtacgtgtcggatgctgcccgtcgatgggggcaactcattaagctttcattcacgccccctgcccgtaaattacgtgttacccttccatgcggaggaaaaaaaaaaaaaaaacttttcttttcccttttcctttttaaatcaaacctttcctttttaaaatccccattgcatttcttaacgctcaatatctctctctatttctctcttcgtctcagtgattgtatctgagaattgttttgtttattttgatctataattgaagttgttattgtggtgttgctgagatcaaatggctgggatttgctgcggtgttgttggggagagcgaaccggcggttacggtcgattcgtctactcgagcttctcttagacggaggttagatctactcccttcgatcaaaatagttgctcctccgcttgagagctcacgtaagcggcagaaacgtgagacaccgtcgggaaatcaagatctggaatcgaatgtacgtagcgagaggaacgtggagaagaaggcgcgatcatcaccggttaagaattcaaatttgattccgagctccgcgacggaagcagagagctgtttcgtctccgatgcgcctaagatcggaacgacgtcggtttgcggcaggagaagagacatggaagacgccgtctcggttcaccactcgctgatccacaaaaactccgagaatctccacttctacggcgttttcgacggccacggctgctctcacgtcgcggagaagtgcagggagcgtttgcatgagattgtcaagcgggacgtcgaagctatggccgccggaggagaggacgagtggaaggagacgatggcgaagagcttccagaagatggatcgagaagtttgccagcgagactctaacaacggtgcggcgagtcggagcgtgaagagctcgtgcagatgcgaattgcagtctcctcagtgcgacgccgtcggatccaccgccgtcgtgtccgtagtcacgccggagaagatcgtcgtctctaactgcggagactctcgcgccgtgctttgccgtaacggagtggccatccctctctcttcggatcataagccggatcgacccgatgaattgattcggatccaacaagcgggcgggcgggttatctactgggacggcgccagggttctaggagttctcgctatgtcgagagctattggtgataactacttaaaaccgtatgtgattccggatccggaggtagccgtaacggatcgaaccgacgacgacgagtgcttgatcttagcgagtgatggactctgggacgttgtgacgaacgagactgcgtgcggcgttgctcgcatgtgccttcaaggtgctgctgcggcggatggaggagactctgatacggcgcacaacgcgtgttcggacgctgcgttgctgttgacgaagctggctctggcgagacagagctccgataacgttagtgtcgtggtggttgacttgaggaaaaggaggagtaataatcaagtgtcttgatttagtgatttaattagtagtagtattagattagataaattgttacatacctaattgtaatttttgttgatttttattatttttctgttttagttttatcttgtttaaggttttttaaaacagctctttattcaagctcgggaagaaaaggagctgatttaaaagttgcgtattttcttttattttaggcattattatcatatacgtgtatttctctttttctaatcaattagagatgtaaacaagtattacgttaaaaaaaactgcagcccggccaatccagagtatgattcnnccccaccncggtccgtccagtatgggcc

SEQ ID NO: 1274 - DNA, 1674 bp, Brassica napus
aacggtacgtgtcggatgctgcccgtcgatgggggcaactcattaagctttcattcacgccccctgcccgtaaattacgtgttacccttccatgcggaggaaaaaaaaaaaaaaaacttttcttttcccttttcctttttaaatcaaacctttcctttttaaaatccccattgcatttcttaacgctcaatatctctctctctatttctctcttcgtctcagtgattgtatctgagaattgttttgtttattttgatctgtaattgaagttgttgctgagatcaaatggctgggatttgctgtggtgttgttggggagagtgaaccaacggttacggttgattcctctactcgagcttctctgagacggaggttagatctactcccttcgatcaaaatcgtcgctcctccactcgagagctcccgtaagcggcagaagcgtgagacaccgtcgggaaatcaagatctggaatcgaatgtacgtagtgagaggaacgtggagaagaaggcgcgatcatcaccggttaagaattcaaatttgattccgagctccgcgacggaagcagagagctgtttcgtctccgatgcgcctaagatcggaacgacgtcggtttgcgggaggagaagagacatggaagacgccgtctcggttcaccactcgctgatccacaaaaactccgagaatctccacttctacggcgttttcgacggccacggctgctctcacgtcgcggagaagtgcagggagcggttgcatgagatagtgaagcgggacgtcgaggctatggccgccggaggagaggacgagtggaaggagacgatggcgaagagcttccagaagatggatagagaagttagccagcgagactctaacggtgcggcgagtcggagcgtgaagagctcgtgcagatgcgaattgcagtctcctcagtgcgacgccgtcggatccaccgccgtcgtgtccgtagtcacgccggagaagatcgtcgtctctaactgcggagactctcgcgccgtgctttgccgtaacggagtggccatccctctctcttcagatcataagccggatcgacccgatgaattgattcggatccaacaagcgggcgggcgggtaatctactgggacggcgccagggttctaggagttctcgctatgtcgagagctattggtgataactacttaaaaccgtatgtgattccggatccggaggtgaccgtgacggatcgaacagacgacgacgagtgcttgatcttagcgagtgatggactctgggacgttgtgacgaacgagactgcgtgcggcgttgctcgcatgtgccttcaaggtgctgctgcggcggatggaggagactctgatacggcgcacaacgcgtgttcggacgctgcgttgctgttgacgaagctggctctggcgagacagagctccgataacgttagtgtcgtggtggttgacttgaggaaaaggaggagtaataatcaagtgtcttgatttagtgatttaattagtagtagtattagattagataaattgttacatacctaattgtaatttttgttgatttttattatttttctattttagttttatcttgtttaaggttttttaaaacagctctttattcaagctcgggaagaaaaggagctgatttaaaagttgcgtattttcttttatttt

SEQ ID NO: 1275 - DNA, 1511 bp, Brassica napus
  misc_feature (3)..(3): n is a, c, g, or t
atngcatttcttaacgctcaatatctctctctctatttctctcttcgtctcagtgattgtatctgagaattgttttgtttattttgatctgtaattgaagttgttgctgagatcaaatggctgggatttgctgtggtgttgttggggagagtgaaccaacggttacggttgattcctctactcgagcttctctgagacggaggttagatctactcccttcgatcaaaatcgtcgctcctccactcgagagctcccgtaagcggcagaagcgtgagacaccgtcgggaaatcaagatctggaatcgaatgtacgtagtgagaggaacgtggagaagaaggcgcgatcatcaccaccggttaagaattcaaatttgattccgagctccgcgacggaagcagagagctgtttcgtctccgatgcgcctaagatcggaacgacgtcggtttgcgggaggagaagagacatggaagacgccgtctcggttcaccactcgctgatccacaaaaactccgagaatctccacttctacggcgttttcgacggccacggctgctctcacgtcgcggagaagtgcagggagcggttgcatgagatagtgaagcgggacgtcgaggctatggccgccggaggagaggacgagtggaaggagacgatggcgaagagcttccagaagatggatagagaagttagccagcgagactctaacagtgcggcgagtcggagcgtgaagagctcgtgcagatgcgaattgcagtctcctcagtgcgacgccgtcggatccaccgccgtcgtgtccgtagtcacgccggagaagatcgtcgtctctaactgcggagactctcgcgccgtgctttgccgtaacggtgttgccatccctctctcttcagatcataagccggatcgacccgatgaattgattcggatccaacaagcgggcgggcgggtaatctactgggacggagctcgggttctaggagttctcgccatgtcgagagctattggtgataactatttaaaaccgtatgtgattccggatccggaggtgaccgtgacggatcgaacagacgacgacgagtgcttgatccttgcgagtgatggactctgggacgttgtgacgaacgagactgcgtgcggcgttgctcgcatgtgccttcaaggtgctgctgctgccgatggtggagactccgatacggcgcacaacgcgtgttcggacgcttcgttgcttctgacgaagctggctctggcgagacagagctccgataacgttagtgtcgtggtggttgacttgaggaaaaggaggagtaataatcaagtgtcttgatttagtgatttaattagtagtagtattagattagataaattgttacatacctaattgtaatttttgttgatttttattatttttctattttagttttatcttgtttaagttttttgttttaaaacagctcttaattcaggctggggaagaaaaggagctgattaaaaatttgcgtatatcttttatttt

SEQ ID NO: 1276 - DNA, 1576 bp, Brassica rapa
  misc_feature (389)..(389): n is a, c, g, or t
  misc_feature (435)..(435): n is a, c, g, or t
  misc_feature (579)..(579): n is a, c, g, or t
caatatctctctctctatttctctcttcgtctcagtgattgtatctgagaattgttttgtttattttgatctagtaattgaagttgttgctgagatcaaatggctgggatttgctgtggtgttgttggggagagtgaaccaacggttacggttgattcctctactcgagcttctctgagacggaggttagatctactcccttcgatcaaaatcgtcgctcctccactcgagagctcccgtaagcggcagaagcgtgagacaccgtcgggaaatcaagatctggaatcgaatgtacgtagtgagaggaacgtggagaagaaggcgcgatcatcaccaccggttaagaattcaaatttgattccgagctccgcgacggaagcagagagctntttcgtctccgatgcgcctaagatcggaacgacgtcggtttgcggnaggagaagagacatggaagacgccgtctcggttcaccactcgctgatccacaaaaactccgagaatctccacttctacggcgtgttcgacggccacggctgctctcacgtcgcggagaagtgcagggagcggttgcatgagatngtcaaacgggacgtcgaggctatggccgccggaggagaggacgagtggaaggagacgatggcgaagagcttccagaagatggatcgagaagttagccagcgagactctaataacggtgcagcgagtcggaacagcgtgaagagctcgtgcagatgcgaattgcagtctcctcagtgcgacgccgtcggatccaccgccgtcgtgtccgtagtcacgccggagaagatcgtcgtctctaactgcggcgactctcgtgccgtgctttgccgtaacggagtagccatccctctctcttcagatcataagccggatcgacctgatgaattgattcggatccaacaagcgggcgggcgggttatctactgggatggagctcgggttctaggagttctcgccatgtcgagagctattggtgataactatttaaaaccgtatgtgattccggatccggaggtaaccgtaacggatcgaacagacgacgacgagtgcttgatccttgcgagtgatggactctgggacgttgtgacgaacgagactgcgtgcggcgttgctcgcatgtgccttcaaggtgctgctgctgccgatggtggagactccgatacggtgcacaacgcgtgttcggacgcttcgttgcttctgacgaagctggctctggcgagacagagctccgataacgttagtgtcgtggtggttgacttgaggaaaaggaggagtaataatcaagtgtcttgatttagtgatttaattagtagtagtattagattagataaattgttacatacctaattgtaatttttgttgatttttattatttttctattttagttttatcttgttttaagtttttttttaaacagctcttaattcaagctgaggaaggaaaggagctgattaaaaagttgcgtatttcttttattttccatattttttttaggcattattatcatatacgtgtatttctctttttctaatcaattagagatgtaaaccctcgtgc

SEQ ID NO: 1277 - DNA, 1556 bp, Brassica napus
ccattgcatcttcttatatacctctctctcttcatctcagtgattgtatcttgcttgtttatttttgatcacatggctgggatttgctgtggtgttgttggggagagtgaaccggcggcaccggctgattccgttactcggacttctctcaaacggaggttggatctactcccgtcgatcaagatcgtcgccaaatccgccgtcgctcctccgcttgaaacctgccgtaaacgtcagaagcgtgagacaccgtctctcgttccgacgttaccggatctggaatcgaatatgaaggcgggatcagcggttacgaaatcaaattcgatttctagctccgccacggaggaggcagggagctctttcttctccgatgcgcctaagatcggtacgacgtcggtttgcgggaagaggagagacatggaagacgccgtatctcttcatccttcgcttctccggagaaactccgaggatattcacttctacggcgtgttcgacggccacggctgctctcacgtcgcggagaagtgcagagagcggttgcatgagatagtcaagcacgaggttgaagctatggcctccgataacgagtggaaggagacgatggcgaagagcttccagaagatggatagagaagtgagccagcgagatgcaagccggagcgcgaagagctcatgccgatgcgaattgcagtctcctcaatgggacgccgttggatccaccgccgtcgtgtccgtcgtcacgccggagaagatcgtcgtatctaattgcggcgactctcgcgccgtgctttgccgtaacgttctcgccatccctctctcttcagatcataagccggatcgacccgatgaattgaatcggatccaggaagcgggcgggcgggttatctactgggacggagctagggtcctaggagttctcgccatgtcgagagctattggtgataactacttgaaaccgtatgtgattccggatccggaagtaaccgtaacggatcgaacagaggatgacgagtgtttgattctggcgagtgatggactctgggacgttgtgacgaacgagacggcgtgtggcgtggctcgcatgtgtcttaaaggtgctgaggtggcggaaggaggaggagattctgatacggcgcacaacgcgtgctccgatgcggcgttgctattgacgaagctggctctggcgagacagagctctgataacgtgagcgttgttgtggttgacttgaggaaaagaaggaataattgagtatcttaattagtgctataattagcaatagactagataaattgttacatagctaattgtaatttttgttgattttattatttttctactttagttttctcttgttttaggtttttaatctgctcttagttcaggcttgggaagaaaaagagctgattaaaatgttacattgtttaattttaatttatcgtattatttgtttagcaaatattatatatatacacgcatttttatttctctttgtgttgacaaatataaatgtaaacaagtatattacgttaactgagagaaaaataaactgcttaagg

SEQ ID NO: 1278 - DNA, 1456 bp, Brassica napus
  misc_feature (1455)..(1455): n is a, c, g, or t
ccattgcatcttcttatatacctctctctcttcatctcagtgattgtatcttgcttgtttatttttgatcacatggctgggatttgctgtggtgttgttggggagagtgaaccggcggcaccggctgattccgttactcggacttctctcaaacggaggttggatctactcccgtcgatcaagatcgtcgccaaatccgccgtcgctcctccgcttgaaacctgccgtaaacgtcagaagcgtgagacaccgtctctcgttccgacgttaccggatctggaatcgaatatgaaggcgggatcagcggttacgaaatcaaattcgatttctagctccgccacggaggaggcagggagctctttcttctccgatgcgcctaagatcggtacgacgtcggtttgcgggaagaggagagacatggaagacgccgtatctcttcatccttcgcttctccggagaaactccgaggatattcacttctacggcgtgttcgacggccacggctgctctcacgtcgcggagaagtgcagagagcggttgcatgagatagtcaagcacgaggttgaagctatggcctccgataacgagtggaaggagacgatggcgaagagcttccagaagatggatagagaagtgagccagcgagatgcaagccggagcgcgaagagctcatgccgatgcgaattgcagtctcctcaatgggacgccgttggatccaccgccgtcgtgtccgtcgtcacgccggagaagatcgtcgtatctaattgcggcgactctcgcgccgtgctttgccgtaacgttctcgccatccctctctcttcagatcataagccggatcgacccgatgaattgaatcggatccaggaagcgggcgggcgggttatctactgggacggagctagggtcctaggagttctcgccatgtcgagagctattggtgataactacttgaaaccgtatgtgattccggatccggaagtaaccgtaacggatcgaacagaggatgacgagtgtttgattctggcgagtgatggactctgggacgttgtgacgaacgagacggcgtgtggcgtggctcgcatgtgtcttaaaggtgctgaggtggcggaaggaggaggagattctgatacggcgcacaacgcgtgctccgatgcggcgttgctattgacgaagctggctctggcgagacagagctctgataacgtgagcgttgttgtggttgacttgaggaaaagaaggaataattgagtatcttaattagtgctataattagcaatagactagataaattgttacatagctaattgtaatttttgttgattttattatttttctactttagttttctcttgttttaggtttttaatctgctcttagttcaggcttgggaagaaaaagagctgattaaaatgttacattgtttaattttaatttatcatattatttgtttagcana

SEQ ID NO: 1279 - DNA, 3079 bp, Arabidopsis lyrata
aaaaaggaattatcacaagacaagagatacaagagaaacatgtcgacttctttcacaatgatcggcggtgaaggtcgcaacagttaccaagaacattcgaaataccagggagcactggttatagctgcaaaggaaaaggtcaatgaagccatttccatgaaactcgatatcgactttacttcaaatcttgttaacatagcagattttggttgttcctctggaccaaacactttcacagcggtacaaaacataattgatgctgtggaaaacaagtataagaaagaaagtactatcgatggaatcgagttccaagttttcttcaatgattcttcgaacaacgatttcaacactctcttcaagacacttcctccggctagaagatatttcgcaactggagttccagcttctttctttggtcgtgtccttcctagaaatagtcttcatgtgggagtttcttcttattcactccacttcgtttccaagattcctaaggaaatcaaagaccgcgattcgcctgtttggaaccaggacatacattgctccggatcttcaaaagaagttacgaaattgtttctcgatcaatacaagatcgacttggggagtttcttgaacgcgagagctcaagagctcgtgtacggtggattgctattgattcttggatcatgtcgtccaaatggagttcaaatgtttgaaacggtcgaaggcatgatgattgatttcattggaagttctcttaatgaaattgctaaccagggtctaatagatcaacaaaagcttgacacttttaaattgcctatctatgctccacaagcggatgaattgaagcaaatcatcgaggataacgggtgtttcacgattgaggtattcgaaaaaattagtcactcaaagggggagtatcctttagaccccgagtttttgacggtctcgtttaaggtaacggttggaggatctgtagcttcaatatttggccaagatgcgatggagaaaacatatgagcttgtgaaagagaagacgcaagaaatgcttcctcaattagccaaagccaaacccggaatgcaatacctcattgtgcttcgaagaaactgatttccatggtcaatgtagatctttgaaacgagacttaaataatgtaattgcaatgatgtgtgtttgtgtgtgtatgtgttgtattgtttgttattttaaatagtctctttcgtttatgtatatcacaaatacatatcacaacattcatatttgcaatgtgccaaaatcctccgcgtgttaaatccatttgttcacagtttctcgttaaaagacaacaaatggtatcaatgtccacggaaaaattgcatacttgcacgcaatctcttcttcttcttccttcttctcgtagcttcaaatagattcatcaaaaaaagagtaaacaacatcaaaatccacataaccaaatcagaaaatgtcagtagttttactctcttctacttctgcaacaatcacaaaatcccaatccaaaaagattccctttttatctcccaccacaaaattcccattcaaagtctcaatttctccatcaagatcaaaacttttcaacaaccctttacgcgtggcggcgccaccgtcaatacccacttcggatccggcggaggagaagcggatcgaagaagagttcggcggagatacggaagaagaagagtctgagtttaagtggagagatcattggtatccagtttctttggtggaggatttggatccgaatgtaccaacccggtttcagctcttgggtcgagaccttgtcctctggtttgatcggaatgatcagaaatgggccgcctttgatgatctttgtcctcaccggctcgctcctttatctgaaggaaggttggatgagaatggacacttgcaatgttcgtatcatggatggtcctttagtgggtgtggatcttgcactaggattccacaagctgctacttcaggtcctgaagctcgtgctgttaaatccccgagagcttgcgctattaagtttccgacaatggtgtctcaaggtcttctctttgtgtggcctgatgaaaatggttgggatagagccaattcaattgaacctcctaggttgccagatgattttgatagaccagaattttcgacggtgacaattcagagggatcttttctatggatatgatactctcatggaaaatgtatctgatccttcccatatcgattttgctcatcacaaggttacaggaagaagagacagagccaaaccattgccgttcaaggtggagtcaagtgggccttggggtttccaaggtgcgaatgatgacaatccaaggataaccgcaaaatttgttgctccatgctattctttgaacaaaattgagattgatgcaaagctaccaatcttcggtaatcaaaaatgggtaatttggatttgctcatttaacataccaatggctccaggaaagacccgttccattgtttgcagcgcccgtaacttcttccaattctctgtaccaggacccgcttggtggcaggttgtaccgagatggtatgaacactggacatcaaacttggtctatgacggagacatgatcgtacttcaaggacaagagaaagtattcctctctaaatcaatggagtcaccggactacgacgtgaacaaacagtacacaaagctcacattcactccaacccaagcagaccgtttcgttctagccttcagaaactggctaagacggcatggcaagagtcagcctgaatggttcggctccaccacagctaaccaacctctcccttccactgtcttaaccaagcgtcagatgcttgatagatttgagcagcatacacaagtgtgttcctcctgcaaaggggcttacaacagtttccaaatcctcaagaagtttcttgttggcgcgacggttttctgtgccgccacagctggtgttccttctgatgtccagattcgactagttctggcgggtttatcactgatatcagctgcttctgcatatgctttacatgaacaagagaagaactttgtgtttagagattatgtccattctgaaatcgaatagatgtatatgtatgtatatgtacaatca

SEQ ID NO: 1280 - DNA, 1924 bp, Brassica napus
acgcggcgcccagctaatcaggcttttccagtcacgtcaggatggttcgtttgtcgtgaaaaaaaaggccccaacaagatggtgcctgcagatacgatccggtattcccgggatcgaacacgcgtccgcgcaatctcttcttcatctcttccttgttcttctcgcaggtttcagcaaaaatcattcctacgaaagaagcaatgtcagttgttttagtctcttcagcttcagcgacactcaccaaatctaaatccataaagattcccttcttatctcccaactccgcgaaattcccgtccagagtctcgatttctcctcaaagaccgaaacttctcgacagccctcttcgcgtggccgcgccaccctcagtacccacttcagatccggcggaggagagtcggatcgaagaagagcacggcggagataaggaagaagaagggtctgagttcaagtggagagatcactggtatccggtttctctggttgaagatctggatccgaattcgccaacccggtttcagctcctgggtcgagacctcgtcctgtggttcgatcggaacgatcagaaatgggccgcctttgatgacctctgtcctcaccggctcgctcctctctctgaaggaaggctggatgagaacggacacttgcagtgttcatatcatggatggtcttttgccgggtgtggatcttgcactaggattccacaggctgctacttcaggtcctgaagctcgcgctgttaaatctcctagagcttgcgctattaagttcccaacaatggtgtctcaaggtcttctctttgtgtggcctgatgaaaatggatgggacagagccaattccattgaaccccctaggttgccggatgacttcgataaaccagagttttcaacggtgacaattcaaagggatcttttctatggatatgatactctcatggaaaacgtatctgatccttcccatatcgattttgctcatcacaaggttacaggaagaagagatagagccaaaccattgcccttcaaggtggagtcaagtggtccttggggtttccaaggtgccaatgacgacagtccaaagataaccgcaaaattcgttgctccgtgctattctcttaacaaaattgagatagatgcgaagctaccgattgtcggtaaccaaaaatgggttatatggatttgctcattcaatataccaatggctccagggaagacccgttccattgtttgcagcgcccgtaacttcttccagttctctgtaccaggacctgcttggtggcaggttgtaccaagatggtacgaacactggacttccaacttagtctacgacggagacatgattgtacttcagggacaagagaaagtattcctctctaaatcaatggagtcaccagactacgatgtgaacaaacagtacacgaagctcacgttcactccaacacaagcagaccgtttcgttctagctttcaggaactggctcagacggtatggcaagagtcagcctgagtggttcggctccactgcagctaaccaacctctcccttccactgtcttaaccaagcgcgagatgctggatagatttgagcagcatacacaagtgtgttcctcttgcaaaggagcatacaacggtttccagatcgtcaagaagttccttgtcggaacaacggttttcttggccgccacggccggtgttccttcagatgtccagattcggttggttctggccggtttagctctaatctcggctgcttctgcatatgctttacatgagaaagagaagaacttcgtgttcagagattacgtgcattctgaaatcgaatagatatgtataatcatcatcatacaaaagcttttgtaaaatcatcagttacagaaaaaacctttgtaaaatcgaatagatatgtataatcatcatacaaatttacaagt

SEQ ID NO: 1281 - DNA, 1617 bp, Brassica napus
atgagcgtggtgctggtgagcagcgcgagcgcgaccctgaccaaaagcaaaagcattaaaattccgtttctgagcccgaacagcgcgaaatttccgagccgcgtgagcattagcccgcagcgccggaaactgctggatagcccgctgcgcgtggcggcgccgccgagcgtgccgaccagcgatccggcggaagaaagccgcattgaagaagaacatggcggcgataaagaagaagaaggcagcgaatttaaatggcgcgatcattggtatccggtgagcctggtggaagatctggatccgaacagcccgacccgctttcagctgctgggccgcgatctggtgctgtggtttgatcgcaacgatcagaaatgggcggcgtttgatgatctgtgcccgcatcgcctggcgccgctgagcgaaggccgcctggatgaaaacggccatctgcagtgcagctatcatggctggagctttgcgggctgcggcagctgcaccaaaattccgcaggcggcgaccagcggcccggaagcgcgcgcggtgaaaagcccgcgcgcgtgcgcgattaaatttccgaccatggtgagccagggcctgctgtttgtgtggccggatgaaaacggctgggatcgcgcgaacagcattgaaccgccgcgcctgccggatgattttgataaaccggaatttagcaccgtgaccattcagcgcgatctgttttatggctatgataccctgatggaaaacgtgagcgatccgagccatattgattttgcgcatcataaagtgaccggccgccgcgatcgcgcgaaaccgctgccgtttaaagtggaaagcagcggcccgtggggctttcagggcgcgaacgatgatagcccgaaaattaccgcgaaatttgtggcgccgtgctatagcctgaacaaaattgaaattgatgcgaaactgccgattgtgggcaaccagaaatgggtgatttggatttgcagctttaacattccgatggcgccgggcaaaacccgcagcattgtgtgcagcgcgcgcaacttttttcagtttagcgtgccgggcccggcgtggtggcaggtggtgccgcgctggtatgaacattggaccagcaacctggtgtatgatggcgatatgattgtgctgcagggccaggaaaaagtgtttctgagcaaaagcatggaaagcccggattatgatgtgaacaaacagtataccaaactgacctttaccccgacccaggcggatcgctttgtgctggcgtttcgcaactggctgcgccgctatggcaaaagccagccggaatggtttggcagcaccgcggcgaaccagccgctgccgagcaccgtgctgaccaaacgcgaaatgctggatcgctttgaacagcatacccaggtgtgcagcagctgcaaaggcgcgtataacggctttcagattgtgaaaaaatttctggtgggcaccaccgtgctgctggcggcgaccgcgggcgtgccgagcgatgtgcagattcgcctggtgctggcgggcctggcgctgattagcgcggcgagcgcgtatgcgctgcatgaaaaagaaaaaaactttgtgtttcgcgattatgtgcatagcgaaattgaatag

SEQ ID NO: 1282 - DNA, 1605 bp, Brassica napus
  misc_feature (125)..(126): n is a, c, g, or t
  misc_feature (484)..(486): n is a, c, g, or t
  misc_feature (631)..(631): n is a, c, g, or t
  misc_feature (633)..(633): n is a, c, g, or t
  misc_feature (820)..(820): n is a, c, g, or t
  misc_feature (856)..(856): n is a, c, g, or t
  misc_feature (1453)..(1453): n is a, c, g, or t
  misc_feature (1455)..(1455): n is a, c, g, or t
atgagcgtggtgctggtgagcagcgcgagcgcgaccctgaccaaaagcaaaagcattaaaattccgtttctgagcccgaacagcgcgaaatttccgagccgcgtgagcattagcccgcagcgccnnaaactgctggatagcccgctgcgcgtggcggcgccgccgagcgtgccgaccagcgatccggcggaagaaagccgcattgaagaagaacatggcgaagaaggcagcgaatttaaatggcgcgatcattggtatccggtgagcctggtggaagatctggatccgaacagcccgacccgctttcagctgctgggccgcgatctggtgctgtggtttgatcgcaacgatcagaaatgggcggcgtttgatgatctgtgcccgcatcgcctggcgccgctgagcgaaggccgcctggatgaaaacggccatctgcagtgcagctatcatggctggagctttgcgggctgcggcagctgcaccnnnattccgcaggcggcgaccagcggcccggaagcgcgcgcggtgaaaagcccgcgcgcgtgcgcgattaaatttccgaccatggtgagccagggcctgctgtttgtgtggccggatgaaaacggctgggatcgcgcgaacagcattnanccgccgcgcctgccggatgattttgataaaccggaatttagcaccgtgaccattcagcgcgatctgttttatggctatgataccctgatggaaaacgtgagcgatccgagccatattgattttgcgcatcataaagtgaccggccgccgcgatcgcgcgaaaccgctgccgtttaaagtggaaagcngcggcccgtggggctttcagggcgcgaacgatgatngcccgaaaattaccgcgaaatttgtggcgccgtgctatagcctgaacaaaattgaaattgatgcgaaactgccgattgtgggcaaccagaaatgggtgatttggatttgcagctttaacattccgatggcgccgggcaaaacccgcagcattgtgtgcagcgcgcgcaacttttttcagtttagcgtgccgggcccggcgtggtggcaggtggtgccgcgctggtatgaacattggaccagcaacctggtgtatgatggcgatatgattgtgctgcagggccaggaaaaagtgtttctgagcaaaagcatggaaagcccggattatgatgtgaacaaacagtataccaaactgacctttaccccgacccaggcggatcgctttgtgctggcgtttcgcaactggctgcgccgctatggcaaaagccagccggaatggtttggcagcaccgcggcgaaccagccgctgccgagcaccgtgctgaccaaacgcgaaatgctggatcgctttgaacagcatacccaggtgtgcagcagctgcaaaggcgcgtataacggctttcagattgtgaaaaaatttctggtgggcaccaccgtgntnctggcggcgaccgcgggcgtgccgagcgatgtgcagattcgcctggtgctggcgggcctggcgctgattagcgcggcgagcgcgtatgcgctgcatgaaaaagaaaaaaactttgtgtttcgcgattatgtgcatagcgaaattgaatag

SEQ ID NO: 1283 - DNA, 1778 bp, Brassica rapa
  misc_feature (699)..(699): n is a, c, g, or t
  misc_feature (716)..(716): n is a, c, g, or t
  misc_feature (753)..(753): n is a, c, g, or t
  misc_feature (772)..(772): n is a, c, g, or t
  misc_feature (776)..(776): n is a, c, g, or t
ttccttgttcttctcgcaggtttcagcaaaaatcattcctacgaaagaagcaatgtcagttgttttagtctcttcagcttcagcgacactcaccaaatctaaatccataaagattcccttcttatctcccaactcctccgcgaagttcccgtccagagtctcgatttctcctcaaagacggaaacttctcgacagccctcttcgcgtggcggcgccaccctcagtacccacttcagatccggcggaggagagtagtcggatcgaagaagagcacggcgaagaagggtctgagttcaagtggagagatcactggtatccggtttctctggttgaagatctggatccgaattcgcctacccggtttcagctcctgggtcgagacctcgtcctctggttcgatcggaacgatcagaaatgggccgcctttgatgacctctgtcctcaccgccttgctcctctctctgaaggaaggttggatgagaacggacacttgcagtgttcatatcatggatggtcttttgccgggtgtggatcttgcactaagattccacaggctgctacttcaggtcctgaagctcgcgctgttaagtctcctagagcttgcgctattaagttcccagcaatggtgtctcaaggtcttctctttgtgtggcctgatgaaaatggatgggacagagccaattccgttcaaccccctangttgccggatgacttcnataaaccagagttttcaacggtgacaattcaaagggntcttttctatgggtatganactntcatggaaaacgtatctgatccttcccatatcgattttgctcatcacaaggttacaggaagaagagacagagccaaaccattgcccttcaaggtggagtcaagtggtccttggggtttccaaggtgccaatgacgacagtccaaagataaccgcaaaattcgttgctccctgctattctcttaacaaaattgagatagatgcgaagctaccgattgtcggtaaccaaaaatgggttatatggatttgctcattcaatataccaatggctccagggaagacccgttccattgtttgcagcgcccgtaacttcttccagttctctgtaccaggacctgcttggtggcaggttgtaccaagatggtacgaacactggacttccaacttagtctacgacggagacatgattgtacttcagggacaagagaaagtattcctctctaaatcaatggagtcaccagactacgatgtgaacaaacagtacacgaagctcacgttcactccaacacaagcagaccgtttcgttctagctttcaggaactggctcagacggtatggcaagagtcagcctgagtggttcggctccactgcagctaaccaacctctcccttccactgtcttaaccaagcgcgagatgctggatagatttgagcagcatacacaagtgtgttcctcttgcaaaggagcatacaacggtttccagatcgtcaagaagttccttgtcggaacaacggttttcttggccgccacggccggtgttccttcagatgtccagattcggttggttctggccggtttagctctaatctcggctgcttctgcatatgctttacatgagaaagagaagaacttcgtgttcagagattacgtgcattctgaaatcgaatagatatgtataatcatcatcatacaaaaacttttgtaaaatcatcagttacagaaaaaacctttgtaaaatcgaatagatatgtataatcatcatacaaatttacagtatcactact

SEQ ID NO: 1284 - DNA, 2349 bp, Arabidopsis lyrata
atctttttctcttttgctcatttcccagaaacctttgtttcatttgcttcgtgtgcgatcgcgagaacaagggaaaattagggtttatattctcaagctttttcgagcaccattgatccttgatctaagatttttcttctattcgagtttcttaagggctttgatcaaactcaaaatcgaagaccaagacgttgaaggattctggtaaagctaagcaattatgagttcaaattcatgggctgatgtttctgaatcagagagggcaccatctggtgcttggggttattctcgtccgtctcgaaccaactatgttcctccacatcttaggagccgtacaccatcttcggagtttgttgctccttcacctggtaatgatcgtgggggatatggtggtgcaaatagtggttatggtggtcgaggccaaggttatggtggtcgaggttcgggctatggtggtagaggaggtgttgggggcggttggaataccagaagtggaggttgggaccgtagggatactgaaactaacccgtttggtaatgatggaaattcagacccggttgttaacgagcaggaaaacacagtcattaactttgaagcctatgaagatattcccatcgagacaagtggggataatgtgccaccccctgttaatacatttgcagagatagacctcggagaagttctgaatctaaatatccagaggtgcaaatatgtgaagccaactcctgtgcagcgtaatgcaattcccatattggctgccggaagggatttgatggcttgtgctcagacagggtctgggaagacagcagccttttgttttccgattattagtgggattatgaaggatcagcatatagagagaccacgcggagttcggggagtctatcctcttgctgtcattctctcaccaacaagggagttggcttgccagatacatgatgaagccagaaagttctcctatcaaactggagtgaaagttgtggttgcttacggaggaacaccagtcaaccaacagattagggagcttgaaagaggagttgatattcttgttgcaactcctgggagattaaatgatttgctcgagagaggtagagtctcattacagatggtaaaattcttggcacttgatgaggcggacagaatgctggacatgggttttgaaccacaaatcaggaagatcgttcagcagatggacatgcctcctcctggtgtccggcagacaatgttgttcagtgctacatttcctagggagatacagagacttgcatctgattttctttcaaattacatatttctggctgttgggagagtgggttcaagtacggatttaattgtccaaagagtagagtttgtccatgattctgacaaaagaagccatctaatggaccttcttcatgcccagagggagaacggtaaccaaggaaagcaagctttgactctagtttttgtggagacaaagaagggagctgactctttggagaattggttgtgcatcaatggtttcccagcaacgaccattcacggtgataggtcacaacaggaaagagaagtggcactgagatcattcaagactggacggacacctattttggttgcaaccgatgtggcagcacgtggtcttgacattccgcatgtggctcatgtagtgaactttgatctaccaaacgacattgatgactatgtccaccgtatcggacgaacaggacgtgcaggcaattcaggactagcaactgctttcttcaatgacaacaacacatcaatggccaagccactggctgagctaatgcaagaagcaaaccaggaggtccctgactggctgactcgatacgcatctcgtgcttcatttggaggtggtaagaaccggcggtctggtggacggtttggtggccgtgacttcaggagagaatcttttagccgaggcggtggtggtgctgactactatggtggtggtggtgggtatggaggcgttcctggtggtggctatggagcaatgcctggtgggtacggacccgtaccaggtggtggatatggaactgttcctggtggtggttatgcaccttatggtagaggtggtggtgcttactatggtggaggtcctggaggatatggaactgttcctagccaagggtatggtcctggagtggctagtgcgtgggattaagctttaacttcaattcttcaagaaccgattatgttctctctctctcacttatctctattgtttattattagggagcagccaccgatgtgtatgtttgctctttaaatggttatgtagtagacacgaatcgtctctttgttcactgtgaaaaaagaaaaacccctagtcgactattattttcatgagtt

SEQ ID NO: 1285 - DNA, 1006 bp, Arabidopsis lyrata
  misc_feature (33)..(33): n is a, c, g, or t
atactggagtccccgcggtggcggccgcttcanactactgattcccccgggctgcaggtcttcggcacgagggacacttggaacttgtctctaaaaccctagtcttcacgcttccgtctcaagtcaagtcaaccaccactgagtcttgcatcaatggagctatgatggtttctatctatatttgaataaagttttgatttttaattatcagaaatgggagattccgacagggattccggtggagggcaaaacgggaataatcccaacggacagtcctcgttgtctccaagagagcaagacaggttcttgccgatcgctaacgtcagcaggatcatgaagaaagccttgcccgccaacgccaagatctccaaagatgccaaagagacgatgcaggagtgtgtctccgagttcataagcttcgtcaccggagaggcatcggataagtgtcagaaggagaagaggaagacgatcaacggcgacgatttgctctgggctatgaccactctagggtttgaggattatgttgagccattgaaagtttacttgcagaggtttagggagatcgaaggggagaggactggactggggaggccacagactggtgctgaggtcggagagcatcagagagatgctgttggcgatggcgctgggttctacggtggtggtgggatgcagtatcaccaacatcatcagttccttcaccagcagaaccatatgtatggagccactggtggcggtagcgacagtggaggtggagctgcctccggtaggacaaggacttaaaagattggtgaagtggatctctgtatatagatacatttataaacatgcctattcatacccataagagttcgcaacatcaatctatttaaatatcatgttggttatgtaggctgtgtaaagaggatcaagtgtgtctgaaactatatgattcgctaacgaatctgctccgtttaatcttgtatttaaacctattggatttggatcacattgaatgcaaatgttt

SEQ ID NO: 1286 - DNA, 1844 bp, Arabidopsis lyrata
gtgatagaaatatacagtaacagaatattttctttggcctttattgacatattttagaagaaaaatagattacttccttgttttattattatttcactcatcatacgttgtagaaagggaaccgcaaagtgaaaaaacagttgcttcaccacgaggaacagatccatgtctgcttcttcctcctctaatcccatgtcccgtgacgaggcaaccctgcttccgtctgttcaagacaagtacggtggcgtgatgaccgagatgtctcatcccatggatccttctctcttctccacacttctccgatcctctctctctacctggactcttcagggcaagaagggagtgtggatcaaattgccaaagcagcttatcggtcttgctgaaactgctgttaaggaaggattctggtttcatcatgcggagaaagactacttgatgcttgtgtattggattcccaaagaagaccatacgcttcctgccaatgcatctcaccgtgttggcataggtgcctttgtcattaaccacaacagagaggtgttggtggttcaagagaagacagggagatttcaaggccaaggtatctggaagttccccaccggagttgtgaatgagggtgaagacatccatgatggctcagtcagagaggtgaaagaagagaccggagtggatacagaattcgaccaaatattggccttcagacaaacacacaaagcgttctttggaaagtcagatttgttcttcgtgtgcatgttaaagcccctttctttggagatcaatgcacaggagtcagagattgaggcagctcagtggatgccttgggaggaatacataaagcaaccatttgtacagaattatgagctattgaggtacatgacagaaatttgctctgctaaaaccaacggagactacgaaggtttcactcctctccgcgtcaccgcacctgatcaacaaggcaacttgtactacaacacccgcgacttacattcgcgcaattgaccttcttgctcaacaaacagagcattcctcacagattctaacgaagctggtttctttgctgcctctctatgtaagcattttgacacttgaatctgaaaacatttgcattcaatgtgatctaaatccaatagtttaaatacaagattaaacggagcagattcgttagcgaatcatattgtttcagacacacttgatccgctttacaaagcctatataaccaacatgatacttgaatatattgatgttacgagctcttatgggtatgaataggcatgttttttaatgtatctatatacagagatccactttcaccaatcttttaagtccttgtcctaccggaggcagctccacctccactgtcgctaccgccaccagtggctccatacatatggttctgctggtgaaggaactgatgatgttggtgatactgcatcccaccaccaccgtagaacccagcgccatctctctgatgctctccgacctcagcaccagtctgtggcctccccagtccagtcctctccccttcgatctccctaaacctctgcaagtaaactttcaatggctcaacataatcctcaaaccctagagtggtcatagcccagagcaaatcgtcgccgttgatcgtcttcctcttctccttctgacacttatccgatgcctctccggtgacgaagcttatgaactcggagacacactcctgcatcgtctctttggcatctttggagatcttggcgttggcgggcaaggctttcttcatgatcctgctgacgttagcgatcggcaagaacctgtcttgctctcttggagacaacgaggactgtccgttttgccctccaccggaatccctg

SEQ ID NO: 1287 - DNA, 933 bp, Brassica napus
atactggagtccccgcggtggcggccgcttcacactactgattcccccgggctgcaggtcttcggcacgagggacacttggaacttgtctctaaaaccctagtcttcacgcttccgtctcaagtcaagtcaaccaccactggtgttctatctatacttgaataaagttttgatttttaattttcagaatgggagattccgacagagattccggcggaggacaaaccgggaacaaccaaaacggacagtcttccctgtctccgcgagagcaagacaggttcctcccgatcgctaacgtgagccggatcatgaagaaagctttgccagcaaacgccaagatctccaaagacgctaaagagacgatgcaggagtgcgtctccgagtttataagcttcgtcaccggagaggcctcggataagtgtcagaaggagaagaggaagacgatcaacggcgacgatttgctttgggctatgaccactctagggtttgaggattatgttgaaccacttaaagtttacttgcagaggtttagggagatcgaaggggagaggactggacttgggaggccgcagactggtggtgaagctggggaggcatcagagagacggtggtgtcggcgacggcggtggaggatactacggtggtgggatggggatgcagtatcaacagcatcatcagtttcttcatcagcagaaccatatgtatgggtccacaggcggtggtggcggcggccacagtggaggaaggagttaaaaagatttggtgaagtggatctttgtatatagagatacatatatactcatcaaagtattttaagtaatcatgttggcttatgtaaaaatatgattttggggcttgtgtataagaggaacaagtgagacttgagagctactaggtatcgatccgtaagtcaagtcctaattataactaatct

SEQ ID NO: 1288 - DNA, 944 bp, Brassica napus
  misc_feature (40)..(40): n is a, c, g, or t
tcctcggcacgaggatttctcaaccctaaccgtatcatcnatggtgtgaagccatgatgatttgaaaaagagtgaagtctctgtttaatttcgtagtaattttcagaatgggggattcagacaaggactccggtggagggcaaaacggacagtctccgttgtctcccagagagcaagacaggttcctaccgatcgctaacgtgagccggatcatgaagaaggctttacccgcgaacgccaagatctccaaagatgctaaagagacgatgcaggagtgtgtctctgagtttataagcttcgtcaccggagaggcgtcggataagtgccagaaggagaagaggaagacgatcaacggcgacgatttgctctgggctatgaccactctagggttcgaggattacgttgagccgctgaaggtttacttgcagaggtttagggagatcgaaggggagagggctggactcgggaggccgcagacaggtggtgaaggtggagagcatcagagagatgctggtctgggcgatggaggtggattctacggcggtggtgggatgcagtatcaccagcatcatcagtttcttcaacagcagaaccgtatgtatgggtccacaggtggtggtgggggtgacggtggaggaggagctggctccggtaggacaagaacttaaaagagattggtgaaagtggatctctgtatatagatacatttataaacatgtaaaactatttaagtatcatgttggttatgtaaaactagattttgaggctgtgtaaagagagacccaagtgtgtatttgaaacaatatgattcgctcacggatctgctccgtttagtcttgtatttaagtgtcaatatgcttacaaagaaaccagctttgatgaaaactgtagagatttgctttgcttgttgtaagaaagaggaggggttaatggcggcctcgtgc

SEQ ID NO: 1289 - DNA, 934 bp, Brassica napus
  misc_feature (33)..(33): n is a, c, g, or t
  misc_feature (578)..(578): n is a, c, g, or t
atactggagtccccgcggtggcggccgcttcanactactgattcccccgggctgcaggtcttcggcacgagggacacttggaacttgtctctaaaaccctagtcttcacgcttccgtctcaagtcaagtcaaccaccactggtggtttctatctatacttgaataaagttttgatttttaattttcagaatgggagattccgacagagattccggcggaggacaaaccgggaacaaccaaaacggacagtcttccctgtctccgcgagagcaagacaggttcctcccgatcgctaacgtgagccggatcatgaagaaagctttgccagcaaacgccaagatctccaaagacgctaaagagacgatgcaggagtgcgtctccgagtttataagcttcgtcaccggagaggcctcggataagtgtcagaaggagaagaggaagacgatcaacggcgacgatttgctttgggctatgaccactctagggtttgaggattatgttgaaccacttaaagtttacttgcagaggtttagggagatcgaaggggagaggactggacttgggaggccgcagactgntggtgaagctggggagcatcagagagacggtggtgtcggcgacggcggtggaggatactacggtggtgggatggggatgcagtatcaacagcatcatcagtttcttcatcagcagaaccatatgtatgggtccacaggcggtggtggcggcggccacagtggaggaaggagttaaaaagatttggtgaagtggatctttgtatatagagatacatatatactcatcaaagtattttaagtaatcatgttggcttatgtaaaaatatgattttggggcttgtgtataagaggaacaagtgagacttgagagctactaggtatcgatccgtaagtcaagtcctaattataactaatct

SEQ ID NO: 1290 - DNA, 990 bp, Raphanus sativus
  misc_feature (57)..(57): n is a, c, g, or t
ggaagtgaacataagtcgtgcatcgtcgctttataaaatcgccggcgactcttacantcccagcagacactttcaattcaatttctaaaaccctaatttttctcgcttcagtcaaccaccactgcactgtacacatcgatggtgaagaagccatgatgatttgaaaaagagtgaagtatctgttttttcttttcttacatttcttattaattttcagaatgggggattccgacaaggactccggtggaggacaaaacggacagtctccgttgtctccaagagagcaagacaggttcctaccgatcgctaacgtgagccggatcatgaagaaggccttgccggcaaacgccaagatctccaaagatgctaaagagacgatgcaggagtgcgtctccgagtttataagcttcgtcacgggagaggcgtcggataagtgccagaaggagaagaggaagacgatcaacggcgacgatttgctttgggctatgaccactctagggttcgaggattacgttgagccgctgaaggtttacttgcagaggtttagggagatcgaaggggagagggctggacttgggaggccacatacaggtggcgaagctggagagcatcagagagatgcaggtgttggtgagggcggtgggttttacggtggtgggatgcagtatcaccagcatcagtttcttcaccaccagcagaaccatatgtatgggtcaacaggcggtgacggtggaggaggagctgcctccggtaggacaaggacctgagagattggtgagagtggatctctgtatatagatacatttataaacatgcctattcatacccataagagttcgcaacatcaatctatttaaatatcatgttggttatgtaggctgtgtaaagaggatcaagtgtgtctggaactatatgattcgctaacgaatctgctccgtttaatcttgtatttaaactattggatttggatcacattgaatgcaaatgttt

SEQ ID NO: 1291 - DNA, 888 bp, Brassica rapa
  misc_feature (874)..(874): n is a, c, g, or t
gacacttggaacttgtctctaaaaccctagtcttctcgcttccgtctcaagtcaagtcaaccaccactgagtcttgcatcaatggagctatgatggtttctatctgtatttgaataaagttttgatttttaattttcagaatgggagattccgacagagattccggcggaggacaaaccggaaacaaccaaaacggacagtcttccttgtctccgcgagagcaagacaggttcctcccgatcgctaacgtgagccggatcatgaagaaagctttgccagcgaacgccaagatctcaaaggacgctaaagagacgatgcaggagtgcgtctccgagtttataagcttcgtcaccggagaggcgtcggataagtgtcagaaggagaagaggaagacgatcaacggagacgatttgctctgggctatgaccactctagggtttgaggattatgttgaaccacttaaagtttacttgcagaggtttagggagatcgaaggggagaggactggacttgggaggccgcagacaggtggtgaagccggagagcatcagagagacggcgatggcggtggaggatactacggtggtgggatggggatggggtatcaacagcatcatcagtttcttcaacagcagaaccatatgtatgggtctacaggcggtggtggtggcggccatagtggaggaagaagttaaaaagatttggtgaagtggatctttgtatatagagatacatatatatatatatatatatatatatatatatatatactcatcaaagtattttaagtatcatcatgttggtttatgtaaaaatatgattttggggcttgtgtaaagaggatcaagtgtgtttgagaacaaataggatcatntgctccgtttgata

SEQ ID NO: 1292 - DNA, 935 bp, Raphanus sativus
  misc_feature (252)..(252): n is a, c, g, or t
  misc_feature (256)..(256): n is a, c, g, or t
  misc_feature (645)..(645): n is a, c, g, or t
  misc_feature (656)..(656): n is a, c, g, or t
  misc_feature (666)..(666): n is a, c, g, or t
  misc_feature (671)..(671): n is a, c, g, or t
  misc_feature (707)..(708): n is a, c, g, or t
  misc_feature (739)..(739): n is a, c, g, or t
  misc_feature (775)..(775): n is a, c, g, or t
  misc_feature (789)..(789): n is a, c, g, or t
  misc_feature (804)..(804): n is a, c, g, or t
  misc_feature (870)..(870): n is a, c, g, or t
agacactttcaattcaatttctaaaaccctaatttttctcgcttcagtcaaccaccactgcactgtacacatcgatggtgaagaagccatgatgatttgaaaaaagagtgaagtttctgtttttttcttttcttacatttcttattaattttcagaatgggtgattccgacaaggactccggtggagggcaaaacggacagtctccgttgtctcccagagagcaagacaggttcctaccgatcgctaacgtnagcnggatcatgaagaaggccttgccggcgaacgccaagatctccaaagatgctaaagagacgatgcaggagtgcgtctccgagtttataagcttcgtcacgggagaggcgtcggataagtgccagaaggagaagaggaagacgatcaacggcgacgatttgctttgggctatgaccactctagggttcgaggattacgttgagccgctgaaggtttacttgcagaggtttagggagatcgaaggggagagggctggacttgggaggccacaacatacaggtggtgaagctggagagcatcagagagatggaggtggattctacggtggtggtgggatgcagtatcaccagcatcatcagtttcttcaccagcagaaccatatgtatggatcnacaggcggtgnaggtggaggnggagntggctccggtaggacaaggacttgaaagattggtgnnagtggatctctgtatatagaaatacatttanaaacatgcctattcatacgcttaagagttcgtaacntcaatctatacaantatcatgttggttangtaaagttagattttgaggctgtgtaaagaggatcaagtgtgtctgaaactatatgattcgctaanggatctgctccgtttagtcttgtatttaaacctattggatttggtttgataattttttttgtgat

SEQ ID NO: 1293 - DNA, 1758 bp, Raphanus sativus
  misc_feature (133)..(133): n is a, c, g, or t
  misc_feature (456)..(456): n is a, c, g, or t
  misc_feature (927)..(927): n is a, c, g, or t
  misc_feature (941)..(941): n is a, c, g, or t
  misc_feature (966)..(967): n is a, c, g, or t
  misc_feature (983)..(983): n is a, c, g, or t
  misc_feature (999)..(1000): n is a, c, g, or t
  misc_feature (1002)..(1002): n is a, c, g, or t
  misc_feature (1004)..(1004): n is a, c, g, or t
  misc_feature (1700)..(1700): n is a, c, g, or t
tgttttccggctgatgggttctctgcgtttcgcagggtctcaacggcgacgaggaacagatccatgtccgcttcttcttcctcctccacgaacccgatggctggtgaggaggcgaataacggaggcgttacantgcttccggtggttgaagacaagtacggtggcgtgatgacggagattagccatcccatggatccttctgccttctctgctcttctccagtcatctctctctacctggactcttcagggaaagaagggagtgtggatcaaattgccgagacagcttatcggtcttgctgaagctgctgtcaaggagggattctggtttcatcacgcggagaaggactacttgatgcttgtgtattggattcccaaagtaggcgatacgattccttccaatgcatctcaccgtgttggcataggtgcctttgtcctcaaccacaagaaagaggtnctggtggttcaagagaagacaggaaggtttcaaggccaaggtatctggaagttccccaccggagtagtcaatgagggtgaatatatccatgatggctcggtcagagaggtgaaagaagagacaggagtggatacagaatttgtccaagtattggctttcagacagacccacaaagctttctttgaaaagtcagatttgttcttcgtgtgcatgttaaaccccctttctttggagatcaacgcacaggagactgagatagaggctgctcagtggatgccgtgggaggaatacacaaagcaaccattcgtacagaaccatgagctactaagatatatgacagccatttgctctgctaaaaccaacggtgactacgaaggcttcactcctctccgtgtctctgcacctgatcaacaaggcaacttgtacttcaacacccgcgacctccgttcccgccattaacccctctttctnacaacaagcaaagnaagtcccctacagttttcatcaaanntggtttctttgctgcntctctatgtaagcatnntnanacttgaatctgaaaacatttgcattcaatgtgatctaaatccaatagtttaaatacaagattagacggagcagattcgttagcgaatcctattgtttcagacacacttgatccgctttacaaagcctatataaccaacatgatacttgaatatattgatgttacgagctcttatgggtatgaataggcatgttttttaatgtatctatatacagagatccacttccaccaatctttcaagtccttgtcctaccggagccagctccaccaccaccgctacctgtggatccattcatatggttctgctggtgaagaaactgatgatgctggtgatactgcatcccaccaccaccgtagaatcacctccatcttgctgatgctctccagcttcaccacctgtatgtggcctcccaagtccacccctctccccttcgatctccctaaacctctgcaagtaaaccttcagcggctcaacgtaatcctcgaaccctagagtggtcatagcccaaagcaaatcgtcgccgttgatcgtcttcctcttctccttctggcacttatccgacgcctctcccgtgacgaagcttataaactcggagacgcactcctgcatcgtctctttagcatctttggagatcttggcgttcgccggcaaggccttcttcatgatcctgctaacgttagcgatcggtaggaaccngtcttgttctctgggagacaacgcagactgtccgttttgccctccaccggagtccttg

SEQ ID NO: 1294 - DNA, 2329 bp, Brachypodium distachyon
accctccgcctcgttaccctatgccttccatcgccaccgttgccgagcccatggctgtcgacgactccgcctccaagaaggccaagcgcaagcagctcaaggccgagaccgctgcggccgaggcgatggagacggcctcatcgggaaagaaggagaagaaggagaaaaagcgcaaggcgaaggagccatcccctcctcctcccgcctccgacgaggaggagaggagtagcaccagctccgattcggagccggcgcccgcggcaaagaaggccaagaaggaaaagaaggacaagaagaagaagtccgaggaggaggtggatgacgacggtgagctgaccgccagcggcggcgacgaggatcccgccgacccaaatgcgcttgctaatttccggatttccgagccgctgaagcagaagctcaagtccaaggggatcaacgcgctgttccccatccaggccaccaccttcggccttgtcctcgacggccacgacttggtcggccgcgcgcgcactggacagggtaaaactctggcttttgttctgcccatattggagtcattggttaacgggccacacaaggcaacgagacgaaccgactacggtaggcttccaagtgttttggttctgctacctaccagagagctagccaatcaggtgcacgctgactttgagttttatggtggagcatttgggctttctacatgttgcgcatatggtggttcgcactatcgtccccaggaaatggcaatgagaaagggggttgatattgttgttgggactcctggccgtgtcaaggatttcattgtaaagggaactctcaatctgaagtctctgaaatttcgtgtccttgatgaggctgatgagatgcttaacatgggatttgttgacgatgttgaacttattcttggcaaggttgaagatgttacaaaagtacaaacacttcttttcagtgcgactctcccagagtgggtaaagaagctctctatgaggtttctgaaagctgacaagaagacggttgatcttgttggcaatgagaaaatgaaagctagttcatcagtcaagcatcttgctcttccttgtaaccgtgctgcaaggtcacaaattattccagacatcattaaatgctatagccgtggtggacggaccattattttcacggagacaaaagaatcagcatcagagctgtctggtttgattcctggatcccgtgcattgcatggagatatcgcgcaagctcaacgagaagttgttattgctggattcaggagcgggaagtttcttgttttggttgctacaaatgtggcagcacgaggtctggacatcaatgatgtgcagcttatcattcagtgtgagcctccacgtgatgttgaagcttacatacaccggtcaggtcggacagggagagcaggaaatactggcgttgctgtcatgctttttgaacccagatataaatatagtgtgaccagaatagagagggagtctggggtgaagtttgaacatatatctgcgccacagcctactgatgtggcacaatctgctggcaatgaagcagcagatgccattgcaagtgtctcggacagtgttattcctgttttccggcaacaagcagaggaactgttgagctcttccagcatgtctgctgtcgatctactagccaaagcacttgcaaaggcagttggttacactgacataaagaagagatctttgctttcttctatggagaactacactacgttacaacttcaaactggcaggccgatgtatacaccagggtttgcccttactactttgaagaggttcatgccagaagataaactttcagatgtacatggtataaccctcaccgctgatgggactggtgctgtatttgatgttccttcagcagaggttcaagattatattctaggctctgagaacgcggccatggtgacgcttgatgaagtgaaacaactgccaccgttgcaagagagggagcagcagtcaaggggcaattctggtgggtcaaggtttggccgaggcggcggtggcaggagatttgggggtggtggtggccgaggcggcggtggtagaggcaggggcggcggcgggaggttcaacaggaggtgaacactgagcagtacatccatttttgcgggattttgagtgagaaggcacagggaatcatcaaagttttgactgcgccgtgtatcgttttttctatttgtttgttaacgtctgtccctgagattatggcgatcaagtttgctagccggaagaatgtagaactgaactgtagaatattgatccgagactcatccactcttatgaatgaagctatatatgttgttttg

SEQ ID NO: 1295 - DNA, 2381 bp, Avena sativa
gctgcgcatcctcgccagcctcccaccctcccgcccgccgcagccgccacccgttctcacctgtcgatgccttccatcgccgccaccgccgagcccatggccgtcgacgactccgcctccaagaaggccaagcgcaagcagctcaaggccgccgaggccgaggcggctgccgccgccgccgcctcctcgggcaagaaggagaagaaggagaagaaagagaagaagcgcaaggccaaggagccgtcctcctccgacgaggagggcaggagcagcaccagctccgagtcggagcctgcgcccaagaaggccaagaaggagaagaaggccaagaaggtcgaagccgaggaggaggaggggaacgacgacggggagctcaccgccagcggcgaggacgagcccgccgaccccaacgcgctcgacaacttcaggatttccgagccgctcaagcacaagctgagggagaagggcatcaaggcgctgttcccaatccaggccaccaccttcagcctcctcctcgacggcaacgaccttgtcggccgtgctcgcactggacagggcaaaacactggcttttgttctacccatactggagtcattggttaatgggccacacaaggcaacccgaaggtctgattacggcaggcctccgagtgttctggttctgcttcctacaagggagctagccaatcaggtgcacgcggactttgagtgttatggtggagcatttgggctttctacatgctgtgcttatgggggctctccctatcgtcctcaagagatggcaatgagaaagggggttgacattgttgttgggactcctggccgtgtcaaggatttaattgtgaagggaacactcaatttgaagtccttgaaattccgtgtccttgatgaggctgatgaaatgcttaacatggggtttgttgacgatgttgagcttattcttggcaaagttgacgatgtcacaaaagtacagactcttctgttcagtgctactctacctgagtgggtaaagaagctctcaatgaggttcctgaaagctgacaagaagactgttgatcttgttggcaatgagaaaatgaaagctagtgcatctgtcaggcatcttgctcttccttgtaaccgtgctgcaaggcagcgagttattccagacatcattcgatgctatagccatggagggcgaaccattattttcactgagacaaaagattctgcatcagagctcgctggcttgattcctggctcccgtgccttgcatggagatatcgcgcaagctcaacgtgaagtagttattgctggattcagaagtgggaagtttcttgttctggttgctacaaatgtggcagcgcgaggccttgatattaatgatgtgcagcttatcattcagtgcgagcctccaaaggatgttgaagcttacatccaccggtcaggtcgcacagggagagcagggaatactggcattgcggtcatgctttttgaacccagatataaattcggtttgaccagaatagagagggagtctggggtgaagtttgaacatgtgtctgcgccgcagcctagcgatgtggcacaatctgctggcaatgaagcagcagaagccattgcaagcgtgtctgacagtgttattcctgtcttccggcaacaagcagaggagctgttaagctcttccagcatgtctgcagttgatctactagccaaagcccttgcaaaggcagttgggtacactgacataaagaagagatctttgctttcttctatggagaactgtacaacattgcagcttacaactggcagttcgatgtatacaccatcgtatgttatttctactttgaaaaggttcatgccagaagatagactttcaaatgtacagggtgtagctctcaccactgatgggagaggcgctgtatttgatgttccttcagcagaggtccaagattatcttctaggtgccgagaacgcagctggtgtgacacttgatgaagtgaaggaactgccagccttgcaagagagggagcagcagtcaagaggtggtgggtcgaggtggggtggtggaggtggcggccgtggtggtggaggcaggagatttggcggcggtggtggcggccgaggtggtttcggcgggagaggcaggggtggcggtggaaggtttggcaggaggtgaaacacctgagagcagcagcataatctatttttgatgggagtttgagagaggcacagggaatcgtcaaagttttgactgcgccgtgtatcgggttttttctttatttgttagtgtttgtccccgagattatgacgatcaagtttgcccactggaagagtgtaaaatgtttgatctgatacttaactttttaagacactgttatgaatgaagctatatgtgttgtt

SEQ ID NO: 1296 - DNA, 2440 bp, Zea mays
ctcttttccggctgcgccttcccctcgcagccgccagtcctcaacgccactatcagcagccaccgcccgttacttgtgatgtctcccgccctcgccgctgccgtggagcccatggccgtcgacgactccgcctccaagaaggccaagcgcaagcagctcaaggccgctgccgctgccgccgccgcggaggcagaggaggaggctgcttcggccaagaagaaagagaagaaggagaagaagcggaaagcgaaggagccgtcccctccgctcccgtcggccgcatcatctggcgaggagaagagcagcaccagctccgaggagacagcccccaccgcgaagaaggcgaagaaggacaagacgaagaagaatgtcgaggtctcgtcttcagcctcagatgacgacggcgagatcacggccggcagcgacgaggaccccgcggacccgaacgcgctgacgaacttcaggatatcggagccactgaggcagagcctcaggtccaaggggatcaaggcactgttccccatccaggccaccactttcgacctcgtactcgacggcagcgacttggttggccgagcgcgcaccggtcagggaaaaactttggcttttgtcttgcccatattggaatctttggttaacggggcaaataaggcatctaggcggactgaacatggcaggaccccaagtgttctcgttctgctaccaacaagagagctggccaatcaggtgcatgccgactttgagttttatggtgcaacatttgggctttctgcatgttgtgtgtatgggggttcaccttatcgtcctcaagaaatggcattgagaagaggtgtggacattgttgttggaactcctggtcgtatcaaggattttattgtaaaaggaactctcaacttgaaatgcttgaagttccgtgtccttgacgaagctgatgagatgcttaacatgggctttgttgatgatgtcgagctcattcttggcaaggtagaagatgctaccaaagtacagacacttctgttcagtgccactctgccagattgggtgaataagctctctatgaggtttctgaaagttgacaggaaaacagttgatcttgtcggtaacgagaaactgaaggccagtgcatctgttaagcaccttgctcttccttgtaacaaggcagcaagggcacaacttattccagatattatccgatgttacagccatggaggccgaaccattatcttcactgagacgaaggattctgcatcagagctttctggtttgattcctggatcccgtgccttgcatggagatgttgtgcaagctcagcgtgaagtcattcttgctggatttcgtagcgggaagttccaggttttggttgctacaaatgtggcggctcgtggtctggatattaatgatgtgcagcttatcattcagtgtgaacctccccgtgacgttgaagcttacatacaccggtcaggtcggacagggagagcaggtaatactggtgttgctgtcatgctttatgagcccagatataagtacagtgtcagcagactagaaagggaatctggggttaagttcgagcatatctctgcaccacaacctactgatgtagcacaatctgctggcagtgaagctgcagatgccattgcgagtgtgtcagacagtgttattcctgtcttcaggcagcaagcagagcagttgctaagctcttccactctgtctgcagctgacttgcttgccaaagctcttgcaaaggcagttggttacacggacataaagaaaaggtcattgttgtcttcaatggaggattacgctacactacatcttcaaactggcagacagatgtggtcacctgggtttgcttttactatattgaaaaggttcatgccagaagagaaacttgcagatgtaaagggtgcaaccctcacggctgatggaacgggggttgtatttgatgttcctgcagcagatgttgaagattacattcaagcttcggagaatgccgcacaggtgacaattgatgaagtccagcaattgccacccttgcaagagaagcagcagcagcagtcaagaggcaactcggggggaggaagatttggccgtggaggtggcgggagattctctggtggtggccgtgggggcggcttcggtggtggtgggagaggcagaggtggtggtggcggcaggggaggcggcggcaatagatttaacaggaggaattagaagctgctgcaatcttaacggacgtttcagtgacgtagttttgaggaagagggggagggaatattctcagttttggctgcaattgtatcgggttttgtttatttgttagcgttcgtcaacgagaatacgacacacatttttgccaacgcaagaattcgcgtttatctactcgaaatcaaccaatgtgttattactaagtaaagctataaacctattgttttaacttgac

SEQ ID NO: 1297 - DNA, 2382 bp, Oryza sativa
ctcttcccccccggctgcgtctcctcctcctccgccgccgccgccgccgcctccttctccgacgatgccttccctccccgtcgccgccgccgagccgatggccgtcgacgagtcggcctccaagaagtcgaagcgcaagctgaaggcggcggaggtggaggtggaggcctcgtcgaggaagaaggagaagaaggagaagaagcggaaggcgaaggagccgtcgccatcgtcctcctcctcatccgaggaggaggagaggagcagcacgagctccgacgagccggcgcccgccgcgaagaaggcgaagaaggagaagacgaaggagaaggtggtggtggaggaggaggaggaggacgacgacgaaggggagctcaccgccagcggcgacgaggatcccgccgaccccaacgcgctcgccaacttcaggatctcggagtcgctcagggagaagctcaagtccaaggggatcaaggcgctgttccccatccaggccaccaccttcgatctcgtcctcgacggccacgacctggtcggccgcgcgcgcactggacagggaaaaacattggcttttgttctaccgatacttgagtcattagttaatgggacacacaaggcatccagaaggactgattatggcaggcctccaactgttttggttctgttgcctaccagagagctagccaagcaggtgcacacagactttgcattttatggtgcaacatttgggctatctgcatgctgcgtatatgggggttctgattatcgttctcaagaaatggcaatcagaaagggggttgacattgttgttggaactcctggtcgtgtgaaggactttgttgaaaagggaaccctcaattttaggtctttgaaattccgtgtccttgatgaggctgatgagatgcttaatatgggcttcgttgatgatgttgagcttattcttggcaaagttgaagatgttacaaaagtacagacacttctcttcagcgctactataccagagtgggtgaagaagctctccttgagatttctcaaatctggaaagaaaacggttgatcttgttggagatgagaaattgaaagctagtgcatctgttaggcatcttgctcttccttgtaaccgtgctgcaagggctcaagttattccagacatcatccgatgctatagccgtggaggccggaccattatctttaccgagacaaaagaatctgcatcagacctctctggtttgattgctggatcacgtgccttgcatggtgatgttgctcaagctcagcgtgaagttattcttgctgggttcaggagtggcaagtttttagttttggttgctacaaacgtggctgcacgagggctggacattaatgatgtgcagcttatcattcagtgtgaacctccacgtgatgttgaagcctacatacaccggtcaggtcggactgggagagcaggcaatactggtgttgctgtcatgctttttgaacccagatataagttcaatgtgaacagaatagaaagggagtctggggtcaaatttgaacatatctctgcaccacagccaactgatgtggcacaatctgctggtactgaagcagcagaagccatttccagtgtttcagacagtgtcattcctgtttttcgggagcaagctgagcaactattgaactcttccgggatgtctgcagttgatctactagccaaagcacttgcgaaggcagttggctacacggacataaagaagagatccttgctgtcttctatggacaaccacactacattacttcttcaaactggtcgatcggtgtatgcagcaggatttgttctttctactttgaaaaggtttatgccagaagagagacttgcagatgtaaagggtataaccatcactgctgatgggacaggtgctgtatttgatgttccttcagcagaggttgaagactatattcaaggtgcacagaacgctgccatggtgactgtcgaggaagtgaaacaattgccacccttgcaagagagggaacagtctggtggcagccgaggtggaggaaggtttggaaacaggagattttctggtggtggtggtggccggggtggaggcggcagagggttcggtggaggcagaggcaggggaggtggcggcggcaacaggtttaacaagaggtactagctgttgctggagcactctcatttttgacctataggttgagccaaggcacagggaatcgccaaaattttgactgcgccatgtatcggttttttgtttatttgttagtgtttgtgtgttcgagattatgatgatcaattttgccatcgcaatagtgtacaatattgatctgatacttgctacatagtaactgttaagaatgaagctatatacttgtttccccatcggct

SEQ ID NO: 1298 - DNA, 2564 bp, Sorghum bicolor
tttccgcggcatacctacaagtactcgaaaccccgtccgctctctccctcttttccggctgcgccttcccctcgcagccgccagccctcaacgcccctaccagcagcagccaccgcccgttacccgtgatgtctcccgcccttgcctctgccgtggagcccatggccgtcgacgactccgcctccaagaaggccaagcgcaagcagctcaaggccgccgccgccgccgcggaggcagaggcggaggccgcttcggctaagaagaaagagaagaaggagaagaagcgcaaggcgaaggagccgtcccctccgcccccgtcggcctcgtcctctgacgaggaggagaagagcagcaccagctccgaggagacggcccccgccgcgaagaaagcgaagaaggagaagacgaagaagaatgtcgaggtctcgtcttcagcctcggacgacgacggcgagatcacggccagcagcgacgaggaccccgcggacccgaacgcgctgacgaacttcaggatatcggagccgctgaggcagagcctcaggtccaaggggatcaaggcgctgttccccatccaggccaccactttcgacctcgtactcgacggcaacgacttggttggccgagcgcgcaccggtcaggggaaaactttggcttttgtcttgcccatattggagtctttggttaacggggcacacaaggcatctagacgaactgaacatggcaggaccccaagtgttattgttctgctacccacaagagagctggccaatcaggtgcatgccgactttgagttttatggtgcaacatttgggctttccgcatgttgtgtgtatgggggttctccttatcgtcctcaagaaatggctttgagaaggggtgtggacattgttgttggaactcctggtcgtgtcaaggatttcattgtaaaaggaactctcaatttgaaaaacttgaaattccgtgtccttgatgaagctgatgagatgcttaacatgggttttgttgatgatgtcgagctcattcttggcaaagtagaagatgctaccaaagtacagacacttctgttcagtgccactctgccagattgggtgaataagctctctatgaggtttctgaaagttgacaggaaaacggttgatcttgtcggtaatgagaaactgaaggccagtgcatctgttaagcaccttgctcttccttgtaacaaggcagcaagggcacaagttattccagacattatccgatgctatagccatggaggccgaaccattatcttcactgagacaaaggattctgcatcagagctttctggtttgattcctggatcccgtgccttgcatggagatgtcgtgcaagctcagcgtgaagtcattcttgctggattccgtggcgggaagttccaagttttggttgctacaaatgtggcggctcgtggtctggatattaatgatgtgcagcttatcattcagtgtgaacctccccgtgacgttgaagcttacatacaccggtcaggtcggacagggagagcaggtaatactggtgttgctgtcatgctttatgagcccagatataaatacagtgtcaacagactagaaagggagtctggggttaagtttgagcatatctctgcgccacagcctactgatgtagcacaatctgctggcagtgaagctgcagatgccatttcgagtgtgtcagatagtgttattcctgtcttcaggcagcaagcagagcagttgctaagctcttccagcctgtctgcagctgacttgcttgccaaggcacttgcaaaggcagttggttacacggacataaagaaaagatcattgttatcttccatggaggattacactacattacatcttcaaactggcagaccgatgtggtcacctgggtttgcttttactatattgaaaaggttcatgccagaagagaaacttgcagatgtaaagggtgcaaccctcacggctgatggaacaggtgttgtatttgatgttcctgcagcagatgttgaagattacattcaagcttcggagaatgctgcacaggtgacaattgatgaagtcaagcaactgccacccttgcaagagaaggagcagtcaagaggcaactctggcggaggaagatttggccgtggaggtggtgggagattctctggtggtggccgtggaggcggcttcggtggtggtggcagaggcagaggtggtggcggcagagggttttctgggaggggaggcggcggcaacagatttaacaggaggaattagaagatgctgcatgggcgtttgagagaactatgttgtgtttgacgtagttttgaggagggggagagaatagtctcagttttggctgcaattgtatcggcttttgtttatttttttggtgttcgaatacgacactcacttttgccaacgcaagagtgtacgttttaatctactcgaaaattacaatcgtgacttattaagtaaagctttatatgtattgtttcaacttgtcgggcatgggtgcagattcggcctcctgtagtctgaaagtatatatacatatagttgctattcctgtctgcc

SEQ ID NO: 1299 - DNA, 2517 bp, Sorghum bicolor
ctcttttccggctgcgccttcccctcgcagccgccagccctcaacgcccctaccagcagcagccaccgcccgttacccgtgatgtctcccgcccttgcctctgccgtggagcccatggccgtcgacgactccgcctccaagaaggccaagcgcaagcagctcaaggccgccgccgccgccgcggaggcagaggcggaggccgcttcggctaagaagaaagagaagaaggagaagaagcgcaaggcgaaggagccgtcccctccgcccccgtcggcctcgtcctctgacgaggaggagaagagcagcaccagctccgaggagacggcccccgccgcgaagaaagcgaagaaggagaagacgaagaagaatgtcgaggtctcgtcttcagcctcggacgacgacggcgagatcacggccagcagcgacgaggaccccgcggacccgaacgcgctgacgaacttcaggatatcggagccgctgaggcagagcctcaggtccaaggggatcaaggcgctgttccccatccaggccaccactttcgacctcgtactcgacggcaacgacttggttggccgagcgcgcaccggtcaggggaaaactttggcttttgtcttgcccatattggagtctttggttaacggggcacacaaggcatctagacgaactgaacatggcaggaccccaagtgttattgttctgctacccacaagagagctggccaatcaggtgcatgccgactttgagttttatggtgcaacatttgggctttccgcatgttgtgtgtatgggggttctccttatcgtcctcaagaaatggctttgagaaggggtgtggacattgttgttggaactcctggtcgtgtcaaggatttcattgtaaaaggaactctcaatttgaaaaacttgaaattccgtgtccttgatgaagctgatgagatgcttaacatgggttttgttgatgatgtcgagctcattcttggcaaagtagaagatgctaccaaagtacagacacttctgttcagtgccactctgccagattgggtgaataagctctctatgaggtttctgaaagttgacaggaaaacggttgatcttgtcggtaatgagaaactgaaggccagtgcatctgttaagcaccttgctcttccttgtaacaaggcagcaagggcacaagttattccagacattatccgatgctatagccatggaggccgaaccattatcttcactgagacaaaggattctgcatcagagctttctggtttgattcctggatcccgtgccttgcatggagatgtcgtgcaagctcagcgtgaagtcattcttgctggattccgtggcgggaagttccaagttttggttgctacaaatgtggcggctcgtggtctggatattaatgatgtgcagcttatcattcagtgtgaacctccccgtgacgttgaagcttacatacaccggtcaggtcggacagggagagcaggtaatactggtgttgctgtcatgctttatgagcccagatataaatacagtgtcaacagactagaaagggagtctggggttaagtttgagcatatctctgcgccacagcctactgatgtagcacaatctgctggcagtgaagctgcagatgccatttcgagtgtgtcagatagtgttattcctgtcttcaggcagcaagcagagcagttgctaagctcttccagcctgtctgcagctgacttgcttgccaaggcacttgcaaaggcagttggttacacggacataaagaaaagatcattgttatcttccatggaggattacactacattacatcttcaaactggcagaccgatgtggtcacctgggtttgcttttactatattgaaaaggttcatgccagaagagaaacttgcagatgtaaagggtgcaaccctcacggctgatggaacaggtgttgtatttgatgttcctgcagcagatgttgaagattacattcaagcttcggagaatgctgcacaggtgacaattgatgaagtcaagcaactgccacccttgcaagagaaggagcagtcaagaggcaactctggcggaggaagatttggccgtggaggtggtgggagattctctggtggtggccgtggaggcggcttcggtggtggtggcagaggcagaggtggtggcggcagagggttttctgggaggggaggcggcggcaacagatttaacaggaggaattagaagctgctgcatgggcgtttgagagaactatgttgtgtttgacgtagttttgaggagggggagagaatagtctcagttttggctgcaattgtatcggcttttgtttatttttttggtgttcgaatacgacactcacttttgccaacgcaagagtgtacgtttaaatctactcgaaaattacaatcgtgacttattaagtaaagctttatatgtattgtttcaacttgtcgggcatgggtgcagattcggcctcctgtagtctgaaagtatatatacatatagttgctattcctgtctgcc

SEQ ID NO: 1300 - DNA, 2607 bp, Zea mays
cgggcacgtgcgcacgcgccgcactagggtttccgcagcatacctacaagtactcgaaaccccgtctctctccccctcttttccggctgcgccttcccctcgcagccgccagccctcaacgttcctaccagctgccaccgcctgttacccgtgatgtctcccgcccttgccgctggcgtggagcccatggccgtcgacgattccgcctccaagaaggccaagcgcaagcagctcaaggccgccgccgccgccgcggaggcagaggcggaggccgcttcggtcaagaagaaagagaagaaagagaagaagcgaaaggtgaaggagccgtcccctccgctcccatcggccgcgtcctctgatgaggaagagaaaagcagcaccagctccgaggagacagcacccgcggcgaaaaaagcgaaggagaagacgaagaagaatgttgatgtctcgtcttcagcctcagatgacgatggcgagatcacagccagcagcgatgaggaccccgcggacccgaacgcgctgacgaacttcaggatatcggagtcgctgaggcagagcctcaggtccaaggggatcaagtcactgttccccattcaggccaccactttcgatctcgtactcgatggcagcgacttggttggccgagcgcgcaccggtcagggaaaaactttggcttttgtcttgcccatattggagtctttggttaatggggcaaacaaggcatctagacggactgaacatggcaggaccccaagtgttctcgttctactaccaacaagagagctggccaatcaggtgcacgctgactttgagttttatggtgcaacatttgggctctctgcatgttgtgtgtatgggggatcaccttatcgtcctcaagaaatggcattgagaagaggtgtggatattgttgttggaactcctggtcgtgtcaaggatttcattgttaaaggaactctcaatttgaaatgcttgaaattccgtgtccttgatgaagctgatgagatgctaaacatgggttttgttgatgatgtcgagctcattcttggcaaggtagaagatgctaccaaagtacagacgcttctgttcagtgccactctgccagagtgggtgaataagctctctatgaggtttctgaaagttgacaggaaaacagttgatcttgtcggtaatgagaaactgaaggccagtgcatctgttaagcaccttgctcttccttgtaacaaggcagcaagggcacaagttattccagacattatccgatgttatagccatggaggtcgaaccatcatcttcactgagacgaaggattctgcatcagagctttctggtttgattcatggatcccgtgccttgcatggagatgtagcgcaagcgcagcgtgaagtaattcttgctggattccgtagcgggaagttccaagttttggttgcgacaaatgtggcggcgcgtggtctggatattaatgatgtgcagcttatcattcagtgtgaacctccccgggatgttgaagcttacatacaccggtcaggtcggacagggagagcaggtaatactggtgttgctgtcatgctttatgagcccagatataagcacagtgtcagcagactagaaagggagtctggggttaaatttgagcatatctctgcgccacaacccactgatgtagcacaatctgctggcagtgaagctgcagatgcaattgcgagtgtgtcagacagtgttattcctatcttcaggcagcaagcagagcagttgctaagctcttccagtctgtctgcagctgacttgcttgccaaagcacttgcaaaggcagttggttacacggacataaagaaaagatcattgttatcttccttggaggattacagtacactacatcttcaaactggcagaccgatgtggtcacctgggtttgcttttactatattgaaaaggttcatgccagaagataaacttgcagatgtaaagggtgccaccctcaccgctgatggaacaggagttgtatttgatgttcctgcagcagatgttgaagattacattcaagcttcggagagtgccgcacaggtgacaattgatgaagtcaagcaactgccacccttgcaagagaaggaccagtcgagaggcaactctgggggaggaagatttggccatggaggtggccggagattttctggtggtggtggcggcggcagagggttttctggccggggaggtggcggcagagggttttctggcagaggaggcggcggcagtagatttaacaggaggaattagaagctgcttcaatctttatggacatttcagaattcagagaactatgtttgtgttcgacgtagttttgatgaagagggagggaatcgtctcagttttggctgcaactgtatcgtgcttttgtttatttgttagccttcgtcaacgaaggcttattttgttagtgatataattgaggcatggggaagagggggaggtaacagtctcagttttggctgcaaattgtatcgtgctattgtttatttgttagtgttcgtcaacgaaggcttatttgttagtgcttttattgtggcgtggtgaagagggaggaaatagtctcagttttggctgcaa

SEQ ID NO: 1301 - DNA, 2428 bp, Saccharum officinarum
cgccttgccctcgcagccgccagccctcaacgcccctaccagcagccaccgcccgttaccccgtgatgtctcccgcccttgccgctgccgtggagcccacggccgtcgacgactccgcctccaagaaggccaagcgcaagcagcttaaggtcgccgccgccgccgccgcggaggcagaggcggaggccgcttcagccaagaagaaagagaagaaagagaagaagcggaaggcgaaggagccgtcccctccgcccccgtcggcctcgtcctctgacgaggaggagaagagcagcaccagctccgaggagacagcccccgccccgaagaaggcgaagaaggagaagacgaagaagaatgccgaggtctcgtcttcagcctcagatgacgacggtgagatcacggccagcagcgacgaggaccctgcggaccccaacgcgctgacgaacttcaggatatcggagccactgaggcagagcctcaggtccaaggggatcaaggcgctgttccccatccaggccaccactttcgacctcgtactcgacggcagcgacttggttggccgagcgcgcaccggtcagggaaaaactttggcttttgtcttgcccatattggagtctttggttaatggggcaaacaaggcttctagacgaactgagcatggcaggaccccaagtgttctggttctgttaccaacaagagagctggccaatcaggtgcatgccgactttgagttttatggtgcaacatttgagctttctgcatgttgtgtgtatggtggttctccttatcgtcctcaagaaatggcattgagaagaggtgtggacattgttgttggaactcctggtcgtgtcaaggatttcatcgtaaaaggaactctcaatttgaaatctttgaaattccgtgtccttgatgaagctgatgagatgcttaacatgggctttgttgatgatgtcgagctcattcttggcaaggtagaagatgctaccaaagtacagacacttctgttcagtgccactctgccagattgggtgaataagctctctatgaggtttctgaaagttgacaggaaaacagttgatcttgtcggtaatgagaaactgaaggccagtgcatctgttaagcaccttgctcttccttgtaacaaggcagcaagggcacaagttattccagacattatccgatgctatagccatggaggccgaaccattatcttcactgagacgaaggattctgcatcagagctttctggtttgattcctggatcccgtgccttgcatggagatgttgtgcaagctcagcgtgaagtcattcttgctggattccgtagtgggaagttccaagttttggttgctacaaatgtggcagctcgtggtctggatattaatgatgtgcagcttatcattcagtgtgaacctccccgtgacgttgaagcttacatacaccggtcaggtcggacagggagagcaggtaatactggtgttgctgtcatgctttatgagcccaggtataagcatagtgtgagcagactagaaagggagtctggggttaagtttgagcatatctctgcgccacagcctaccgatgtagcacaatctgctggaagtgaagctgcagatgccattgcgagtgtgtcagacagtgttattcctgtcttcaggcagcaagcggagcagttgctaagctcttccagcctgtctgcagctgacttgcttgccaaggcacttgcaaaggcagttggttacacggacataaagaaaagatcattgttatcttccatggaggattacactacactacatcttcaaactggcagaccgatgtggtcacctgggtttgcttttactatattgaaaaggttcatgccagaagagaaacttgcagatgtaaagggtgcaaccctcaccgctgatggaacaggggttgtatttgatgttcctgcagcagatgttgaagactacattcaagcttcggagaatgccgcacaggtgacaattgatgaagtcaagcaaatgccacccttgcaagagaaggagcagtcaagaggtaactctggtggaggaagatttggccgtggaggaggcgggagatactctggtggtggccgtggaggcggcttcggtggtggtggcagaggcagaggtggtggtggcagagggttttctgggaggggaggtggtggcaatagatttaacaggaggaattagaagctgctgcaatcttaatggacatttcagagaactatgttgtgtttgacgtagttttgatgaagaaggggaaggaataatctcagttttggctgaattggatcggcttttggttatttggtagtgttcgtcaacgagaatactactcatttttgctaacgcaagagtgtacgttttttatgtactcgaaatcaacaattatgttattataaggtaagctattt

SEQ ID NO: 1302 - DNA, 2334 bp, Saccharum officinarum
  misc_feature (7)..(7): n is a, c, g, or t
  misc_feature (24)..(24): n is a, c, g, or t
  misc_feature (2265)..(2265): n is a, c, g, or t
  misc_feature (2277)..(2277): n is a, c, g, or t
  misc_feature (2306)..(2306): n is a, c, g, or t
  misc_feature (2318)..(2318): n is a, c, g, or t
cgccttnccctcgcagccgccagncctcaacgcccctaccagcagccaccgcccgttaccccgtgatgtctcccgcccttgccgctgccgtggagcccacggccgtcgacgactccgcctccaagaaggccaagcgcaagcagcttaaggtcgccgccgccgccgccgcggaggcagaggcggaggccgcttcagccaagaagaaagagaagaaagagaagaagcggaaggcgaaggagccgtcccctccgcccccgtcggcctcgtcctctgacgaggaggagaagagcagcaccagctccgaggagacagcccccgccccgaagaaggcgaagaaggagaagacgaagaagaatgccgaggtctcgtcttcagcctcagatgacgacggtgagatcacggccagcagcgacgaggaccctgcggaccccaacgcgctgacgaacttcaggatatcggagccactgaggcagagcctcaggtccaaggggatcaaggcgctgttccccatccaggccaccactttcgacctcgtactcgacggcagcgacttggttggccgagcgcgcaccggtcagggaaaaactttggcttttgtcttgcccatattggagtctttggttaatggggcaaacaaggcttctagacgaactgagcatggcaggaccccaagtgttctggttctgttaccaacaagagagctggccaatcaggtgcatgccgactttgagttttatggtgcaacatttgagctttctgcatgttgtgtgtatggtggttctccttatcgtcctcaagaaatggcattgagaagaggtgtggacattgttgttggaactcctggtcgtgtcaaggatttcatcgtaaaaggaactctcaatttgaaatctttgaaattccgtgtccttgatgaagctgatgagatgcttaacatgggctttgttgatgatgtcgagctcattcttggcaaggtagaagatgctaccaaagtacagacacttctgttcagtgccactctgccagattgggtgaataagctctctatgaggtttctgaaagttgacaggaaaacagttgatcttgtcggtaatgagaaactgaaggccagtgcatctgttaagcaccttgctcttccttgtaacaaggcagcaagggcacaagttattccagacattatccgatgctatagccatggaggccgaaccattatcttcactgagacgaaggattctgcatcagagctttctggtttgattcctggatcccgtgccttgcatggagatgttgtgcaagctcagcgtgaagtcattcttgctggattccgtagtgggaagttccaagttttggttgctacaaatgtggcagctcgtggtctggatattaatgatgtgcagcttatcattcagtgtgaacctccccgtgacgttgaagcttacatacaccggtcaggtcggacagggagagcaggtaatactggtgttgctgtcatgctttatgagcccaggtataagcatagtgtgagcagactagaaagggagtctggggttaagtttgagcatatctctgcgccacagcctaccgatgtagcacaatctgctggaagtgaagctgcagatgccattgcgagtgtgtcagacagtgttattcctgtcttcaggcagcaagcggagcagttgctaagctcttccagcctgtctgcagctgacttgcttgccaaggcacttgcaaaggcagttggttacacggacataaagaaaagatcattgttatcttccatggaggattacactacactacatcttcaaactggcagaccgatgtggtcacctgggtttgcttttactatattgaaaaggttcatgccagaagagaaacttgcagatgtaaagggtgcaaccctcaccgctgatggaacaggggttgtatttgatgttcctgcagcagatgttgaagactacattcaagcttcggagaatgccgcacaggtgacaattgatgaagtcaagcaaatgccacccttgcaagagaaggagcagtcaagaggtaactctggtggaggaagatttggccgtggaggaggcgggagatactctggtggtggccgtggaggcggcttcggtggtggtggcagaggcagaggtggtggtggcagagggttttctgggaggggaggtggtggcaatagatttaacaggaggaattagaagctgctgcaatcttaatggacatttcagagaactatgttgtgtttgacgtagttttgangaagaggggganggaataagtctcagttttggctgaattgnatcggcttttgnttatttggtagggttc

SEQ ID NO: 1303 - DNA, 2161 bp, Panicum virgatum
tccccgtcctcggacgaggaggagaagagcagcaccagctccgaggagacggcacccgccgcgaagaagtcgaagaaggagatggcgaagaagacggtcgaggcctcgtctccggcctcggaggacgacggcgaggtcacggccagcagcgacgaggaccccgcggacccgaacgcgctgaccaacttcaggatatcggagccgctgaggcagaggctcaagtccaaggggatcaaggcgctgttccccatccaggccaccacattcgacctcgtcctcgacggcagcgacttggtcggccgcgcgcgcacgggccagggcaaaactttggcttttgtactgcccatattggagtcgttggttaacgggacacacaaagcaacccgaaaaactgactatggcaggcctccaagtgttttggttcttctacctacaagagagctggccaatcaggtgcacgcggactttgagttttatggagcaacatatgggctttcggcgtgttgtgtgtatgggggttctccttatcgtcctcaagaaatggcattgagaaagggggtggacattgttgttggaactcctggtcgtgtcaaggatttcattgtaaagggaactctcaatttgaagtgtttgaaattccgtgtcctcgatgaagctgatgaaatgcttaacatgggatttgttgatgatgtagagctcattcttggtaaggttgaagatgttaccaaagtacaaacacttctgttcagtgccactctgccagattgggttaataagctctccatgagattcctgaaaggtaacaggaagacagttgatcttgttggtaatgagaaactgaaggctagtgcatctgtcaagcatcttgctcttccttgtaacaaagcagcaagggctcaagttattccagacattatccggtgctatagccatggaggccgaacaattatcttcactgagacaaaggactctgcatcagagctttctggtttgatccctggatcccgtgccttgcatggagatgttgtgcaagctcagcgtgaagtcattcttgctggattccgcggtgggaaattccaagttttggttgctacaaatgtggcagctcgtggtctggacattaatgatgtgcaacttattatccagtgtgaacctccacgtgatgttgaagcttacatacaccggtcagggcggacagggagagcagggaacactggtgttgctgtcatgctttacgagcccagatataagcacagcgtgagcagattagaaagggagtcaggagttcagtttgaacatatttctgcgccacagcctactgacgtggcacaatctgctggcactgaagctgcagatgctattgcgagcgtgtcagacagtgttatccctattttccgggagcaagcggagcaactgctaagctcttctagtctgtctgcagctgacttgctggcgaaagcactggcaaaggctgttggatacactgacataaagaaaagatcattgctctcttctatggaggattacactacattacatcttcaaactggcaggcctatgtggtcaccagggtttgcttttactatattgaaaaggtttatgcctgaagagaagcttgcagatgtaaagggtgccaccctaacagctgatggaacaggggttgtatttgatgttcctgcagcagatgttgaagattacattcaagcttccgagagtgctgctcaggtgacaattgatgaagtgaagcagctgccacccttgcaagagagagagcagtcaagaggcaactctggcggtggaagattcggtcgtggaggtggaagcagattcggtggtggtggtggccgtggaggcggcagcaggtttggtggtggcggaggcagaggtggaggtggcagaggcttttctggcaggggaggcggtggcaataggtttaacaggaggaattaggtctgttgcagggttggcgaacatttgaaagctgtatgtcgttttttgacgtagatttgaggaagaggggagtgaattgtcacagttttggctgcaagtgtatcggtttttatttatttgttagtgtttgtcaccaatattacaattttgatcttgtgtcccatatcaactattgtcttatgagtaaaaatatatgtatttcttttgcaac

SEQ ID NO: 1304 - DNA, 1304 bp, Triticum aestivum
  misc_feature (43)..(43): n is a, c, g, or t
ccacgcgtccggagagagagagagagagagagaaacggaaacngagacagagggagaggagacttgcagaggagaggagagaagaggcggaacaagggaggagggaggggtcgccggaagggggacatgctccctccgcatctcacatctcgcagcttgaactgagagcaagagcagaagcccatgagatgagacgcaagcaaaatatgcaagaaaatggcacaatcatgattcagtttggtcagcaagtgcctaactgcgagtcctcagctagcgattctcctcaagaagtgtccggaatgagcgaagggagctttaatgagcagaatgatcaatctggtaatcgcgatggctatacgaagagtagtgatgaaggcaagatgatgtcggctttgtctctgggcaattcagaaatggcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccactaccgattgaaccagctgccgccgaagagcccatttatgtgaatgcgaagcaataccatgccattctccgaaggagacagctccgcgcaaaattagaggctgaaaataagctggtcaaaagccgtaagccgtacctgcatgagtcccggcaccagcacgcgatgaagcgggctcggggaacaggcgggcggttcctcaacgcaaaggagaagtctgaagcttcaggcggcggcaatgcatcagcgaggtctggccacgccggcgttcccccggatggcggcatgttctcgaagcacgaccacaccttaccatccggtgacttccattaccgcgcgagagggggcgcctagggtgggcacgcagttgccccctggcaaatcatccttggcttatgtgtgtggcgaatgaccgtcaactcggtccagtgatattgtaaaactgaatttagagtctgtgcaattgtgttacttgggggtttggtagacagcccttgtgtttggggaggggacgatgcagctgcagctgcagccggttctcttgttgtggtaggtttgtgtggcatggcaggtgctgctaagctggagcctgcttgaactgttttcctgtcactttgttgtttggggtaataatgaccatcttgtatgatattagtactgacttggagtaagtaataaccattcccggcgtgatgcatttgcgcccgtggtggtgtttctgttgagccgtgttgttca

SEQ ID NO: 1305 - DNA, 1238 bp, Pseudoroegneria spicata
  misc_feature (3)..(5): n is a, c, g, or t
  misc_feature (80)..(80): n is a, c, g, or t
  misc_feature (91)..(91): n is a, c, g, or t
  misc_feature (236)..(237): n is a, c, g, or t
  misc_feature (277)..(277): n is a, c, g, or t
  misc_feature (1044)..(1044): n is a, c, g, or t
  misc_feature (1148)..(1148): n is a, c, g, or t
  misc_feature (1151)..(1151): n is a, c, g, or t
ccnnnaccaagcagagagagagagagaaacggagacagaggcagagaggagacttgcagaggagaggagacgagaggcgnagcaagttgcngaacaagggaggaggggtcgccggaaaggggacatgctcccttcacatctcacagcttgaactgaaagcaagagtggaagcccatgagatgagacgcaaggaaaatatgcatgaaaatggcacaatcatgattcagtttggtcannaagtgcctaattgcgagtcatcagctagcgattctcctcnagaagtgtccggaatgagtgaaggaagctttaatgagcagaatgatcaatctggtactcgcgatggttacacgaagagtgatgaaggcaagatgatgtcagctttatctctgggcaattcagaaacagcatacacaccgccaaaacctgaccgcacccatcccttcgccatatcatacccatatgctgatccttactatggcggtgcagtggcagcttatggtgcacatgctattatgcacccccagatggtgggtatggtaccatcctctcgagtgccactgccaattgaaccggctgctgccgaagagcccatttatgtaaacgcgaagcaataccatgccattctccgaaggagacagctgcgcgcaaaattagaggctgaaaataagctggtgaagagtcgcaagccgtacctccatgagtcccggcaccagcatgcgatgaagcgggctcgaggaacaggcgggcggttcctcaacgcaaaggagaagtccgaggcttctggcggcggcaccgcctcagcgagatctggccatgccggggttcctacagacagcggcatgttctcaaagcacgaccacaccttaccgtccggtgacttccattaccgcgcgagagggggcgcctagggcgggcagcggcaggttgaccgttgtcccctggcaaatcatccttggcttatgtgtgtggcgaccgtcaattcggtccaatgatattgtaaactgaatttagagtctgtgcaattgtcacttgggggtttggtanacagtcgctgtgtttgggacgatgcagccagttctctggtcgtggtagatttgtgtggcatggcaggtgctgctaagctggagcctgcttgaactgttttcctntcncttttgttgggtaataatgaccatccatcatgtatgataccagtactgacttggagttggagtaataaccattcccggcttgctgca

SEQ ID NO: 1306 - DNA, 1270 bp, Avena sativa
ccaagccaagagagagagagagaggatcagagattcagagagagagagagagagaggagacttgcagaggagagaagcaagttgcggtcgtgcggaagaggcgaagcaagggaggaggggttgccggaaaggggacatgctccctcccgtcgcatcatctcgcagtttgaactgacaagcacagtttagcccatgagatgagacgcaaggaaaatatgcatgaaaatggcacaatcatgattcagtttggtcatcaagtgcccacttacgactcatcacctagtgattctcctcgagaagtgtccggaatgagtgaaggaagccttaatgagcagaatggccaatctggtaatcgcaatggttacacgaagagtgatgaaggcaagatgatgtcggctttatctctgggaaatactgatacagcatacacgcagccaaaacctgaccgcgctcatccctttgccatgccatacccgtatggtgatccgttctatggtggtgcagtggccgcttatggctcacatgctattatgcacccccagatggtgggcatggtaccatccgctcgagtcccactgccaattgaaccagctgctgccgaagagcccatctatgtaaatgcgaagcaataccacgctattctccgaaggcgacagctgcgtgcaaagttggaggctgagaataagctggtgaagagtcgcaagccgtacctccacgaatcccggcaccagcacgcgatgaagagggctcggggcacgggcgggcggttcctgaacgccaaggagaagtccgaggcttccggcggcggcgcctcgacgaggcctggtggccacaccggcatcccaacgaatggtggcatattctcgaagcacgaccacaccttgtcctccggcgatttccactatcgcgcgagagggggcgcttgagggggcgtcgttccctggcaattcatccttggcttatgtgtgtggtgtggtgcggtgcggtgaccagcaattcggtccaattggctatgtgaactgaaagatttggggattgtagtgttagttagttggtactttggtgttttgactgacagtcgttctgtggttgctgctctggagacggctaccatttctgtggtgatgcttaggctttgtgggagcacggactgccgaaacggcacctgtttgatgaactgtttaggcttgtagcttctccgaggtcataaccattttgtatgatgctaataatttggaatgaccattccccggtctagtctttttttttt

SEQ ID NO: 1307 - DNA, 1156 bp, Triticum aestivum
gaggagcaagttgcggaggaggcagcggcaagggaggaggggtcgccggaagggggacatgctccctcctcatctcacatctcgcagcttgaactgagagcaagagtagaaacccataagatgagacgcaagcaaaatatgcatgaaaatggcacaatcatgattcagtttggtcagcaagtgcctaactgcgagtcctcagctagcgattctcctcaagaagtgtccgggatgagtgaaggaagctttaatgagcagaatgatcaatctggtaatcgcgatggctacaccaagagtgatgaaggcaagatgatgtcggctttgtctctgggcaattcagaaacagcatacacacccccaaaacctgaccgcactcatcccttcgccatatcatacccatatgctgatccttactatggtggtgcagtggcagcctatggcacacatgctattatgcacccccagatggtgggtatggtaccatcctctcgagtgccactgccaattgaaccggctgccgccgaagagcccatttatgtgaacgcgaagcaataccatgccattctccgaaggagacagctccgcgcaaaattagaggctgaaaataagctggtcaaaagccgtaagccgtacctccacgagtcccggcaccagcacgcgatgaagcgggctcgggggacaggcgggcggttcctcaacgcaaaggagaagtccgaggcggcctccggcggcggcaatgcatcagcaagatctggccacgccggcgttcctacagacggtggtggcatgttctcgaagcacgaccacaccttaccgtccggtgacttccattaccgcgcaagagggggcgcctagggcgggcctttgcccccggcaaatcatccttggcttatgtgtgtggcgaatgaccgtcaattcggtccaatgatattgtaaaactgaatttagagtctgcaattgttacttgggggtttggtagacggtcgttgtgtttggggacgctgcagctgcagctgcagctgccggttctcttgttgtggtaggtttgtgtggcatggcaggtgctgctaagctggagcctgcttgaactgttttcctgtcactttgttggggtaataatgaccatcctgtatgatattagtactgacttggagta

SEQ ID NO: 1308 - DNA, 1286 bp, Brachypodium distachyon
gcgccccgacggcccaaccccgtcgcccgtcttcctcctcgagcgagcgccgccaccccctccctccccgtcccgctgccgagcgccccagtcccctcgcttcgtcgctcgtcttcctcctcgtgcgagcgcctccaccgcagtttgaactcaaaagcaagagtagaattccatgatatgagacgtaaggaagatatgcatgaaaatggcactatcatgattcagtttggtcatcaagtacctaattacgactcgtcagctagtgattctcctcaagaagtgtccggaatgagcgaaggaagccataatgagcaaaatgaacaatctggtaggcgtgatggttacacgaacagtgatgaaggcaagatgatgtcggctttatctctgggaaactcagaaacaacatatgcacagccaaaacctgaccgcactcatccctttgccgtagcatacccgtatgctgatccgttctatggtggtgcttatggatcgcatgctgttatgcacccccagattgtgggtatggtaccatcctctcgagtgccactaccaattgaacaagctgccgctgaagagcccatttatgtaaatgcaaagcaataccatgcgattctccgaaggagacagctccgggcaaagttagaggccgaaaacaagctggtgaagagtcgtaagccatacctccacgaatcccggcatctgcatgcaatgaagagagctcggggaacagggggccgattcctcaactcaaagcagcagcccgagggttccagtggcagcgacgcctcgacgagagctggccacagtggcatccctgcaaacggtggcatgttctcgaagcacgatcacaccttatcgtccggtgatcttcagtatcgtgtgagaggaggcgcttgaggcggcagtggcgagcggctaggtaaagatcctagctagtggagccgttgctccctggcaaatcatccttggcttatgtgtgtggtgaccggcaagcaatctcggtcagatgttatgtagcagtaaaacttgactccgggcgtgggcgatatgttgcttagtacgtggggtgttttgacagtcgttgtgttcttcctgtggtgtgtctctgggtttggagacgatgcaggtgctgccagttctctctcacagtgcttatttagacttgtggctagtgttgctaccaaactggcacctgcttgaactgttttctgtcgctaccaaaatggttctgtactaataataaccgttccctgcgtgagatgcgttgcatttgcctttttgggcct

SEQ ID NO: 1309 - DNA, 1183 bp, Triticum aestivum
gagggagaggagacttgcagaggagaggagacgggaggagcaagttgcggaggaggcagcggcaagggaggaggggtcgccggaagggggacatgctccctccacatctcacatctcgcagcttgaactgagagcaagagtagaagcccatgagatgagacgcaagcaaaatatgcatgaaaatggcacaatcatgattcagtttggtcagcaagtgcctaactgcgagtcctcagctagcgattctcctcaagaggtgtccggaatgagcgaaggaagctttaatgagcagaatgatcaatctggtaaccgcgatggctacacgaagagtgatgaaggcaagatgatgtcagctttgtctctgggcaattcagaaacagcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccgctgccaattgaaccggccgccgccgaagagcccatttatgtgaacgcgaagcaataccatgccattctccgaaggagacagctccgcgcaaaattagaggctgaaaataagctggtgaagagccgcaagccgtacctccacgagtcccggcaccagcacgcgatgaagcgggcccggggaacaggcgggcggttcctcaacgcgaaggagaagtccgaggcctccggcggcggcaatgcatcagcgagacctggctacgccggcgttcctgcagacggcggcatgttctcgaagcacgaccacaccttaccgtccggtgacttccattaccgcgcgagagggggcgcctagggcgggcctttgccccctggcaaatcatccttggcttatgtgtgtggtgaatgaccgtcaattcggtccaatgatattgtaaaactgaatttagagtctgcaattgttacttgggggtttggtagacggtcgttgtgtttggggacgatgcagctgcagccggttctcttgttgtggtagatttgtggcatggcaggtgctgctaagctggagcctgcttgaactgttttcctgtcactttgttggggtaataatgaccatcctgtatgatattagtactgacttgggagtaactaataa

SEQ ID NO: 1310 - DNA, 546 bp, Brachypodium distachyon
ctatactccctcttcctgctctgctctctgctctagtttactccatcgacccaaagagagaaaagaaagcactcagaacttgagatcagcatccaggagatcggccatggcgggcacggcgaactgcatcgacatcatcctggccatcatcctcccgcccctgggcgtcttcctcaagttcggctgcgggcatgagttctggatctgcctgttgctcaccttcctcggctacatccccggcatcatctacgccatctacgccatcacaaagtagttgaatcatcgaaccgaacccttgctagcagtacctacctgtaaagggatgtctatctgtaattctgtatgcatcgtgtatgggtgttttatgtttattaactcccctagtgggagaatatctctttgttgaagttagatcattcctgccccccctgttgaagattggaatcagtgcttgtattcagtgagttggtttcctcagtctgcttctagatcttctgtatgggtgttttttgaagatttggtaataaagaagcatagggtttctgg

SEQ ID NO: 1311 - DNA, 536 bp, Brachypodium distachyon
tcctgctctgctctctgctctagtttactccatcgacccaaagagagaaaagaaagcactcagaacttgagatcagcatccaggagatcggccatggcgggcacggcgaactgcatcgacatcatcctggccatcatcctcccgcccctgggcgtcttcctcaagttcggctgcgggcatgagttctggatctgcctgttgctcaccttcctcggctacatccccggcatcatctacgccatctacgccatcacaaagtagttgaatcatcgaaccgaacccttgctagcagtacctacctgtaaagggatgtctatctgtaattctgtatgcatcgtgtatgggtgttttatgtttattaactcccctagtgggagaatatctctttgttgaagttagatcattcctgccccccctgttgaagattggaatcagtgcttgtattcagtgagttggtttcctcagtctgcttctagatcttctgtatgggtgttttttgaagatttggtaataaagaagcatagggtttctggaaa

SEQ ID NO: 1312 - DNA, 507 bp, Triticum aestivum
  misc_feature (364)..(364): n is a, c, g, or t
  misc_feature (472)..(473): n is a, c, g, or t
ttccatcagctctgctcagttctctctactgcttcccctccatccaccgagtgaaaaagctctccatccgacgaaagatcgaccatggcgggcacggccaactgcatcgacatcatcctcgccatcatcctcccgcccctcggcgtcttcctcaagttcggctgcgggcatgagttctggatctgcctcctgctcaccttcctcgggtacatccctggtatcatctacgccatctacgccatcaccaagtaaaatcgagccgtcccaaagcgttccgcgatgtaatattttcaggatcatctcgtctgtctagcccctccctgcctttgtgggttcttttgattcttttccgtgtgcgttgctnatgcgaatttctctgtggtttccatggaccgtgtgaagagcagtggcttctctatgtatgtatatctatatgtactattagtatatcatgtatgggagtttatatatnntcccctattgggagtacttctttcttgaagctca

SEQ ID NO: 1313 - DNA, 617 bp, Triticum aestivum
catcctgctctgctcagcgcctctactgcttcccctccgtccaccgatcgagtgaaaaagctctccgttcgccggaagatccacgaccatggcgggcacggccaactgcatcgacatcatcctcgccatcatcctcccgcccctcggcgtcttcctcaagttcggatgcgggcacgagttctggatctgcctcttgctgaccttcctcgggtacatcccgggtatcatctacgccatctacgccatcaccaagtaaactagcaagccgtcccgagtgttccgcgacacaatattttcaggatgatttgatctgtctagtccctccttgcctgtgtgggttcttttaattcttttccgtgtgcgttgatgatgcgaattcctctgtggtttccatggaccatgtgaagagcatcagcttctgtatgtatatgtactagtatgatatatgggagtttatatatgcttcccgagtgggaatacttcttgttaaagttagattattgcctccctgttcaagtctggactcggcagtgatatgtatgtatagtcgggtttctcatttgatttcttcagtaataataatataaataacgaagcatcaggttctactgggaaaa

SEQ ID NO: 1314 - DNA, 622 bp, Triticum aestivum
ctctgctcagctctactgcttcccctccatccaccgatcgagtgaaaagctctccgtccgccggaacatcgacgaccatggcgggcacggccaactgcatcgacatcatcctcgccatcatcctcccgcccctcggcgtcttcctcaagttcggctgcgggcacgagttctggatctgcctcctgctcaccttcctcgggtacatcccggggatcatctacgccatctacgccatcaccaagtaaatcaaggcagccgccccgagtgttccggcggaatagtagtatatttccatgatgatctcgcctgtctattcctagcgtgctcgggttattgcttgtgtgggttctttgaattcttttccgtgtacgttgacgatgcgaatttctctgtggtttccatggaccgtgtgaagagatttcagcttctttatatgtactatgtatatgcactagtatcatgtatgggagtttatgcatacagtacttattgttgaagttagattaccgcctccctgttcaagtctggaatcggcagtgatgtgtatgtagtcgggtttctcatttgatttttcagtttttcttcagtaataataatataaataaagaagcatcaggttcta

SEQ ID NO: 1315 - DNA, 600 bp, Triticum aestivum
gctctgctcagctctagtgtttcctctccatccaccaccgagtgaaaaagctctccgtccgccgggcgaaagatcgacgaccatggcgggcacggccaactgcatcgacatcatcctcgccatcatcctcccgcccctcggcgtcttcctcaagttcggctgcgggcacgagttctggatctgcctcctgctcaccttcctcgggtacatcccggggatcatctacgccatctacgccatcaccaagtaaactagctagcaagccgtcccaagtgttccgcgacacaatattttcaggatgatttgatctgtctagtccctccttgcctgcgtgggttcttttaattcttttctgtgtgcgttgatgatgcgaattcctctctggtttccatggaccgtgtgaagagcatcagcttctttatgtatatgatatatgtgagtttatatatgctccccgagtgggaatacttcttgttaaagttagatcatcattgcctccctgttcaagtctggaatcggccgtgatatatactgcatgtagtcgggtttctcatttgatttcttcagtaataataatataaataaagaagcatcaggttc

SEQ ID NO: 1316 - DNA, 1010 bp, Triticum aestivum
ctgctccctgtcgtcattaattcctcgaaggacagagtgccgaacatcaagttcaatgttgcgaaagttctgcagtcgcttgtaccaatccttgatcaatctactgtgaagccatgcctcgtcgagctgagcgaggaccctgatgtggatgtacgatactatgcaaaccaggcccttcaggcgtgtgaccagatcatgatgtctagctaactaagctactgtcgtcacggttctttagaagctattcttactccccccgtgccgaattcggcacgaggctctgctcagctctagtgttttctctccatccaccgatcgagtgaagctctccgtccgccggacgaaagatcgacgaccatggcgggcacggccaactgcatcgacatcatcctcgccatcatcctcccgcccctcggcgtcttcctcaagttcggctgcgggcacgagttctggatctgcctcctgctcaccttcctcgggtacatcccggggatcatctacgccatctacgccatcaccaagtaaactagctagcaagccgtcccaagtgttcggcgacacaatattttcaggatgatttgatctcttggtctagtccctccttgcttgtgtgggttcgtttaattcttttctgtgtgcgttgatgatgcgaattcctccgtggtttccgtggaccgtgtgaagagcatcatcttctttatgtatatgatatatgggagtttatatatgctccccgagtgggaatacttcttcttaaagttaggctggtcacaatgggcaagaacataagctagtaacttacacactttcctagattatgttattatcttcatagtgtgtaagaacatctatatagtgtcatgcaacgatgtatttattaggttatagactcatttttttttaagtgtgtgatgtttcggtaacttagctagttaccacaagcacctctctcttcattaaatatgtgccacataagcaaagttatattagagtgtgtgatgttactccta

SEQ ID NO: 1317 - DNA, 579 bp, Leymus cinereus x Leymus triticoides
ctctgctctacttgcttcttccccatagtttactccatccaccgagtgaaaaactctccatccagcaaacgatcgaccatgggcacggccaactgcatcgacatcatcctcgccatcatcctcccgcccctcggcgtcttcctcaagttcggctgcgggcatgagttctggatctgcctcttgctcaccttcctcgggtacatcccgggtatcatctacgctatctacgccatcaccaagtaaatcaagccgtcccaagtgctccgcgatacgatattttcaagtccctccttgcttgcgtgggttcttttaattcttttccgtgtacgttgatgatgcaaatttctctgtggtttccgtgaagaagcagcagcttctttatgtatgtatatgtactagtatcatgtatgggcgtttatatatgttccccaagtgggagtacttctttgttgaagttagatcattgcctccctgttgaagtctggaatcgggcgtgatatgtatgtagtcgggtttccatttgatcttcttcagtttttctgaagtaatacatataaataaagaagcatcaggttcttt

SEQ ID NO: 1318 - DNA, 870 bp, Oryza sativa
gtgcttaacagctaagaaatcggccaaaattcaggcaaacaagagacaaagttagcaggcaacgcgtcactaccgcgtgatcatttcgacgcgaaggcaatttggccggtgatcgagcgcgtctcgtgcagtgaatgaagtagcttaatttgctagtccccacaagtacgtggcactctgccatgtcttctcttagtataaatatatggaagccaaagccaaagccagtcagttcatcagttgcagttcagagttgcccactgctactttactttgcagctattttgcttctgcttcttcttgttcttgttgctgttggtaatactgcgagagaaattaatcagtagagtgttcatctactatcaatttttgatcgaggagagatggcgggaacggcgaactgcatcgacatcctcatcgccatcatcctcccgcccctcggcgtcttcctcaagttcggatgcgggcatgagttctggatctgcctgttgctcaccttcctcggctacatccccggcatcatctacgccatctacgccatcaccaagtaattcatcattagttactacatcatcaaccaaatcctcaagggatgggctccaaaccgcttcatctatcttctcgattgccgtgtgcttgttggaatttggaaatgatatatgcatccaaaattcagtcctgagtgctccaattcttgtcatctagtcattttcaatgtccccccagtctcttcctctaatgtttgatgatatgtagaatctcttgctgttaatctgttgctttcgtgtgaataagctcccctcttatgtatatctatctatgacttgttttactagtaaacttgattattgagagcttgagacttgcttc

SEQ ID NO: 1319 - DNA, 602 bp, Triticum aestivum
tttactttgcagctattttgcttctgcttcttcttgttcttgttgctgttggtaatactgcgagagaaattaatcagtagagtgttcatctactatcaatttttgatcgaggagagatggcgggaacggcgaactgcatcgacatcctcatcgccatcatcctcccgcccctcggcgtcttcctcaagttcggatgcgggcatgagttctggatctgcctgttgctcaccttcctcggctacatccccggcatcatctacgccatctacgccatcaccaagtaattcatcattagttactacatcatcaaccaaatcctcaagggatgggctccaaaccgcttcatctatcttctcgattgccgtgtgcttgttggaatttggaaatgatatatgcatccaaaattcagtcctgagtgctccaattcttgtcatctagtcattttcaatgtccccccagtctcttcctctaatgtttgatgatatgtagaatctcttgctgttaatctgttgctttcgtgtgaataagctcccctcttatgaatatctatctatgacttgttttactagtaaacttgattattgagagcttaaaaaaaaaaa

SEQ ID NO: 1320 - DNA, 900 bp, Pseudoroegneria spicata
  misc_feature (591)..(591): n is a, c, g, or t
  misc_feature (594)..(594): n is a, c, g, or t
catcctgctctgctcagctctactgcttcccctccatccaccgagtgaaaaagctctcatccgccgaaagatcgaccatggcgggcacggccaactgcatcgacatcctcatcgccatcatcctcccgcccctcggcgtcttcctcaagttcggctgcgggcatgagttctggatctgccttctgctcaccttcctcgggttcatcccgggtatcatctacgctatctacgccatcaccaagtaaatcaaggcagccgtcccgagtgttccggcggaatactatatgttcatgatgatctcacctgtctattcctagcgtgctcaggttattgctcgtgtgggttcttttaattcttttccgtgtacgttgatgatgcaaacttccctgtggtttccatggaccgtgtgaagaagcagcagcttctttctgtctgtctctgtgtaatatcattgcctccctgttgaagtctggaatcggctgtgatatgtatctagtcgggtttctgacttgattttcctcggtttttcttctatagtacagtagtagtaatatgtgtataaataaagaagcatcaggttctattgggaantcntagtcgactgagacttcgttaagtctcagtcgatgctatatccgtgagatcttacattaagatccgtgtaaaattttctttttagtttttctttttctctctagcatgttcacttgactgagacttggttaaatctcagtcgactgagacctagccacacccaaataaagaagcatcaggttctattgggaattccatatagcgttgttatgcaaatctgaggtgcgcgtccctctcgggacagttgcgcacttgcgcgcgcggctttgctcgtgttaacaaaaataaaaaagctgtatcatcata

SEQ ID NO: 1321 - DNA, 633 bp, Tropaeolum majus
ttcggccattacggccgggggtaaaatcaaagtttagttacatatagagagagaaaatcaagcaatataaattatataattacatacatatatatatatatatatatagtttttgtaatcaggagagagaaagaaagaagaaatggcaggtacagcaaactgtgtagatatcatcttagcaatcatcttgcctcctcttggtgtcttcctcaaatttggttgtgggaaggagttttggatctgtttgttgctgacaattcttggatatattcctggaattatatatgctgtttatgctatcaccaagtgatttcttccatctccatgggatggataaatagttgtggtttgttgttttggagtcttgaggttgatgatcatactcttctcattttgttaatgtttttttgtattttcttgtgaaatttgtattttatttttatttttttggttttctatgttatatgatgtactaatattatgtttcaatatttggtatatattaatttgttttcataaacaattcaagattgtgtacttgaaacaatcatgcatgtaaacctttaatttcaatgatataaaatttgaattttagttaaaataattatcaaaaaaaaaaaaaaaggccgcctc

SEQ ID NO: 1322 - DNA, 256 bp, Hordeum vulgare
gcacgagggtctgctctgctctgctcagctcagctctgctgcctcccctccatccaccgagtgaaaaaagctctccgtccgccgaaggatcgaccatggcgggcacggccaagtgcatccacatcatcctcatgatcatcctcccgcccctcggcgtcttcctcaagttcggatgcgggcacgagttctggatctgcctcctgctcaccttcctcggctacatcccgggcatcatctacgccatctacgccatcac

SEQ ID NO: 1323 - DNA, 513 bp, Leymus cinereus x Leymus triticoides
gccctgctctgctctactctactctactgcttcccctccatccaccgagtgaaaaactctccatccgccgaaagatcgaccatgggcaccgccacctgcatcgacatcatcatcgccatcatcctcccgcccctcggcgtcttcctcaagttcggatgcgggcatgagttctggatctgcctcttgctcaccttcctcgggttcatcccgggtattatctacgctatctacgccatcaccaagtaaatcaagccgtcccaagtgttccggcggaatactatattttcatgatggatctcacctgtctattcctacttcctagcgtgctcatgttatttgcttgtgtgggttcttttaattcttttctgtcgactgccgtacgttgatgatgcaaatttctccgtggtttccatggaccgtgtgaagaagcagcagcttctttatgtatgtactatcatgtatgggagtttatatatgtttcccaagtgggagtacttctttgttaaaaaaaaa

SEQ ID NO: 1324 - DNA, 480 bp, Musa acuminata
ttagaaagaatcggccattacggccggggacatctgcctgacgtcgtcgtcttcttcttattcttcttcttcttcttctcgctgtgcttggttgagatcgagttaatggcggacgagggcacagccaactgcatcgatatcattctggccatcatcctccctccgctcggtgtcttcctcaagttcggatgcaaggcggagttctggatctgcctgttgttgacgattctgggctacatccccgggatcatctacgcggtgtacgccataaccaagtaaaattgctcctcggagctcctctgtaaggaagtggtgatacgatggtggcgctgctctgtgattgattcgttcgtctgtacaaatgatttcttctactagttgttgagagttctgtgaactctagctttgttttcgactgttgtgttactgtattggttgatttgtcgtcatcgtcaataaatgaagcactaagtttcttga

SEQ ID NO: 1325 - DNA, 445 bp, Musa acuminata
gacatctgcctgtcgtcgtcgtcgtcttcttcttcttcgtcttcttcttcttctcactgtgctaggtttagatcgagttaatggcggacgagggcacagccaactgcatcgatatcattctggccatcatcctccctccgctcggtgtcttcctcaaattcggatgcaaggcggagttctggatctgcctgttgttgacgattctgggctacatccccgggatcatctacgcggtgtacgccataaccaagtaaaattgttcctcggagctcctctgaagtggtgatacgatggtggcgctgctctgtgattgattcgttcgtctgtacaaatgatttcttctactagttgttgagagttctgtgaactctagctttgttttcgactgttgtgttactgtattagttgattggtcgtcatcgtcaataaatgaagcattaagttt

SEQ ID NO: 1326 - DNA, 313 bp, Orobanche aegyptiaca
atctcattttgagaagaaaagataaaacaatctttcttgaaaattaatacaaaaggcaaaaatggcagatgggacagcaaactgcatcgacattctagtggccattcttctgcctcctcttggtgttttcctcaaatttggctgcggggttgagttctggatttgcttgctattgacactcttgggttacatccctggaatcatttatgcgatctatgccatcaccaagtaaagattctttataatggtgaagatgcaaacagttgtgtggtcttttccagcggttgaattggtgttgattttagatttcgat

SEQ ID NO: 1327 - DNA, 499 bp, Linum usitatissimum
agcagatcaaagctcaaatatttttaatcatagtaatctcagccttcatcaattatgggcaccgctaattgcatagacataatcctggcgatcctgttgcctcctctgggtgtgttcctcaagttcggctgccaggttgagttctggatctgcttgctcctcaccatccttggatacatccctggcatcatctacgccatctacgccataaccaagtgacctcatcatcatcatgtaattgccgacgacgactcctatgatctgctgttcttgttgtttgtctgtggtgttttgaagatgttaggtagttgcgtttcatacccagattatatcagctagctatatagcctactgtgtacaagcttagttgttcaattttttccttgtgtaatttaccatttttaattactatgtacgcttttacagatgatgtacaatttcagagttctgttattgttactttttcctctttgctcttgttagtaatggaggaattaat

SEQ ID NO: 1328 - DNA, 660 bp, Pennisetum glaucum
aaccagcgcgtataggctatagggaaaaggggggaaaaagaggaccctcgttcagttcagggaaaggaagaggatcgtcgtcggagcgaggcactgcaggcacctgcttgccgcagttagggagcaccatggcgggcacggcgaactgcatcgacatcctcatcgccatcatcctccccccgctcggcgtcttcctcaagttcggctgcaagtgcgagttctggatctgcctcttgctcaccttactcggctacctcccggggataatctacgcgatctacgccatcaccaaatagtagtatgatcaggttctttctgcaaccagctgctgctacagtaggcaggttgatgttgtacctgctggatgcggcaggaaccggcggtgccggatgatgtgtgtgtgagatgtatcctttggagatttatcgtctgttgtcgagctacaaaccggccgagttcatgcttgtgttatgtgtgcagactgtgtacagtacatatgttcatctcatcatgtgaaactgtaagacaccgatatacgttgtccgatccatgttgttgttcagttgaagagctagctcttgattgggttttatgtaaagccacttgcttctagtggggatttcgtatctatgtttctagtagagtgccacatgtataatt

SEQ ID NO: 1329 - DNA, 501 bp, Avena sativa
ttcttcgatcgcctagttcttcatccactgcttcctcgaccaagagatcaagctctcaagaaggaagaccgatcgaccgatcatgggcgcggccacctgcatcgacatcatcctcgccatcatcctcccgcccctcggcgtcttcctcaagttcggatgcgggcatgagttctggatctgcctcttgctcaccttcctcggctacctccccggcatcctctacgccatctacgccatcaccaagtagattcacatcgtggcgtggcatctgctgttccgaaatatcctcgtactactagtaagtcttcatgatcgaagatgccatctctctatgtatagaagtctagtgtgcttcagttgttgcttgtgttcctttccattctttttttcatgatctgtacttattggcccctgctgtttcattggaccgttgtatgtataccagttggtgatgatgtgagaggccacgtccttatgaggtgctcgccaacgtttcattag

SEQ ID NO: 1330 - DNA, 476 bp, Linum usitatissimum
agtaatctcagccttcatcaattatgggcaccgctaattgcatagacataatcctggcgatcctgttgcctcctctgggtgtgttcctcaagttcggctgccaggttgagttctggatctgcttgctcctcaccatccttggatacatccctggcatcatctacgccatctacgccataaccaagtgacctcatcatcatcatgtaattgccgacgacgactcctatgatctgctgttcttgttgtttgtctgtggtgttttgaagatgttaggtagttgcgtttcatacccagattatatcagctagctatatagcctactgtgtacaagcttagttgttcaattttttccttgtgtaatttaccatttttaattactatgtacgcttttacagatgatgtacaatttcagagttctgttattgttactttttcctctttgctcttgttagtaatggaggaattaataaaggaaa

SEQ ID NO: 1331 - DNA, 557 bp, Panicum virgatum
gggaatccaattcttcttccaacaagccagagactgcgcgagccgcacggcactgaccgctgaggatcatatccagcaggaaagagagacagaggcagcagagagcatggcggccaactgcatcgacatcctgatcgccatcctcctgccgccgctgggggtgttcctcaagttcgggtgcgggcacgagttctggatctgcctcctcctcaccttcctcggctacatcccgggcatcatctacgccgtctacgccatcaccaagtagtacgagtagtatcgtcttctgtctatgctatgccagtggggatcctgatcgaatctgtcgatgagtgctccacttcatgtgtgttcgtgccatgatgtactagtgctcctgtttagtttcgtcgcccccgctcttgtatttatttacccgtgctttgttggttgattatatcccagtgctgatttcgctgctcaccatgtctgagcttttttttttttgagaaacatcatgtctgatcttttgttcttgttgaggatttgaggcgtactcctctctctagctcatggat

SEQ ID NO: 1332 - DNA, 894 bp, Zingiber officinale
  misc_feature (456)..(456): n is a, c, g, or t
gcacgaggccactgactgcactccgtcggtcactccctgctttgctttgctctgtctcatctcagctcgaggtcatcaatggcggacgagggcacggcaaattgcatcgatattattctcgccatcatcctccctcctctcggtgtcttcctcaagttcggatgccaggtggagttctggatctgccttctgctgacgctgttcgggtacatcccgggaatcatctacgccgtgtacgccatcaccaaataaacaacaaccagccctaagctgtacaatactagatctggcgatcgacgaaaccttccgcttctgtatggtttgcttgtttaattggaggtcgttttaatttccattgtgatttatttcttggaaaactaatttgattctcgattatattgtgttgatgtgtaagttagtgttgtacgggattgaataaataagttgttaattagnttggagttggatctgcatgagctgcgctttccttcctctgtttctggtttgattaagttaattgccctaaatagaaggatcgaaagggggttccgaagaacttcacagatcgatttcccatttcggcgagttgctgttcgaggaagataaagaacggccgtagaggacactgacagtaggccctacggctccattcgcacgccagtgacagttgttgctgaacatgtcgttatttgaatttggcttatttaataaaaaatatatattttttaaatttagctcgtttttcagaagtaaagttaggtagtagagaggtaggtccggttcaatgggctgaatttgctggtagggatgtaaatgactgttaagttcgagtttgacttgtttaaattatatttaagttcggcttgaattgatctcgagttctagtttacgagc

SEQ ID NO: 1333 - DNA, 776 bp, Populus trichocarpa
tgaatacgattcttacaacccaaaagcgtgccatccaccccttcccttcccttccctttgtcgtctaatcaacgactctcacacgaaggaagagagtgcataatatgatcttcattagctaggtattactagacgacgtacgtgtgggacacgtgtacactggaaggttgtgttagtgggcagtggggtggctctggggcgcctatatataaccaacctcaatcttcaactctctgtatatcgcagaatatattagcaccacaaagaagaaaaacagtttctcaagagcagtatatatagatctttcagaagaattaaggagatggcagacgagggaacagctacttgcatagacatcttgttggccatcatcttgcctccgcttggtgtcttcctcaagtttggctgcggggtggagttttggatctgcttgcttctcaccttctttggctacctccctggaattatttatgctatctacgccatcaccaagtgaagatcctgatcttatctgttgtggagaggcacataaccgtttgattcaatgaaaagtcccttgttggtgtacatcgatcaatacttggaatatttattcttctttctttcttcataattgtgcgtcttttttttttaattaaataagaaatgatttgttgtgaaagaggtaattaattagcaattgttgttgagtgacatttgtgagtatgggtacttaagaccgtaatggatggatttaattttcttgttaagtagtatctttccctcttaacttaatt

SEQ ID NO: 1334 - DNA, 766 bp, Populus trichocarpa
tgaatacgattcttacaacccaaaagcgtgccatccaccccttcccttcccttccctttgtcgtctaatcaacgactctcacacgaaggaagagagtgcataatatgatcttcattagctaggtattactagacgacgtacgtgtgggacacgtgtacactggaaggttgtgttagtgggaagtggggtggctctggggcgcctatatataaccaacctcaatcttcaactctctgtatatcgcagaatatattagcaccacaaattaagaagaagaaacagtttctcaagagcagtatatatctttcagaagaattaaggagatggcagacgagggaacagctaactgcatagacatcttgttggccatcatcttgcctcctcttggtgtcttcctcaagtttggctgcggggtggagttttggatctgcttgcttctcaccctctttggctacctccctggaattatttatgctatctacgccatcaccaagtgaagatcctgatcttatctgttgtggagaggcacataaccgtttgattcaatgaaaagtcccttgttggtgtacatcaatacttggatttattcttcttaatttcttcataattgtgcgtcttttttttttaattaaataagaaatgatttgttgtgaaggaggtaattagcaattgttgttgagtgacatttgtgagtatgggtacttaagaccgtaatggatggatttaattttcttgttaagtagtatctttccctcttaacttaatt

SEQ ID NO: 1335 - DNA, 497 bp, Saccharum officinarum
  misc_feature (121)..(121): n is a, c, g, or t
  misc_feature (364)..(364): n is a, c, g, or t
cacgagcccaatcccatccatccaagctaaggcaaggcagaggagaggcaagaggatcggccgccggagtgcgatcaccgacaccgagcagcttgcagatcgagaagaaggcaggcagcanccatggcggaggggacggccaactgcgtggacatcctgatcgccatcatcctgcccccgctgggggtgttcctcaagttcgggtgcgggcacgagttctggatctgcctcctcctcaccttcctcggctacctccccggcatcatctacgccgtctacgccatcaccaagtactagcactagcttagttattggcttagctgctattcctgttcctttgcttgctcgccgacaagtatgtatngatatatgccgattccaatacctgctagtacgtactacctaggtagcacctgctgctctgctcttctatatatgattccgacttgtgtgtcattgtgtgatcgtcgatgaatcgaacaaacagctattaagct

SEQ ID NO: 1336 - DNA, 537 bp, Eragrostis curvula
tgcttagttttgtgctcaagcaaacaggaggtgcttagtttcttcagcagtttccctataattttctagcaacgcgatagaggtgatttgatctccatcgactggccatggctgacgggacggccaattgcgtcgacatcctcatcgccatcatccttccgccgctcggcgtcttcctcaagttcggatgcgggcacgagttctggatctgcctgctgctcaccttcctcggctaccttcccgggatcatctacgccgtctacgccatcacccagtagagcagcagcttcacagctgttcaaggtaagacaacacgcccctaccaactacaagcttgtacatcgaatccatcagctaacatatgacacacttcctctgttcttccttcttatttttaccggattcaggaactgatgcctgacggtggtgggaaatatgtgttgtcgttcgtccgagttctctggttctggatcatgtgttttccttctttttccccgcttgttcgtcagcactcttggtgacgccgattcctagctg

SEQ ID NO: 1337 - DNA, 578 bp, Saccharum officinarum
ccatccaagccaaggcaaggcagaggagaggcactgcacaggagaggaagaggatcggccggcggagtgcgatcaccgacaccgagcagcttgcagatcgagaagaaggcaggcagcagccatggcggaggggacggccaactgcgtggacatcctgatcgccatcatcctgcccccgctgggggtgttcctcaagttcgggtgcggacaccagttctggatctgcctcctcctcaccttcctcggctacctccccggcatcatctacgccgtctacgccatcaccaagtagtagtgctactactagctgttcctttgcttgctcagctcgccgatatgtatgcatggatgccgattccactacctgctagtacctagtaggtaccacctagtgctctgctcttctatgattgtatctatgtgttcatatgccggccgacttgtgtgtgatcgtcgatgaatcgaacaaacagtcattaagctactactagtatattcatgggtatgtcctgcttgtctcaagttactgctgtctgtcttttgctatatatcaccgcgacgcaagcataataagttca

SEQ ID NO: 1338 - DNA, 469 bp, Saccharum officinarum
tcggcacgagcccaatcccatccatccaagctaaggcaaggcagaggagaggcaagaggatcggccgccggagtgcgatcaccgacaccgagcagcttgcagatcgagaagaaggcatggcggaggggacggccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagtagtgctactactagctgttcctttgcttgctcagctcgccgatatgtatgcatggatgccgattccaatacctgctagtaccacctagtgctctgctcttctatgattgtatctatgtgttcatatgccgtgccgacttgtgtgtgatcgtcgatgaatcgaacaaacagtcattaagcta

SEQ ID NO: 1339 - DNA, 476 bp, Saccharum officinarum
ccatccaagctaaggcaaggcagaggagaggcactgcacaggagaggaagaggatcggccgccggagtgcgatcaccgacaccaggcaggcagcagccatggcggaggggacggccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagttgtgctactagcttattatatgccttagctacttgctctgctcgccgatatgtatgtatggatgccgatttcaataccttctagtacctaggtagcacatgctgctctgctcttgtatgattctatctgttcatatgtcgtgccgacttgtgtgtgatcgtcgatgaatcgaaccaacagttattaagctgctactagtatattca

SEQ ID NO: 1340 - DNA, 487 bp, Saccharum officinarum
cccaatcccatccatccaagctaaggcaaggcagaggagaggcactgcacaggagaggaagaggatcggccgccggagtgcgatcaccgacaccaggcaggcagcagccatggcggaggggacggccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagttgtgctactagcttattatatgccttagctacttgctctgctcgccgatatgtatgtatggatgccgatttcaataccttctagtacctaggtagcacatgctgctctgctcttgtatgattctatctgttcatatgtcgtgccgacttgtgtgtgatcgtcgatgaatcgaaccaacagttattaagctgctactagtatattca

SEQ ID NO: 1341 - DNA, 541 bp, Saccharum officinarum
cccaatcccatccatccaagccaaggcaaggcagaggagaggcactgcacaggagaggaaggggatcggccgccggagtgcgatcaccgacaccgagcagcttgcagatcgagaagaaggcaggcagcagccatggcggaggggacggccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagctgttcctttgcttgctcagctcgccgatatgtatgcatggatgccgattccaatacctgctagtagataggtaccacctagtgctctgctcttctatgattgtatctatgtgttcatatgccgtgccgacttgtgtgtgatcgtcgatgaatcgaacaaccagttattaagctactagtagtatgttcatgggtatgtcctgcttgtctcaagttactgctgtctgtcttttgctat

SEQ ID NO: 1342 - DNA, 459 bp, Saccharum officinarum
gcacaggggaggaagaggatcggccggcggagtgcgatcaccgacaccgagcagcttgcagatcgagaagaaggcaggcagcagccatggcggaggggaccgccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagtagtgctactactagctgttcctttgcttgctcagctcgccgatatgtatgcatggatgccgattccaatacctgctagtaccacctagtgctctgctcttctatgattgtatctatgtgttcatatgccgtgccgacttgtgtgtgatcgtcgatgaatcgaaccaacagttattaaactactagtagtatgttcatgggt

SEQ ID NO: 1343 - DNA, 495 bp, Saccharum officinarum
cccaatcccatccatccaagctaaggcaaggcagaggagaggcactgcacaggggaggaagaggatcggccggcggagtgcgatcaccgacaccgatcagcttgcagattgagaagaaggcaggcagcagccatggcggagggggcggccaactgcgtggacatcctgatcgccatcatccttcccccgctgggggtgttcctcaagttcgggtgcgggcacgagttctggatctgcctcctcctcaccttcctcggctacctccccggcatcatctacgccgtctatgccatcaccaagtaagtagtgctactacttattggcttagcagctgctgctgctgctactgttcctttgcttgctcagctcgccgatatgtatgcatggatgccgattccaatacctgctagtaccacctaggctctgctcttctatgatggatctatgggtcatatgccgggcccacttgtgtgtgatcgcgatgaatcgacaacc

SEQ ID NO: 1344 - DNA, 610 bp, Panicum virgatum
gaatccatccaattcttccaagccagaccgcgcgagcacggcactgaccactgagcatcatatcgagccggaaagagagacaaggaaagaaagaggtcgagaaagaagcagaggagcggctgcggcgatcgagcatggcggagggcacggccaactgcctcgacatcctgatcgccatcctcctgccgccgctgggggtgttcctcaagcacgggtgcgggcacgagttctggatctgcctcctcctcaccttcctcggctacatcccgggcatcatctacgccgtctacgccatcaccaagtagtagagtatcgtcttctgtctatgccagtgggatagatcatgaatccgccgcactagttcctgtgtgttcgtgccacgatagatgtagtagtgctcctttcttgttacccccggcacgctcttgtatttacccgtggttccttggttgatcttggttccagtgctgatttcgctgttcatcatgtctgtgcttttgctgttgaggatttgaggtgtgctaccgtgttctctctagctgatgggtcgctgcaatcgatcaaggttactaagaattttatatatattgtcatcgcgcttgctgcatcc

SEQ ID NO: 1345 - DNA, 562 bp, Panicum virgatum
ggcggctgcccatacacatcacacatcaaactaactgccagttggagaggaagaggggaaccacctctccggcgcaagatgaaggcgggcacggcaaactgcatcgacatcatcatcgccatcatccttccccctctcggcgtcttcctcaagttcggttgcaaggtcgagttctggctctgcctcttgctcaccttcctcggctaccttccggggatcatctacgcgatctacgccatcaccaagtagagtacgggaacagagcaacacttggagagaaggatgtaaaattcttaccggtgtcttctagtttggagattgattgtcatctgtcaagctactcgtactgattgagctctagtttggagattggtatctgtcagataatcagattgattgtcatccgtctgatgattatttgtggatcctatatatgatgatacggtgtttcgtgtgagaaattcctgccaactcgtgctgtttttctttcgcgcgcagtggtctctgtaaatctgtctcaatagttgttgataataataaaaatgtatcttgcttggtgaaa

SEQ ID NO: 1346 - DNA, 604 bp, Saccharum officinarum
gtcgacccacgcgtccgcaatcccaatcccatccaagccaaggcaaggcagaggagaggcactgcacaggagaggaagaggatcggccgccggagtgcgatcaccgacaccgagcagcttgcagatcgagaagaaggcaggcagcagccatggcggaggggacggccaactgcgtggacatcctgatcgccatcatcctgcccccgctgggggtgttcctcaagttcgggtgcgggcaccagttctggatctgcctcctcctcaccttcctcggctacctccccggcatcatctacgccgtctacgccatcaccaagtagtagtgctactactagctgttcctttgcttgctcagctcgccgatatgtatgcatggatgccgattccaatacctgctagtacataggtaccacctagtgctctgctcttctatgattgtatctatgtgttcatatgccgtgccgacttgtgtgtgatcgtcgatgaatcgaacaaacagtcattaagctactactagtatattcatgggtatgtcctgcttgtctcaagttactgctgtctgtcttttgctatatatcaccgcgacgcaagcataataagttca

SEQ ID NO: 1347 - DNA, 561 bp, Saccharum officinarum
ccatccaagccaaggcaaggcagaggagaggcactgcacaggagaggaaggggatcggccgccggagtgcgatcaccgacaccgagcagcttgcagatcgagaagaaggcaggcagcagccatggcggaggggacggccaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagctgttcctttgcttgctcagctcgccgatatgtatgcatggatgccgattccaatacctgctagtagataggtaccacctagtgctctgctcttctatgattgtatctatgtgttcatatgccgtgccgacttgtgtgtgatcgtcgatgaatcgaacaaccagttattaagctactagtagtatgttcatgggtatgtcctgcttgtctcaagttactgctgtctgtcttttgctatatatcaccgcgacgcaagcataataagttca

SEQ ID NO: 1348 - DNA, 522 bp, Triphysaria pusilla
acagaaattgttaatcttattaatccctctaaaattatctttatcttcagtttttgtttggattaagagataattatggggactgcaacttgtattgatatcatcctcgctattattctgcctccacttggtgttttcctcaagtttggctgcggggttgaattctggatatgtttgattctgacgctgttgggttatctccctgggattatatatgctatctatgccatcaccaagtagttttttttcgtctatggtataatggtgaggatgcaaaagggccataaagtttgatttggtgttggtgttaggctgcttgtccatttcttctttatttttgcttttgccttttttattttattttattaatgaaaatgtatttgctatctatgtagtgatttttatttgctttatcatattgtaacgtgttattattatacaagtatcatggctcattgtataattgatgcttctaagtattgtaattatgattttatttgataagtgttgtttgaatttctt

SEQ ID NO: 1349 - DNA, 347 bp, Triphysaria pusilla
acagaaattgttaatcttatattaatccctctaaatttatttttatcttgagtttttgttcggattaagagataattaatatggggactgcaacttgtattgatatcatcctcgctattattctgcctccacttggtgttttcctcaagtttggctgcggggttgaattctggatatgtttgattctgacgctgttgggttatctccctgggattatatatgctatctatgctatcaccaagtagtcttcttttttcgtctatggtaaggatgcaaaagggccataaagtttgatttggtgttggtgttaggctgcttgtccttttcttctttatttttgcttttgc

SEQ ID NO: 1350 - DNA, 510 bp, Secale cereale
tctccatccgacgaaagatcgaccatggcgggcacggccaactgcatcgacatcatcctcgccatcatcctcccgcccctcggcgtcttcctcaagttcggctgcgggcatgagttctggatctgcctcctgctcaccttcctcgggtacatccctggtatcatctacgccatctacgccatcaccaagtaaaatcgggccgtcccaaagcgttccgcgatgtaatattttcaggatgatgatctcgtctgtctagcccctccatgccttcgtgggttcttttgattcttttccgtgtgcgttgatgatgcgaattcctctgtggtttccatggaccgtgtgaagagcagtggcttctctatgtatgtatatgtatatgtactattagtatatcatgtatgggagtttatatatgctcccctattgggagtacttctttcttgaagctaaatcatcattgcctccgtgttcaagtctggaatcggccgtgatatagtcatttgatttctt

SEQ ID NO: 1351 - DNA, 818 bp, Euphorbia esula
  misc_feature (10)..(14): n is a, c, g, or t
ttcaaaaacnnnnntttcgtttcctgaaattccttgaaagcgataaaaaatgggaacagcaaattgcgtcgacattatcttagcaatactattgcctcctctcggcgttttcctcaagttcggttgcaatgttgaattctggatatgtttgcttctaacgattctgggatacatacctggaattatatatgctatttatgctatcaccaagtgatgatgatccttcatttttccatctactgtgagtaaaaaactaatcaccgtctctctattttattttcagaaaaaactcattgcattacaattcttaattgatactaattaatatttctttacaagcttaattaacattaaaagtcacctttatacgtttgctttctgtatatttaaaaaactaatatagttttccatcacgcccaattcatttgatgtgtaatactaatatggtggggctttcaacattgttcaaccattaacgttgggtgctcctgctatattggcgtcacgcaccaaatgaattcggcgtgaggggcgtgttaaatgtcccatattattaacttggaagctatattgattttttaaatatagaaagtaaacatatcccttcaatgtgtggcttcctaatttatcaatgtggaacatttttaacacgtttttttcacgcccaattcatttggtgcgtgatgtcaattcaactggaagtctcacattgatcaatcatgattctgatatcatcttagcaaatcctaactaacggtaaaagtgacattgattgatttgtttatttatgagccattttgctttctaatatataaatt

SEQ ID NO: 1352 - DNA, 511 bp, Brassica napus
  misc_feature (3)..(3): n is a, c, g, or t
  misc_feature (6)..(7): n is a, c, g, or t
  misc_feature (9)..(9): n is a, c, g, or t
ctntgnngnaaaaagtaggtatatattatatctaaaaaaaaacttgaagagcttgaagggaagaaccaaaaaatggcggacgaaggaagtggaagtggaagtggaagtggaacagctaattgcatagatattgtgcttgctatcctcttgcctcctctcggcgtcttccttaaatttggctgccatgtggagttttggatatgtttggcgttaacgttcttaggatacattccggggatcatatatgctatctatgccatcaccaagaagtagtgatctctctctctgccttcttgagtcttgttatatggctaccacttgtatatttcatgtacaactatagtttatacatgataaatcacagctcttctcttctactgcactaggacgatacgattgatgaaggaacggtggtgttattttgatagtttctttttttattgttcatttcaatattgtaagataaacttattaaatatggtaaagttaatataaatggagttgaattttt

SEQ ID NO: 1353 - DNA, 706 bp, Cryptomeria japonica
aacagcctcgtgctctgtgttctgttctgtgatttctgtgctctgttctctgttttgagctcttctgtctgtttgtgctgcggtatcgttatcagagaaatcatgagggaaggcactgcgaattgcgttgacatcattttggccatcatcttgcctcccttgggagtcttcctgaaatttggctgtcatgcggagttctggatatgcttgctgctcacaattctcggctacttgccaggaattatttatgcaatctatgccatcactaagtgaaaccgtcgctgtcatgctttcctttggatgtaattttattttattttagggtttgctggttgtttagggtttgagtatccggcttgttgcagaagaataatggaaggattttcagcagtgattttagttgaggcagctgaagccaaacactttgatgtaatatttatcctcgatttatttggccgttaggtcatggacatgattgcatgaatcatttttagtaattctaaaatatcagtgtaatatttttagttcctgccacagcaggatatttatgcattcacttaggtcattttcttttttcaggatatttatgcattcacctaggtcattttttttttaagctgaccgatcagatttaagaattttaaacaagtctatagtttatatttatttaagttttaatataattataaaaataccatttttcttt

SEQ ID NO: 1354 - DNA, 498 bp, Euphorbia esula
cttcttcactttcgaaatagaattcaaaaactccattttcgtttcctgaaattccttgaaagcgataaaaaaatgggaacagcaaattgcgtcgacattatcttagcaataatcttgcctcctctcggtgtttttctcaagttcggttgcaatgttgaattctggatctgtttgcttctaacgatcctgggatacatacctggaattatatatgctatttatatcattaccaagtgatgatgatccttcatttttccatctactgtggaaaagctttgggagccatttgatttgatgtaaaccgtatatttctgttggtgtagtttgatggagacacttgttgagccaatgtcttcaatccttttccttttttagtaactttttgtctgttatgtggtgtaaaggggtgactttgtgtttatgattatggcctttactctgtctgaattcatattttttgttataataaaagtgattgcattattattttctattatc

SEQ ID NO: 1355 - DNA, 523 bp, Musa acuminata
gaaaaccttttgccctttgagagagagagagagagagagagagaggtcatggcggacaaggggacggccaactgcatcgacatccttcttgccatcatcctccctccgctgggcgtcttcctcaagttcggatgcgaaatggagttctggatttgcctcctgttgacgttgttcggatacattccagggatcatctacgctgtgtacgccatcactaagtaaattggtctctctgagctcagggaattgatgcccgatagtggatgtcactcctcactgttctatggacgattcctacctgctctgtataattgtcatgcacttcttcttgttgggagctctctcttagctctcgagttgtctttgtctctgtatcgtagtagttgtttgctgtatgtgttctgctacctgtagaaggacatgctcattcttttggatgatgatgtcttcggtacagttgtttcatatcctatctatagcatgttcatcagaataaatttatgatgaaagggctttgtgactt

SEQ ID NO: 1356 - DNA, 662 bp, Eucalyptus gunnii
cggccggggaccgtaacctgcaaatatccctcgagtctctctctcgccaaccaccgttccctttcgatttctctgtttcttctccattttctcggagcccgttcgaaaaggggtttttctgcagagagaaattccgcttctccttggcttcggtagagagagagctagcagaagagacagaaaggaacaggaaaaatgtctggcacgatgaattgcatcgacattatcctagccatcatcttgcctcctctcggggtcttcctcaagtttggttgccaggtggagttctggatctgtttgattctcacgctctttggctggattcctggtatcatttatgccatctatgccattaccaagtaactgaacttgattgagtggcaacacatgatgggccgatgcgtctccatccaacagtcgcgatttcgtgggatattatcttcttcgaatatatatatttttttttggggtcatagggatatcatcttcgtcggatgtgtccttttcttctcttcgtttttttcctgtaattgtcattagttgtccgtagcgtgatgatgatttgttgtattattggattcatttcctatatatgaaatggcgccctggctctgtcggctggttttcagatatttctttaattgaccccacttgagatttat

SEQ ID NO: 1357 - DNA, 414 bp, Liriodendron tulipifera
cttctcttctctctcaattccaaaagctttctttaatggcggctgcgaactgcgtagacatcatcttggcgattcttctcccgcctcttggggttttcctcaagttcggttgcaaggcggagttttggatctgtttgttgctgacgatcttgggatatatccctggaatcatctacgccgtctatgccataaccaagtgaaaatcttcctattgagaaagactctatttggtcggttatcaggtggtgtgtatttggtggttgtaactgctgttgttttacgatggaggatcctgaccgttgattcttgtttgtctgagtgtgtttgatttctctgtgattatggttttctttctctttgtaatttacgttgtttattagaataaaggaagacaatgtaagttgttataaaaga

SEQ ID NO: 1358 - DNA, 657 bp, Lotus japonicus
gacataacacgttaacattcatttacattttgcatagcaagaagttcctgtttttgcaactttgaaaggaaaaagagttaattagacaactccagagaaaaaaaatgggcacagcaacatgcgtagacatcattcttgccatcatcctacctcctcttggagttttccttaggtttggatgcaaggtggagttctggatctgtttgctgctgacaattttaggttatatacctggaattatctatgctatctacgctatcaccaagtgatcaacctttatagcttcagtggagaatgaataaacgtcaagggtgtttctgtcttttggttctgatactggtgtttctctaaaattggttgctgagggtcaagactgatttttatccccacctcacaaaaaaaaaaataaaaattatgtaaatcattgtccattgtatttattatatgctggttctaatgagtgttttgttttgggcatctgtgagaggagtgtgtaagagtgtctagatttggtatagaagagcacaacttttttttttttcaatttttgtattaatgtgttcactatgaagtaataaatttcctttcattttcgtttattctgttttgattttggacaactttttgttaataagtgaagtatttcctttcgatttc

SEQ ID NO: 1359 - DNA, 639 bp, Lotus japonicus
ttcatttacattttgcatagcaagaagttcctgtttttgcaactttgaaaggaaaaagagttaattagacaactccagagaaaaaaaatgggcacagcaacatgcgtagacatcattcttgccatcatcctacctcctcttggagttttccttaggtttggatgcaaggtggagttctggatctgtttgctgctgacaattttaggttatatacctggaattatctatgctatctacgctatcaccaagtgatcaacctttatagcttcagtggagaatgaataaacgtcaagggtgtttctgtcttttggttctgatactggtgtttctctaaaattggttgctgagggtcaagactgatttttatccccacctcaccaaaaaaaaaataaaaattatgtaaatcattgtccattgtatttattatatgctggttctaatgagtgttttgttttgggcatctgtgagaggagtgtgtaagagtgtctagatttggtatagaagagcaccacttttttttttttcaatttttgtattaatgtgttcactatgaagtaataaatttcctttcattttcgtttattctgttttgattttggacactttttgttaataagtgaagtatttcctttcgatttc

SEQ ID NO: 1360 - DNA, 580 bp, Medicago truncatula
tatcaaccaacaactgtgtcttgtgttgtaaactaaattgttcttttgtaatactttctttctttcaaatttcaactcaaaatattgaaaatgggcacagctacatgcatcgatattattcttgccatcatccttccacctcttggtgtcttcctcaagtttggctgcaacgtcgagttttggatatgtttgattctcaccattttgggttatcttcctggaattatctatgctatctatgctatcactaagtgatccatcatcttccaatataaggtggatcatgaatagtttgtcaggggcgtcattctagtatttcaattcagatattggtttcatgtaaaattgttcagtcaaggacaatagttgattcttttttgtttttatctttcggtgtcaatattcctttttcttttcttttttagtcctgcgtggaaatgaaagaaatgaaagtgtgaagcttgtgaactctagaaatggttgtagatttgaactatagtagtagtccatctcggtaatcttgtttgtatatccttgactttaagatattcattaaatatttatgtgtatgttttgtttc

SEQ ID NO: 1361 - DNA, 661 bp, Medicago truncatula
attatggccagggatcaaccaacaactgtgtcttgtgttgtaaactaaattgttcttttgtaatactttctttctttcaaatttcaactcaaaatattgaaaatgggcacagctacatgcatcgatattattcttgccatcatccttccacctcttggtgtcttcctcaagtttggctgcaacgtcgagttttggatatgtttgattctcaccattttgggttatcttcctggaattatctatgctatctatgctatcactaagtgatccatcatcttccaatataaggtggatcatgaatagtttgtcaggggcgtcattctagtatttcaattcagatattggtttcatgtaaaattgttcagtcaaggacaatagttgattcttttttgtttttatctttcggtgtcaatattcctttttcttttcttttttagtcctgcgtggaaatgaaagaaatgaaagtgtgaagcttgtgaactctagaaatggttgtagatttgaactatagtagtagtccatctcggtaatcttgtttgtatatccttgactttaagatattcattaaatatttatgtgtatgttttgtttcacttctagaggactataattgatcctcgagatatataattaatgttgacatatttattgagttgaattg

SEQ ID NO: 1362 - DNA, 625 bp, Picea glauca
  misc_feature (616)..(616): n is a, c, g, or t
gcttaatttcaaggataaggattggactgggattggcggttgttctctggttttttgggggtgtatttacagatcttttcatctgaataataagattatatcgccatcatcattatgggcactgcaaactgcgtcgacatcttgctggctataattctgcctcctctcggagtctttctcaaattcggctgccatgccgaattctggatatgtctgctgttgactctgttagggtacttaccaggaataatatatgccatctatgctatcaccaagtgatattgtgaatgaacacaatttggtgccatgtgttactcctcgtcgcatacacagatttgaatttctttattcagttgtttgtaagtagattatatgaaccgatggatctgctactgttaaccagccctcggaggcgctcatgcgcttagtttgccttttcgtttttcttttcattgggaataaatgaatgatattttaatatttaaacattgataatgtgcagagtatgctctcacaatttttcttatggtcttttttaattcaattatatatatatatatatatatgtgtgttttttaaaatttgtcaataaatatactcatataattattaatantcgaaaaaa

SEQ ID NO: 1363 - DNA, 574 bp, Cryptomeria japonica
gaagctctctcaaaatttaactccttgtctgtgtaaaatcttcgagcttttatactgggttctacttttctgtttttctgtttttctgtttgtgttgtggtattatcatcggagaataatcatgagggaaggcactgcgaactgcattgacatcattttggccatactgttgccgcccttgggagtctttttgaaattcggctgccatgtggagttctggatttgcttgcttctcacgattctgggatacttgccaggaattatttatgccatttataccatcaccaaaacaccctagttctaatgcttttttgtggtgtgaatatttttagggtttggtattcgtttagggtttgagaactggtttattagagcagaataatgaagggttttcagcagtggttttattggacgcggctgtagccgaacactttgatatgtaataattattatcctcaatttgattgtccaagtgcctttaactgtgacaatctttgtgttaactggttcttttgtgaacaaaattgccaagaatatgtagttgttagatcattcgagaaataaactaatttat

SEQ ID NO: 1364 - DNA, 541 bp, Cryptomeria japonica
gctgcagggaaagttcagtccatttctttgtaaaatcttgtttgttttgctctgttctctgtttgtgctgtggttttgttaccagagaaatcatgagggaaggcactgcaaattgcgttgacatcgttttggccataattttgcctcccttgggagtcttcttgaaatttggctgcaatgtggagttctggatatgcttgctgctcacaattctgggctacttgccaggaattatttatgccatctatgccatcaccaaaacaccctagcttttatgctattttgggtgaaagttttcttagggttgggtatttgtttagggtttgggagctgcattattgtacaaaattagttaagggtttttttgggtgaaagttttctcagggttcggtatttgtttagggtttgggagctgcactattgtacaagattagttaagggttttcagcagtagttttatttgaggccgctgcagccattttgaaatgtaatttatcatcctcaatttatagaatatgtaggattctgtgttcgtgtaaaa

SEQ ID NO: 1365 - DNA, 635 bp, Picea glauca
ccccccccccccccccgaccatcacctcttaatttcaaggataagaattgggattggcagtggttctgtggtttgttagggcgtgttgatattttctaatctgaataataagctttcacagcagaagtatcatcatcatgagggagggcactgcaaactgtgtagatatcttgttggccataattcttcctcctttgggagtctttctcaaatttggctgccatgctgaattctggatatgtctgctgctgactctgctgggttacttaccaggaataatatatgccatttatgctatcaccaaaggagaccgtgaatggacataatttcttttgttgggagtttggtgccatgcaaatctcctcctgtactgagaattgaattttgtttatttagttgtttgtcagtagattataggaatcaatggatctgctcttgttaagcagcccagggagcgccttaagctccaagtttgtttgttttgtttattttctcataaataaacgataatatagaattgagatttatgctacaggcttagaaatataagctctcattaaagtttttgttctttccatgtgatacaaaattctcaaaaaattaataagcagactatttttctcctgcctaaaaaa

SEQ ID NO: 1366 - DNA, 471 bp, Picea glauca
gagcttctgtttgcttttcctgaatgcccctttgacgaagctttgggatctaacgaccgtcgtatacttctctctgcgtatatcgcaataatggcagcaaactgtttggacatcttgttggccataattctgcctcctctgggcgtatttctcaaattcggttgcaatgctgagttctggatttgtctgttgctgacgatcctggggtacatacctggaattatatacgccgtctacgccatcaccaagtgaggcaattctttatttcagaagtgggatttgattttgcagctatcgtgatttcggtgacatcgtgttatggatttttttcttatagcgtaatattgtaatacactctctcatgggctctacagtttgtgattgagcacttctctgtctcatatatgtgcatttaattcattttctataaataagaaataaacgtttcgatattgtttaccttttaaaaaa

SEQ ID NO: 1367 - DNA, 632 bp, Citrus sinensis
gcggggacataacacaaaggcagttactcaaattgaaaaaacacacattcctttaaaatcttcaatcaaagtttcttgcttttgactctttaaatttcacttgatttttttttttttgtaagaatcaatcaaagatggcagatgaaggcacagcaacatgcattgatattatcttggctatcattttgcctcctctcggtgtctttctcaaatttggctgcaaggttgagttttggatctgtttgctgttgacaattttcgggtatatccctggaattatttatgctgtttatgccatcaccaagaattgatctctctcttcttattctatggagagatctgaggggcagtatgtgtttatgagatttttatttacaaccatttgatggacagttctgatttgatgtagccagatggattatgattcttcttttaagtgttgtgtgtgcgcgtgtgtgagagagtgagtgagtgaagtgttcctttgttgatctttaattttttccgccctttttgtatgatttgtcccttttatgaactttagttcattattttaatgtaaattccgcgacagaaaatttttcttgggctaaaaattttatatatctatatatctgtcactaattcatatt

SEQ ID NO: 1368 - DNA, 611 bp, Citrus sinensis
gcggggacataacacaaaggcagttactcaaattgaaaaaacacatatgcctttaaaatcttcaatcaaagtttcttgcttttgactctttaaatttcacttgattttttttttttttgtaagaatcaatcaaagatggcagatgaaggcacagcaacatgcattgatattatcttggctatcattttgcctcctctcggtgtctttctcaaatttggctgcaaggttgagttttggatctgtttgctgttgacaattttcgggtatatccctggaattatttatgctgtttatgccatcaccaagaattgatctctctcttcttattctatggagagatctgaggggcagtatgtgtttatgagatttttatttacaaccatttgatggacagttctgatttgatgtagccagatggattatgattcttctttaagtgttgtgtgtgcgcgtgtgtgtgaagtgttcctttgttgatctttaattttttccgccctttttgtatgatttgtcccttttatgaactttagttcattattttaatgtaaattccgccacagaaaatttttcttgggctaaaaattttatatatctatatatctgtcactaat

SEQ ID NO: 1369 - DNA, 662 bp, Zea mays
  misc_feature (607)..(607): n is a, c, g, or t
aaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcattcgctgctatactcctactcgtcttttcagtatgcagaactttattacttttccgttcgcccgtgctaaccaaccaaattatatgacattaataatatatagcgcataagaaataaacctcgacctaacactaacacgtcttacgatttagaacagnttcgttgtagtagtaattagtataaatttcagtttcagctttcagccgccaacgt

SEQ ID NO: 1370 - DNA, 775 bp, Zea mays
cgcagcgtgaaagaaagaattggatgctgctgcttagcagcgaaggaagcgggcaggaaggccgtgtggggtccacacctccccggacacccgcgcagccgccgcccacgcttggtccgtcgaccgccggccgatcgattgatggatgcatgcatccaccgtccacgtacgcggcgacgagacgtgttgcgtttgcgtgccaccggactagctagtagatcgctcgactggtatgtagctgtcgccatcccatcgccctccctctcgtccaaggtctgcctgcctataaagtgaaagtgaagccagggaagaggcaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcattcgctgctgt

SEQ ID NO: 1371 - DNA, 522 bp, Musa acuminata
  misc_feature (11)..(11): n is a, c, g, or t
ggatcctttgnacccgtttccctctttccttgggcttccacacacacctctagcatctctctctcgttgcttcaccagaacgtccgaggacggtcgacatacgtgatagatggcggacgagggcacggccaactgcatcgatatcctcctggccatcatcctccctccactgggtgtcttcctcaagttcggatgccaggtggagttctggatctgcctgctgttgacgttgttcgggtacctcccgggcatcatttatgctgtgtatgccatcaccaagtgaactcgtttctcctacttcagggattttagcgtctggtgttggagaaatgaggttggctgtgttgtctgcttcactctgctctgccactgatggtagttctgtggctttgttggttatttgtaccgtcagtgggccttcgattgttgtgtgactgtagtaattgattggtgtctgcgtggctgtagttgtagaaagacttgatcatcaataaatcaaggatcgcgtttagatttgctcct

SEQ ID NO: 1372 - DNA, 599 bp, Glycyrrhiza uralensis
gatcacatcgcacggttgtcttttagcagacttattgtaacgttccttttccaaaatcgagcagttgcaactttgaaccaaaaaggtaaagagagagagagagaatggcaagggaaggcacagctacctgtatcgacatcctcctcgccatcatcctccctccacttggtgtcttcctcaagtttggctgccacgtggagttctggatctgtttggtgctcaccctttttgggtatattcctggaatcatctatgctatctatgccatcaccaagtgatctaattgcccttaattaatttcgcttctgtggataatgaatagctgtatgtcaagggcgttcatgtctttcggttcagatatttattatttcgtgtatgattaatatcttatggacagaagtgattctttttcccctctttaatattccttttagctgtgtttttaacttctgtttttgtcctatatggaaatgtaagtgtggagcttgtggcctctagaaattgtaatcgaattgaatttgaaacatagtactccttggtccgtgttaaatcatcttgttcaagtgtgtcctagtcctagaccccaatgtattcattta

SEQ ID NO: 1373 - DNA, 495 bp, Salvia sclarea
tccacatcaaatagaaggaaattatttcgtttcatttgtgaaaaatggcagcagcaacttgtattgatattattgtggcaattattttgccccctcttggagtcttcctcaagttcggctgcaagcatgagttctggctatgtttgctgctgacccttctcggttatattcctgggatcatatatgctgtctacgccatcaccaagaactagtttttaccacggtgtgagatgcaaaggatagagcctcttgttggttgatgtgtgttgactgtgcgatttttctagagatgtctacagtctttactcatgaatgcttacaaaatattgtgtttgtgtttggacttttttttctatgtaaagtctcttgaattcttaggggatttcattttacatcatcgtaatattgtaatgttgtcgtgtagtggtttattttattgttttggtgttgtatcatttcatgcagctgtagataaaagtgactatttgttaaatt

SEQ ID NO: 1374 - DNA, 936 bp, Zea mays
ggggcgtcagatggggatgcatgcacagctcagcgcacccgatgctctctgcccacgcatcttggcaccccggacccccgcccgctccccgcctttataagcggcagcagccacggcaggtggagctcatcgcatccatccaccacgcaccccaccaacccatacccataccagaggctctctgattttacttctcagcggtagatcggctgagcgagcgagcgaggcacacggagctagctaaacagagcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcctcggctacctccccggcatcatctacgccgtctgggccatcaccaagtagccggccggagcagatgaaccacggtcccctgccagtgccaggcagctagctgtgactccgtcgcgtgcgttagcatgcaatgcaagcgcagggtggtctcgtggggggacgtggtgtgcgcgtgtcttgagatgtgattccttccttctttgtttagttgctgctgctcctgctggtgtagtactggtgtatccagtccttttaatttcttgattagtttgctcggctgaagaaatcaggacgcgtgcctggtgtcgctcctcagctccatgtacttgtacaaccgttcctccctgcagctgctgccccttctctcttttttgtttaccttgggttgatgggttgttaaattcgttgtttgtctcttttttaaccttcgcgattgtagtactgggttggttgcttgcttggttggtttcggttgggagatcgatgggaataagtctatgatatatatcagtacaacaaaagagagaaagaaattgccgccgtcat

SEQ ID NO: 1375 - DNA, 870 bp, Pennisetum glaucum
agtacgcggggagctcagctcagctcatcggcatcgcactcaacaacctcatctcgctctcgctctcgctctcgtctcggcgcctctgatattttctccctctcgctgtccgcggcgtcgtcagccttctttcttcccttggtcgggagactcctgaaggagtgagagagagaagatgtcggacggcacggcgaactgcatcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagaggggcggcctagctagctcttcgaggtggtgatgatggggccgggccttccgtaactgtggtatcctgctcctcctcgtcgtcgtcctggtgtgatcgatcgatctgcagtcagtgtggtcgtcgtttttaatttgagatgtgatgatttcttcttctagtttctcttgatttccctcccttttggctggtggacgcacgcacgcacatatggtgagcaccgtgctgggcgtgctgcacatcagcctggtgctggtgctcagctccctcttcttccacgaccgcttcccgctgctgctgctctactcatccctctccctcggatacgggctgcacctcctccattgtatcgtccggttcctctgcacatttccgtccttgtactctctgattgattaattaattcgtcccttgcttcttcagtggaaatgatgatcaaatctctctgtctgtgtcgactgcttgatatttttcccttccgttttcaatttcttctttcttctttctttgtttgtttgcactca

SEQ ID NO: 1376 - DNA, 723 bp, Pennisetum glaucum
  misc_feature (562)..(563): n is a, c, g, or t
  misc_feature (588)..(588): n is a, c, g, or t
  misc_feature (593)..(593): n is a, c, g, or t
  misc_feature (624)..(625): n is a, c, g, or t
  misc_feature (646)..(649): n is a, c, g, or t
  misc_feature (656)..(656): n is a, c, g, or t
  misc_feature (672)..(672): n is a, c, g, or t
  misc_feature (697)..(697): n is a, c, g, or t
tcatctcgctctcgctctcgctctcgtctcggcgcctctgatattttctccctctcgctgtccgcggcgtcgtcagccttctttcttcccttggtcgggagactcctgaaggagtgagagagagaagatgtcggacggcacggcgaactgcatcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagaggggcggcctagctagctcttcgaggtggtgatgatggggccgggccttccgtaactgtggtatcctgctcctcctcgtcgtcgtcctggtgtgatcgatcgatctgcagtcagtgtggtcgtcgtttttaatttgagatgtgatgatttcttcttctagtttctcttgatttccctcccttttggctggtggacgcacgcacgcacatatggtgagcaccgtgctgggcgtgctgcacatcagcctggtgctggtgctcagnncctcttcttccacgaccgttcccgntgtgntgtctactcgtcctctccctcggataggggnngacctcctccattgtcgccgnnnncctctgngcatttcgccttgtantctctgattggattgatttattcgnccttgcttcttcagtgggaaaaaaaa

SEQ ID NO: 1377 - DNA, 514 bp, Triticum aestivum
ggaagaatccgatccatccaactatccaagccaagcaaaagcaggactacagggaggatcatcggccggagtactgcgtccgtccatcgatcgagtttcaccgaagctagcaaagcagatcgagaaggcaggcagccatgtcggaggggacggccaactgcgtggacatcctgatcgccatcatcctgccaccgctgggtgtgttcctcaagtttgggtgcgggcaccagttctggatctgcctcctcctcaccttcctcggctacctccccggcatcatctacgccgtctacgccatcaccaagtagtcgtcgtcgtcgttgatgctgctgctgtttgttgatgttcctgcttgctcttgccgatcgatgaatatatgccgattttaatacctagtagctagtggtatgtagcatcgatgtacttttcttaattgtatctttatatgttcatatgccccgttccaacggatttgtgtgtcagtgtgtgataaacggttattaagctggtacta

SEQ ID NO: 1378 - DNA, 813 bp, Mimulus guttatus
atgctcaacaccgactttggagaagggatcgcccgccgcacttcctccggccgttacgtcagctactcacacgacgacctggacagcgaactcggcagcaacgacttcctcaactacactgtccagatgccgcccacacctgacaaccagcccaacaacaacaccaccggcaacaaccccggctccgcccaaaaagtggaggagcagttcgtctccaactccctcttcaccggcggcttcaacagcatcacccgcgcccacctcatggacaaagtcatcgactcctcctccgacgccaattcccaccaccccctaatgggcgccgccgccgccaagggctcgtcaaataattcaaagggaaaaatgggtgctgcaacttgtattgatattattttggctattattttgcctcctcttggtgtctttctcaagtttggctgcaagttggaattctggatctgtttgctgctgacaatatttggttatctccctggaatcatatatgctatctacgccatcaccaaggattaatcctttccatggtaaaaatgcaaagggacatacataaagtttattcctctagtggtgattgatttgatttggcgcctttaatttcttattttgattcttcttctcccctcttttggctttttataaacaggatattttattttattttattttatttgtatcaagtgatttattttagcatgtcctggtttgctgattgtctattattgctacgtacttttaagtaatgtaatgtaattatggtgaccttgatttgattattgtataatatatatttttctg

SEQ ID NO: 1379 - DNA, 658 bp, Tropaeolum majus
atcacaaaaatcaaagtactgtttgtttcgttaaaaaaaatagcattttaagcagaagctaaaaaatagcttttttttaattgtaattagagaagaaagatggcaagtgaaggcacactaaacgtgtatagacatccttttggcaatcatcttgcctcctcttggtgttttcctcaaatttggatgccaggtggagttttggatctgtttggtgcttacactttttggttacatccctggaattatatatgctatctatgccatcactaagtgatcatcatcacaatgtggaaaggataagtataaagttatgaaacaaattgaaggacagatctgatttggtgtttttagtttaagttcattgattctttgtcagtgtgttataaagtctttttctttctttttgttattttttttttccttctagatggaccactttatgtttctgtctttatttttatttttcagtgtcgatattaatagtttggttttttattttttttaaaagtaatgtttgttgaattaatggagctttcttttctctttgtatctttttagtgttctgttttttgagattgatttatgtggccatccaaatcacaagtcttatgttatattattcaatccaacaaagttaattttaaaaagcataattatg

SEQ ID NO: 1380 - DNA, 450 bp, Lactuca sativa
  misc_feature (438)..(438): n is a, c, g, or t
gccggggaattttcaaatatcactaccattcccatccacatccaaatccaaatacaaaacggaatcggtgtccaaatcgaaagagaaacactgcgaagatgggaggtacagcaacctgcatagacataatcctcgcaatcatccttcctcccctcggtgtcttcttcaagttcggatgcaaggtggagttttggatatgtgtgttgttgactttgtttggatggatccctgggattatttacgcaatttatgccatcaccaagtgattcttatggtgggtgggatcgcatatcttttatatggatagaacatcgattttcatgtcagttcttgttttatgtttggattgtttttggttttgaattgatgtattgtaaattcttttttaatgttgtgttggttgaagtattttgtttgaatatagttgatgtgtcgtgnttgactcgttaa

SEQ ID NO: 1381 - DNA, 600 bp, Arachis hypogaea
gaatccccatttccctcacaacaatacacgtttgacacttcactaattgttactagaaccattattccatactccatagtgtgcaattcaattttaacacaaaacaaaaatggcggatgaaggcacaggcacggccacatgcattgacatcctccttgccatcattcttcctccacttggagtcttcctcaagtttggttgcaaggcggaattctggatctgtttgttgctgactattttgggttatttacctggaattatctatgctgtctatgctatcaccaaaaagaataagtgatcaccaccatgctttggtgggcctaggacatgctgtcgtgtcttttcttcctttacaacagtttcatatttagtgggaaaaatatatattcattttccccatttagtgtttcatactttcattgtaattccattttcttatgtttttgatgttcctctgttattagtacgtgtgagtggagtgtgcagcttttagtttatagattttgtaccatatgtaatcaagaattgaaatacaggacttgtacatgtattctgtaataatagcttgatttattcttatagttatattcttatttattg

SEQ ID NO: 1382 - DNA, 757 bp, Picea glauca
tctttacttctataagtaccttggcagacacagattcctaatactgatactgatcctgatcttgattttcctgattgcttgtttggtggagttcatatacttgctttctttgcttcctgtgttgggtctctgttcagttttcttcaccagtaatcatcatatcagtcaaaatgaaggagggcactgcaaactgcgtcgacattatattggcaataattctgcctcctttgggagtctttctcaaattcggctgccatgctgagttctggatatgtctgctgctgacgatattggggtacctgccggggattgtatacgccatctacgccatcacccaggacaatacgcgatcatccagggctgcggtctgatttagcaacttcctgttactggtgttcttcactgttaaccataggttataatttaatctttatatacacagtacacttgtgacatgactgagtgcacttactaagtgaacagttctctgtcacatatatgtttattggcttcattttctatagacaatgaattaagcttttcactatcctgtagtatactgaattctctgtgtcaatatgttttccattggcatattccccattgatggttatgaaaatgggaaagataaaaatttggtaaatcacatcttagtctctccttccttgattgagactttgtgatttgagtgtttgtaattttataatgataaagtttataatatcataatttggttgtgatccaacttggcaaaaaa

SEQ ID NO: 1383 - DNA, 584 bp, Picea glauca
tcccccccccccccttggtctttacttctataagtaccttggcagacacagattcctaatactgatactgatcctgatcttgattttcctgattgcttttttggtggagttcatatacttgctttctttgcttcctgtgttgggtctctgttcagttttcttcaccagtaatcatcatatcagtcaaaatgagggagggcactgcaaactgcgtcgacattatattggcaataattctgcctcctgtgggagtctttctcaaattcggctgccatgctgagttctggatatgtctgctgctgacgatattggggtacctgccggggattgtatacgccatctacgccatcaccaaggacaatccatgatttttctgggatgtgcctgttgctggggctgtggtctgatttagcaacttcctgttaatgagtgttcttcactgttaaccataggttataatttaatctttatatacacagtacacttgtgacatgactgagtgcacttactaagtgaacagttctctgtcacatatatgtttattggcttcattttctatagacaatgaattaagcttttcacta

SEQ ID NO: 1384 - DNA, 408 bp, Triticum aestivum
atcgagaaggcggcggcagcagcagcagcagcagagaagccatgtcggcgaactgcgtggacatcctgatcgccatcatcctgccaccgctgggtgtgttcctcaagtttgggtgcgggcaccagttctggatctgcctcctcctcaccttcctcggctacctccccggcatcatctacgccgtctacgccatcaccaagtagtcgtcgtcgtcgtcgctgctgctgctgtttgttgatgttcctgcttgctcttgccgatcgatgaatatatgccgattctaatacctagtagctagtggtatgtagcatcgatgtactcttcttaattgtatctctatatgttcatatgccccgttccaacggatttgtgtgtcagtgtgtgataaacagttattaagctgctact

SEQ ID NO: 1385 - DNA, 544 bp, Cichorium intybus
cgccaaattaaaatgggggagggttagggctcacttcaatttaggggcaaccccccagggcctttaacaactttaaaggctttccgggcttcgtaagtttgcgaaaacgaaatccaaatcgaaatcgaaaaagaaagagatcgaagatgggaggtacagcaacctgcatagacataacctcgcgatcatccttcctccacttggtgtgttcttcaagttcggatgccaggttgagttttggatttgcgtgttattgactttgcttggatggattcctgggattatttacgcgatttacgccatcaccaagtgattcttatggtgggtgggctcgcatcggttgatagcggataaatatcgatacccatgttacttttcgttttctattttcgttttttagtgtcgaattgatgtatcggttggttctagtattttgtttgaatatagttgtgtgatgtgatttaatcgttaatgtaaattacgatcttatgttatttactatttagcgtgatttttatgctactcgttcgatcttaattggctt

SEQ ID NO: 1386 - DNA, 717 bp, Cicer arietinum
tactcgggatctcatcgcatcacactctgtctttaagtttatcatcatattcatacctaacaacactgtgtaaactagtggtcattagaacactttgtctttttctctaattaaaatgggtacagcaacctgcgtcgatatcattcttgctatcatccttcctcctcttggtgtcttcctcaagtttggctgcaacgttgagttctggatctgtttgatacttaccattttaggctatcttcctggaattatatatgccatctatgctataactaagtgatcatcagctatgtactcctcaatttatcttttgtgtatcatgaatagttttcaagggcgttcaattcagaacaaaagtgattcttttttttatctcttttagtgtcaatattctatttcctttttgctctgtttttaacttcagtttttgtcctgtgtgaagcttgtgatgtaaactctattattactccgtctcaataatcttgttcatgtgtcattgactttaaatatattcacttcaatattcattgttaaatctgagatcgcttctatttggatattatttatctatttaaaagaaaaaattatttctctataatacagcaaataatatataaaaaccaaaaaagtcctctgcgttgaaaccactgcttattcactattgaatttcccggccgcctgtaagtcgaaccatatgggaaaactcccaatcgcgtt

SEQ ID NO: 1387 - DNA, 495 bp, Musa acuminata
  misc_feature (328)..(328): n is a, c, g, or t
gggcattggactctatataatccatagctccttgttgagctctctccatcatctctctttcttcagaaaaagaagaggagaaggttagctcgagaggtctaacatggggacagccacttgcatagatatactggtggccatcatccttcctcctcttggagtcttcctcaagtttggctgcaaggtggagttttggctgtgcctgttgctgacgatcctcggctacatccccgggatcatctatgccatctatgccatcaccaaataattcatttctctacatgaaaacaagaagaatcaggggattggtagtggagatggtgctgcnacttgggctcttcttctttcttctgtaatatatgatctgtgcactattgttgtgttcttcttgagagttcttattgagagtcttcttgtctgttgattgttgcacattagtggtgtaattgtttgtcgacaataaagcaacagctgcatctgtgcctttatgcattc

SEQ ID NO: 1388 - DNA, 653 bp, Populus trichocarpa
aaaaaagaagtggatatctagacgtaattaggagtacgcgtgtagacgacgtggaagttattgtagggggagtggctttggttctctatatatatataaccagcaacaacagcccttgagagaattactacgccaacagagaaggaagcagctgatcctgaagagcaattcgctagcctgttaaagttaattaattagcagttagttaattaattaattagtcaagaagatgtcaagtactaacttcatagacatcttgctggccatcatcttgcctcctctcggtgtcttcctcaagtttggttgcggggcggagttttggatctgcttgctgcttaccattttagggtacatccctggaatcatttatgccgtctatatcattaccaagtgatcgatatcaccctcttcttcatgatctcttgttgtggagagacgcagtaccgtttgatccaataaaaaagttcctggtcgtctgattcaatgaagagctcctgattttgtatggagttggatgattatacacactcccttttcataattgttttttctttttaatgtattaattgatattttgtaaaggaggttagcagcccttattgctgagtgccttatcatgcgtgcatggtctggttaataagcaagtctctttc

SEQ ID NO: 1389 - DNA, 654 bp, Populus trichocarpa
aaaaaagaagtggatatctagacgtaattaggagtacgcgtgtagacgacgtggaagttattgtagggggagtggctttggttctctatatatatataaccagcaacaacagcccttgagagaattactacgcgaacagagaaggaagcagctgatcctgaagagcaattagctagcctgttaaagagaattaattagcagttaattaattaattaattaatcaagaagatgtcaagtactaacttcatagacatcttgctggccatcatcttgcctcctctcggtgtcttcctcaagtttggttgcggggcggagttttggatctgcttgctgcttaccattttagggtacatccctggaatcatttatgccgtctatatcattaccaagtgatcgatatcaccctcttcttcatgatctcttgctgtggagagacgcagtaccgtttgatccaataaaaaagttcctggtcgtctgattcaatgaagagctcctgattttgtatggagttggatgattatacacactcccttttcataattgttttttctttttaatgtattaattgatattttgtaaaggaggttagcagcccttattgctgagtgctcttatcatgcatgcatggtctggttaataagcaagtctctttc

SEQ ID NO: 1390 - DNA, 425 bp, Populus trichocarpa
tcgacttaatttatctcacagagaagaaaagcaatacattatttttcaggagagtactttagtagagaattaataagaagatcatggcaggggcagttaaatgcatagacatcttgatagccatcatcttgcctcctcttggtgtcttcctcaggtttggctgcggggtggagttttggatctgcttgctcctcaccatcttaggctacatccctggaattatttatgctgtctacgccatcaccaagtgaagatccttgatctcgccatcttaatatctctgttgcgagcacctgcaccgcacccccaaaagctgtttctttctctctgttcctgtaaaggattgtaaagtatttgcgaaaataaaggatatatattatatattatgacggttaatttttttaaaataaatttaatttgttgaa

SEQ ID NO: 1391 - DNA, 422 bp, Populus trichocarpa
tcgacttaatttacctcacagagaagaaaagcaatatctttttcaggagagtagtttagtagagaattagtaagaagatggcaggggcagttaaatgcatagacatcttgatagccatcatcttgcctcctcttggtgtcttcctcaggtttggctgcggggtggagttttggatctgcttgcttctcaccatcttaggctacatccctggaattatttatgctgtctacgccatcaccaagtgaagatccttctcaccgtcttaatatctctgttgcgagcacctgcaccgcacccccaaaagctgtttctttctctttgtttctataaatttaaagggttgtaaagtatctgcgaaaataaaggatatatattatatattatgacggttaatttttttaaaataaatttaatttgttgaa

SEQ ID NO: 1392 - DNA, 476 bp, Lactuca sativa
gcggggaaatatcactaccattcccatccacatccaaatccaaatacaaaacggaatcggtgtccaaatcgaaagagaaacactgcgaagatgggaggtacagcaacctgcatagacataatcctcgcaatcatccttcctcccctcggtgtcttcttcaagttcggatgcaaggtggagttttggatatgtgtgttgttgactttgtttggatggatccctgggattatttacgcaatttatgccatcaccaagtgattcttatggtgggtgggatcgcatatcttttatatggatagaacatcgattttcatgtcagttcttgttttatgtttggattgtttttggttttgaattgatgtattgtaaattcttttttaatgttgtgttggttgaagtattttgtttgactattgatgtgtcgtgatggactcgtcaatgaaaattaaattatattaaataagatacatgttaac

SEQ ID NO: 1393 - DNA, 626 bp, Cucumis sativus
tctctctctctctctctctctttgtttgttttgtgtaaatcagaagaagaagaagaaagaaagaaagaaaaagaaaaatggcagacgaaggaacaacaaattgcatcgatatcctcctcgctattctcctccctcctcttggtgtctttctcaaatttggatgccaagttgagttttggatctgcttggtcttaactttctttggttacatccctggcattatttatgctgtttatgccatcaccaagtgatcatccaattcaaaggattgatgcaagaaattattggaactcatcatcatgcatggtctctcctcaccgacactctcccttccttttttctaatttctcttgatctctgttttgtgtgtgtttgcttgtgtgataatcatcatcccatccatcaaagacatctacacaattgttgcttctaatttcttttttctcttttgtaatttgtaattttgaattatttgggggtaatttaatcatgtgttgttcttggttgtattgattgaattggttgctgtaaatcagaaaaaaacaaaaaagaaggataaggacaaagtaagtttgttgaagaattggaatgtgttgagtgttgattacgtttctttctttctttct

SEQ ID NO: 1394 - DNA, 915 bp, Hordeum vulgare
tccgatccaacccccctgtctggcgctcgtgggagcatgagcatcatcaccgccgcacgagccgggcacgtaacgtaacctcgccaaccggcgccctcgccccgcgtggtgcctcgccgcctctctttataatcagcaggggcgtcgcaccaccgcatcatcactctactactccacctctagccgtctcgctctcctagtttcttccatcaacctcctctcctctcctctcctctcgcctcgggttctcccttcgactgcttcgagacaaggaaggaagatggcggacgaggggacggccaactgcatcgacatcatcctcgccatcatcctgccgccgctcggcgtcttcttcaagttcgcctgcgggatcgagttctggatctgcctgctgctcaccttcttcggctacctccccggcatcatctacgccgtctgggtcatcaccaagtagccgcccctgcctgcctgcttgtctctaggtgatccatggccaacttgttccgtttgtccgagacgcgagccaggtgatccatggtgctgcgtacgcgttgtgtgttcatgctgttgtacatctgtttgttgttcttgcttgatgattagactcctctcctcctgtcaccttccccagtgtatgtgtatccataatccatccagttgttcctctgtccattttcgtcgtccatgtactttgatgaattaattaattaatcaattgattggtggagaaaaattatttttatcttcttaatcaaaaacaaaaacaacaaccaatactataaagacccctataaaaaaaacctcgggggggggcccccctaacaccaattccccctcttagggggcccttttccccccctttttttttccctcccccctacaccccctccccccccccccccccccccccccccc

SEQ ID NO: 1395 - DNA, 796 bp, Hordeum vulgare
tccgatccaacccccctgtctggcgctcgtgggagcatgagcatcatcaccgccgcacgagccgggcacgtaacgtaacctcgccaaccggcgccctcgccccgcgtggtgcctcgccgtctctctttataatcagcaggggcgtcgcaccaccgcatcatcactctactactccacctctagccgtctcgctctcctagtttcttccatcaacctcctctcctctcctctcctctcgcctcgggttctcccttcgactgcttcgagacaaggaaggaagatggcggacgaggggacggccaactgcatcgacatcatcctcgccatcatcctgccgccgctcggcgtcttcttcaagttcgcctgcgggatcgagttctggatctgcctgctgctcaccttcttcggctacctccccggcatcatctacgccgtctgggtcatcaccaagtagccgcccctgcctgcctgcttgtctctaggtgatccatggccaacttgttccgtttgtccgagacgcgagccaggtgatccatggtgctgcgtacgcgttgtgtgttcatgctgttgtacatctgtttgttgttcttgcttgatgattagactcctctcctcctgtcaccttccccagtgtatgtgtatccataatccatccagttgttcctctgtccattttcgtcgtccatgtactttgatgaattaattaattaatcaattgattggtggagaaattttcccgttctagacaaaatataagtagcaaagatgatatcagtatacgaagttacaacgtgac

SEQ ID NO: 1396 - DNA, 535 bp, Hordeum vulgare
ccgtctcgctctcctagtttcttccatcaacctcctctgctgtcctctcctctcgcctagggttctcccttctactgcttcgagacaaggaaggaagatggcggacgaggggacggccaactgcatcgacatcatcctcgccatcatcctgccgccgctcggcgtcttcttcaagttcgcctgcgggatcgagttctggatctgcctgctgctcaccttcttcggctacctccccggcatcatctacgccgtctgggtcatcaccaagtagccgcccctgcctgcctgcttgtctctaggtgatccatggccaacttgttccgttggtccaagacgcaacccaggcgatccatggcgctgcgcacgcgttgtgtgcccatgctgaggaacacctgtccgttgcccttgctagatgatgagactcctctcctcctgtcggccttcccaagtgtatccatgcatcccgttgttcctctgcccattttgggcgtccatgtactcgggtgaatgagtaaataaataacttgaggggggg

SEQ ID NO: 1397 - DNA, 557 bp, Phaseolus coccineus
tagttggtcctattatggccgggggcattacgtcttcttcagcagtctgaacagtacaaaatttctgctttcttttgaaagaaaaagctcaaaagggtaagagaaaatggccgatggaagcacagctacctgcatcgatattctccttgccatcatcctccctcctctcggtgtttttctcaagcatggctgcaaggtagagttctggatctgtttgctgctcaccattcttggctacattcctggaattatctatgctgtctatgccatcaccaagtgaaactcatcatccaccttttctaagtggtccagtgatggagtttcaaaggaagagggttttgcatgtttctgaactctacagttaccgtttgatcttaggtggatggacgtgattcttttttgttgtctctgtttttaagttactgttgttgttttatgtggaaaccaaatgtcgacgttgtgtactctacttttaacgcttatccaatttaattcatattaattatcatcttctttttttatatgcattaatttattcaatcaattttattagtatt

SEQ ID NO: 1398 - DNA, 247 bp, Fagus grandifolia
ctctcttcctcttcctcttctctaaaagcctcttcaatttcctcttaattccaaacaagacaaaatggctagtgaaggcacagctaactgcatagatatcatcttggccatcattttgccacctcttggtgtctttctcaagtttggttgccaggtggagttttggatttgtttgttgctgacccttttcgggtatctccctgggattatttatgctgtctgggtcatcaccaagtgaacttgattt

SEQ ID NO: 1399 - DNA, 608 bp, Castanea mollissima
agtcattggatcagttacaaatatacacatatatataataactttccaattttcatttactcttctctctcccctcaaaaaccccttttagactcttcaattttcaacaccaccaaagaaaaagctacatacatacatagaaaatggctgatgaaggcacagctacctgcattgatatcctcttggccattattttgcctcctcttggggttttcctcaagtttggttgccagatcgagttttggatttgtttgttgctgacccttttcggctatctccctgggattatttatgctgtctatgccatcaccaagtgaacttcaatctttgtggaggtgtgacctgtgaacgccaatatgtctcttgtttttctgatttggggttcgtttatggccgttgatggacagttgattcttctttctgtgtgtcaaagtgtttaagattttcttttccctccttttttaatctgatgtaaaggtggaatattggttatgtgattaagactttgacgaatggtgggtaccattcgtcatgttagtgtttcttaaaacctattcttattttaatgtgatttgtgttctttttcaaccaatttgtctatggaggaa

SEQ ID NO: 1400 - DNA, 592 bp, Castanea mollissima
cagttacaaatatacacatatatataataactttctaattttcatttactcttctttctccctcaaaaaccccttttagactcttctattttcaacaccaccaaagaaaaagctacatacatagaaaatggctgatgaaggcacagctacctgcattgatatcctcttggccattattttgcctcctcttggggttttcctcaagtttggttgccagatcgagttttggatttgtttgttgctgacccttttcggctatctccctgggattatttatgctgtctatgccatcaccaagtgaacttcaatctttgtggaggtgtgacctgtgaacgccaatatgtcttttgtttttctgatttggggttcgtttatggccgttgatggacagttgattcgtctttctgtgtgtcaaagtgtttaagattttcttttcctttctttttcttttccctccttttttaatctgatgtaaaggtggaatattggttatgtgattaagacttcgacgaatggtgggtaccattcgtcatgttagtgtttcttaaaacctattcttattttaatgtgatttgtgttctttttcaaccaa

SEQ ID NO: 1401 - DNA, 578 bp, Eucalyptus gunnii
cggccgggggctgtcgcctgcaaatatccctcgaatctctctcttgccctcttccgttccctctcgatttctctgttttcttgtccattttctcaagctcgttcagaaagcgaatctgctccaccttcacttcggtaaagagagagaaaggaacaggaaaaatggcggacgagggcacgatgaactgcatcgacatcatcctcgccatcatcttgcctcctctcggagtcttcctcaagtttggttgccaggtggagttctggatctgtttggtgctcacgctctttggctggattcctggtatcatttatgccgtctatgccattaccaagtaactcaacttgattgagtggcaacacatgatgggctgatgcgtctccattcaacggtcgcgaatttcgtgggatctcatcttcttcttcttcttcttctttcgtcatagggatatcaacttcttctcttcgttttttttttcctgtaattgtcattagttgtccgtagcgtgatgatgatttgttgtattgttggattcatttcttatgtatgaaatggcgctctggatctgtcggcagattttc

SEQ ID NO: 1402 - DNA, 537 bp, Actinidia deliciosa
aattccccacgaggctcaatttgtgtgtgtttactctctctctctctctctctctctctctctgtttgagtttttttttgtagtgagacaaaaatgtcagacgagtccacagccaactgcatagacatcatcttggccatcatcctgcctccccttggtgtcttcctcaagtttggttgcaaggttgaattctggatctgtcttttgttgaccctttttgggtacatccctggaattatctatgctgtttatgccatcaccaagtgagatcaatgcttcaggtggagatttgttggtcacatggaaaagcatcaagatgctttgatggaaagtgttgattgggtgtattttattttatttttttattaaggtttggtgttgtgattggtctttgttagtacttgtttatagtcttgtcttaaaaagtcataaatttggattattgtattgtgtatgtatggatttgtgagttaaataaattgtaatatttgggtttcattttatttttattttgttactgattttataaaaaaaaaa

SEQ ID NO: 1403 - DNA, 697 bp, Quercus alba
gcgtggtcgcggccgaggtacgcggggaatcataaaacacacacaaaagtagtcattgggtcagttacaaattacatatagataataactttccaattttcatttactcttcttcccctcaaaaaccccttttagcctcttcaattttcaacaccaccaaagaaaaagctacatatacatacatacatacctagaaaatggctgatgaaggcacagctacttgcattgatatcctcttggccattattttgcctcctcttggtgttttcctcaagtttggttgccagatcgagttttggatttgtttgttgctgacccttttcggctatctccctgggattatttatgctgtctatgccatcaccaagtgaacttcaatctttgtggaggtgtgacatgtgaacggcaatatatgtcttttgtttttctgatttggggttcgttaatagccgttgatggacagttgattcttcattctgtgtgtcaaagtgtttaagattttcttttcctttttctttttcttttccctcttttgttttttaatctgatgtaaaggtgcaatattggttatgtgattaagactttgacgaatggtgggtaccattcgtcatgttagtgtttcttagaacctattcttattttaatgtgatttgtgttctttttcaaccaatttatctatggaggaatgatttttaag

SEQ ID NO: 1404 - DNA, 643 bp, Sorghum bicolor
gacgtgtcctcttgcttgctgctgcgtgttccactggtggtgatagagatggattctacgctgtctccctcccggtccgttctgtctatatataaagtgaagcacgaccaccagccagagccggtaccagggcaagcggaaggaggaaatcaggaagaatccgatccatccaactatccaagccaagcaaaagcaggactacagggaggatcatcggccggagtactgcgtccgtccatcgatcgagtttcaccgaagctagcaaagcagatcgagaaggcaggcagccatgtcggaggggacggccaactgcgtggacatcctgatcgccatcatcctgccaccgctgggtgtgttcctcaagtttgggtgcgggcaccagttctggatctgcctcctcctcaccttcctcggctacctccccggcatcatctacgccgtctacgccatcaccaagcagtagtagtcgtcgtcgacttgtgtgtgtcgctgtgtgatccatgcatgactagcattgcctaaatgcctaaattaagatataagttgagaatgtgtattattctagccaaacttccatgtaattaaaacagaatgtattgtgttgagacccatgaattaagcaagagtaagttattaatcctca

SEQ ID NO: 1405 - DNA, 492 bp, Sorghum bicolor
accagggcaagcggaaggaggaaatcaggaagaatccgatccatccaactatccaagccaagcaaaagcaggactacagggaggatcatcggccggagtactgcgtccgtccatcgatcgagtttcaccgaagctagcaaagcagatcgagaaggcaggcagccatgtcggaggggacggccaactgcgtggacatcctgatcgccatcatcctgccaccgctgggtgtgttcctcaagttcgggtgcgggcaccagttctggatctgcctcctcctcaccttcctcggctacctccccggcatcatctacgccgtctacgccatcaccaagcagtagtagtcgtcgtcgacttgtgtgtgtcgctgtgtgatccatgcatgactagcattgcctaaatgcctaaattaagatataagttgagaatgtgtattattctagccaaacttccatgtaattaaaacagaatgtattgtgttgagacccatgaatt

SEQ ID NO: 1406 - DNA, 570 bp, Glycine max
ggtcattatcgcatcactccgagcctcaacagcagcaaagcaaattcgcagttggtaagagaaaatggccgacgatagcacagctacatgcatcgatattattcttgccatcatccttccacctcttggtgtcttcctcaagtttggctgcaacgtagaattctggatctgtttggtgcttaccctttttggctacattcctggaattatctatgctgtctatgctatcaccaagtgatagatcatattcatcattttaattttgggtggacaatgaataatttgtcaaattaaaggacgacggctatgcatgttcctcatcaactccaatattgatattcctgtataatcctttgatctcagatggacaaatgtgattcttttttgttttctgtctatcggtctcaatattcctttttcattgttgtgtttttaattattgttattatttatcttgtgtggaaacaaaatgtagacattgttttgtggcctctagtcttagtattggtatcaaattgaaatgtactacttggttggtattaattatcttgttcagcttttttaattaaa

SEQ ID NO: 1407 - DNA, 447 bp, Saccharum officinarum
  misc_feature (12)..(12): n is a, c, g, or t
  misc_feature (88)..(88): n is a, c, g, or t
  misc_feature (94)..(94): n is a, c, g, or t
  misc_feature (159)..(159): n is a, c, g, or t
  misc_feature (244)..(244): n is a, c, g, or t
  misc_feature (274)..(274): n is a, c, g, or t
  misc_feature (276)..(279): n is a, c, g, or t
  misc_feature (282)..(283): n is a, c, g, or t
  misc_feature (291)..(291): n is a, c, g, or t
  misc_feature (296)..(296): n is a, c, g, or t
  misc_feature (298)..(298): n is a, c, g, or t
  misc_feature (301)..(301): n is a, c, g, or t
  misc_feature (303)..(304): n is a, c, g, or t
  misc_feature (319)..(319): n is a, c, g, or t
  misc_feature (349)..(349): n is a, c, g, or t
  misc_feature (353)..(353): n is a, c, g, or t
  misc_feature (355)..(356): n is a, c, g, or t
  misc_feature (359)..(359): n is a, c, g, or t
  misc_feature (363)..(363): n is a, c, g, or t
  misc_feature (370)..(370): n is a, c, g, or t
  misc_feature (374)..(374): n is a, c, g, or t
  misc_feature (417)..(417): n is a, c, g, or t
  misc_feature (421)..(421): n is a, c, g, or t
aagccaaggcanggcagagaaaagcttggcactgcacaggagaggaagaggatcggccgccggagtgcgatcaccgacaccgagcagnttgcanatcgagaagaaggcatggcggaggggacggccaactgcgtggacatcctgatcgccatcatcctncccccgctgggggtgttcctcaagttcgggtgcgggcaccagttctggatctgcctcctcctcaccttcctcggctacctccccngcatcatctacgccgtctacgccatcaccnannnntanngctacacnagcgntnctntnnttgctcagctcgccnatatgtatgcatggatgccgattccaatanctgntnntanatangtaccanctantgctctgctcttctatgattgtatctatgtgttcatatgccgngccnacttgtgtgtgatcgtccatgaatcg

SEQ ID NO: 1408 - DNA, 255 bp, Juglans hindsii x Juglans regia
  misc_feature (9)..(9): n is a, c, g, or t
  misc_feature (15)..(15): n is a, c, g, or t
  misc_feature (55)..(55): n is a, c, g, or t
  misc_feature (102)..(102): n is a, c, g, or t
  misc_feature (115)..(115): n is a, c, g, or t
  misc_feature (132)..(132): n is a, c, g, or t
  misc_feature (141)..(141): n is a, c, g, or t
  misc_feature (147)..(147): n is a, c, g, or t
  misc_feature (222)..(222): n is a, c, g, or t
ccctctctntttgtnccgttcacaaactcaaaaaggctcttcaactttcgcttcnagaaaaatatggcggacgaaggcacggctacttgcatagacatcctnctggcaatcatcntgcctcctcttggtgtntttctcaantttggntgccaggtggagttttggatctgtttgttactgaccatcttcggctatctccctgggattatttatgctgtctangccatcaccaagtagtgaactttattattttgt

SEQ ID NO: 1409 - DNA, 681 bp, Triticum aestivum
gtaattggaatgagtacaatctaaatcccttaacgaggatccattggagggcaagtctggtgccagcaccacatcactctactccacctacctgtctcgccctccttgttcacatcatctcccttggctttcccttcgacgcttcgagagagagggagagagagaaggaacgaggaagatggcggacgaggggacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcaggaggggctcctcacctctgcctctaggtgatccatgtcgaacttgttctgtgtctggtacaagccgtttgtccgagacgcgagccacggttcatggtgctgcctgcctacatgtgtgtgttcatgctgttgtacatctgtgttgttgtccgtgcttgatgattagcctcctctcctgtcaccttcccttctccagtgtagtgtatccatccatccacttgtgttgttcctccgcgcattttcgtcgtccatgtactttgaactttgattaattaattaatcaatcaattgattggtggggaagttttcagtaaaaaaaaaa

SEQ ID NO: 1410 - DNA, 615 bp, Triticum aestivum
ctctactccacctacctttctcgcgctccttgttcacatcatctcccttgccttggctttcccttcgacgcttcgagagagagagagagagagagagagagagagagagagaaggaaggaagaagatggcggacgaggggaccgccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcatgcaggaggggctcctctgcctctgccgctaggtgatccatggcgaacttgttctgtgtctggtacaagccgtttgtctgagatgcgagtcgcggttcatggtgctgcggtgcttcctacgtgtgtgttgatgctgttgtgcatctgtttcttgttcgtgcttgatgattagcctcctctctcgtcagttgtcaccttcccttctccagtgtatccatccagttgtgttgttcgtccgggcattttcgtcgtccatgtactttgaactttgattaattaattaatcaatcaattgattggtggagaaaa

SEQ ID NO: 1411 - DNA, 590 bp, Triticum aestivum
gctccactccacctacctgtctcgccctccttgttcacatcatccatctcccttggctttccgttggacgcttcgagagagagaaggaggaagaagaaagatggcggacgaggggacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcaggaggggctcctctgcctctgccgctaggtgatccatggcgaacttgttctgtgtctggcacaagccgtttgtctgagatgcgagctacagttcatggtgctgcctgcctacatgtgtgtgttcatgctgttgtacatctgtgtgtgttgtccgtgcttgatgattagcctcctctcctgtcaccctccccagtgtagtgcatccatccatccagttgttcctccgcgcattttcgtcgtccatgtactttgaactttgattaattaattaattaatcaatcaattgattggtggagaagttttccgtt

SEQ ID NO: 1412 - DNA, 517 bp, Linum usitatissimum
ggctgctaattagaaaacactcaacagatcaaaagagatctaatctcagccttgatcatcatcaatcaatatcgtcatgaaggagggcaccgctaattgcgtagacataatcctggcgatccttttgccgcctctgggtgtgttcctcaagttcggttgtcatgtagagttctggatctgtttgctcctcactatctttggctacctccctggcatcatctacgccatctacgccatcaccaagtgaagtcttcatcatcatctaattattattcttcttctttttgttgttgttgtttgtttgtgggtgtttgaagatgttaggtagctgcgtgtcagatccagatcatggcagctagctagccgactgtgttgactgatgttcatagcttacttgttccatttttcttctgtaatttaccattttttttaattattactacgcttttatttatatattaacgcccttttatttatattatcttttcttatgaaataaaatgatcaatgatgatcc

SEQ ID NO: 1413 - DNA, 439 bp, Rhizophora mangle
tccgcctcttctcttaaccctccttaatcagactttctattttttagaatatttttcttctgggaattccaattccgaacatcctttttcgtttgctctccatcttttttaattttcagcactttcaaggcagagatcttcaagaagagaagagaaaagaaaagaaagatggcagaaggtgcagcaacttgcatagatatcctcttggccatcctcttgcctcctctaggtgtcttcctcaagtatggctgcaaggtggaattttggatctgtttgctgctgaccatcctgggttatattcctgggattatttacgctgtctacgcaatcaccaagtgatcatacatcctctggagtaagtgcagacaagttaactttttgattgatggaaggttctgatttcgttgcataagtccagccagatggtatcattttccct

SEQ ID NO: 1414 - DNA, 455 bp, Salvia sclarea
gttgtaatctctatttgaaattgaaggaaattattttgttttatttattaaagaaaagaaggtgaaaaatgggggcagcaacttgtcttgatattattctggcaatcattttgcctcctcttggtgtcttcctcaagttcggatgcaagcatgagttctggatatgtttgctgctgaccctctttggttatatccctggaatcatatatgctatctacgtcatcaccaaggactaaattttgcgatggtgtgagatcaaatcaaaagggaactgcagccgttatccgtggatggctgcgaaatatcttgatttagaaaagtgttttgtctttggaattttctgtaaagttgttgaattcttattacattattcgtaatattttgtaatgtgtcgtgtagtggtttattttagtgttcttgcattgtcgcgttcgcagtgagtgacaggctagtag

SEQ ID NO: 1415 - DNA, 860 bp, Bruguiera gymnorhiza
gaccgtacagagaagtctgtgagtttctcttctcttattaaataaccaactcattgtcgtagttttacaattcgctcttcttgattagccttttgtttttttttgcctttttgggaattccaattccaaatccaaacacctttttccgtttgctctccatcgacctatcttatctaggtctctgtttaaattttcagcacttacaaagagaagagacaagatggcagaaggtgcagcaacctgcgtagatatcctcttggccatcatcttgcctcctcttggtgtcttcctcaagtttggctgcaaggtggaattttggatctgtttgcttctgacaatcctcggttatattcccgggattatttatgctgtctacgtcatcaccaagtgaacatacatcctctggagtggggacaagttaaccgtttgactgatggaaggttctgattttgtgcataagcccagccagatggatcatattccgttttcttcagcgtgcgtgattgtcctgttttcttctctttttttctttaatttgtatacagcattgcgttgattgtaaagatgggcgtaactgtgtgagtaaattaagaatatggtatgttcaattagatcggccgtgttattctgatagaagtacaaatttgtttcacatgtgaacgtgattcttgctgtagtgttatgttatgttatctatgattattattcctcactgcttttactgccgttgcctctgcatcttcgcttttcgtccgctgtcgccttactccctttagtgggaggtcattgtatccagagatggaaagattcatgggagagtgttgaccaaacacatctacgatagactgaaaaatatggtt

SEQ ID NO: 1416 - DNA, 627 bp, Catharanthus roseus
tagtggatccaaagaattcggcacgaggctttcttgcattcttcttcttcttcatctgctttacgagtgatcccaaaaaaaaaaaaaaaaagaagagaaaaatctttattggaattttttagaaagaaaaaatgtcagacggtacagcaacctgcttagacattctcttggccatcatcttgcctccccttggtgtcttccttaagtatggctgccagatggagttctggatctgcttgttgctgacaattttaggatatattcctggaattatctatgctgtttatgccatcaccaagtaaatcatctggtggagatatgttaaaatggtcataacaacttttcatttctggtgtttgaagaagcttatgaatgttattggattttagtagtttcgtgagacagtgctttgttgatatttatatttgtggttcttgaatgaatttcccatttttattttgttgtcagtcactcaaaattgttcgtcattttctggtgcctttgtagttctatttggatttgttgatttaggattggatgagtgtttgaatttgtcaccacttatcatcttttactcatcatcactcgtattaattgatttctttgtctcttcacaaaaaaaaaaaa

SEQ ID NO: 1417 - DNA, 680 bp, Cenchrus ciliaris
  misc_feature (196)..(196): n is a, c, g, or t
  misc_feature (223)..(223): n is a, c, g, or t
  misc_feature (229)..(229): n is a, c, g, or t
  misc_feature (280)..(280): n is a, c, g, or t
  misc_feature (311)..(311): n is a, c, g, or t
  misc_feature (509)..(509): n is a, c, g, or t
tcgcaacttgctcgctctcgtctcggttagctctgatattttctcctccactcgctgtccggcgtcgtcagcctttccttggtccggagactcccgaaggagagagagaagataaaggagagagaagatgtcggacggcaccgcgaactgcatcgacatcatcctcgccatcatcctcccgccgctcggcgttttnttcaagttcggctgcggggttgagttntggatntgcctcgtcctcacctttttcggctacctccccggcatcatttacgccgtntgggtcatcaccaagtagaagggcctagctnttggaggttatgacggggccgggcctctttgcgtgtggcatcctcctcctcgtcgtgcctgctggtgtgatcgatctgcagtagtcgtttgagatgtgatttctagtttctcttaatttccttttgggctggatggtgagcaccgtgttgggcgtgctgcacatctgcctggtgttggtgcttagctccctcttcttntacgaccgcttcccgctgctgctctactcgtccctttccctggggtacgggctgcacctcctccattgtatcgtccagttcctctgcacatttccgtcactgtactttgattgattaattaattcgtccgttgttcggtggaaattaaatctccgtctgtgttgactgcta

SEQ ID NO: 1418 - DNA, 633 bp, Pennisetum glaucum
gcacgaggcccagtaccagcagcagcgagaagtttagcagatcgagcacggcgctgaccaccaaacagcatcaagcaggagaaaggagaaggaggaagcagcagcagcagcagcagcgaggatgtccgaggggacggccaactgcgtggacatcctgatcgccatcatcctgccgccgctgggggtgttcctcaagcacgggtgcgggcacgagttctggatctgcctcgtcctcaccttcctcggctacctccccggcatcatctacgccgtctacgccatcaccaagtagtagctagccttcgttagttctctccatcgatgttcgatgatgagcgctccagctcctgcgcgtgtggtgtccatccatgtcgtctagtactctttgtttagtttaattccctctctcttgtgtctctgtgcgtgtgtttaccctcctttcctttgcttgttccgtcgtcttcgttgattccccagtacttctattattcactgttcatcatctcaacacatgtatgtatgtgtgtgctctcgttgatttgttaccatcaatcgacttgttctatttcccggctgatcgatgcatcgtcatcgttgcaattaatcaataaagattgttgagaaccttgtgct

SEQ ID NO: 1419 - DNA, 628 bp, Pennisetum glaucum
gcacgaggcccagtaccacagcagcgagaagtttagcagatcgagcacggcgctgaccaccaacagcatcaagcaggagaaaggagaaggaggaagcagcagcagcagcagcagcagcgaggatgtcagaggggacggccaactgcgtggacatcctgatcgccatcatcctgccgccgctgggggtgttcctcaagcacgggtgcgggcacgagttctggatctgcctcgtcctcaccttcctcggctacctccccggcatcatctacgccgtctacgccatcaccaagtagtagctagccttcgttagttctctccatcgatgttcgatgatgagcgctccagctcctgcgcgtgtggtgtccatccatgtcgtctagtactctttgtttagtttaattccctttctcttgtgtctctgtgcgtgtgtttaccctcctttgcttgttccgtcgtcttcgttgattccccagtacttctattattcactgttcatcatctcaacatgtatgtatgtgtgtgctctcgttgatttgtgaccatatatcaatcgacttgttctatttcccggctgatcgaaacatcgtgtcgttgcattaatcataaaatcgtgggaaaggggcccagc

SEQ ID NO: 1420 - DNA, 600 bp, Oryza sativa
acctgcatcgcatcagctctcttgactcctctctcttcgtctcagcttggagctcagtctttgatttttcttcttcttcttgtttgtgcaattgtgcatcgttgttagctgggaacaagcagaagaatggcggacagcacggcgacctgcatcgacatcatcctcgccatcatcctgccgccgctcggcgtcttcttcaagttcggctgcgggattgagttctggatctgcttgctgctcaccttcttcggctacctccccggcatcatctacgctgtctgggtcatcaccaagtaggaggagaattactacccttccaaggtgatggtgaattggtgatccggagcctgtgattggttgtgcctggtgtaagcggcagttgtcaaagctgtgattttctggttctttggacggatggtgctcgctgtggtgttgtgtatgctgtacatctgttttggtgtttgtgcttaggtccctcttctgttacaacaattgttttctccctgttcttccggggtaccttctccagtttatcttctgcaccttctcgtccctgtactttgaatattaattaattaattaattaattgctccttgtta

SEQ ID NO: 1421 - DNA, 1242 bp, Saccharum officinarum
gccgtgggagtccgaacaggatcggaccaggcgggcggcgaaccttgggatcggacgccgatgccgatgcagtgcccacgcacgcgctcttgggtcctggcgtcttggcaagctcgggccacgtgccgactgccgaccccggacccccgcccgctctcctccgtctttataagcccagccccagcggcggagcgagctcaggctctcagctcatcgcattcaccaccacacgcacccccaccttgcctgccttctttctgctctctgatattttcggtcgcgctcgctgtcgcccgccgtccgccgtcgatcgacggggtcctagcctgcagctgcagggctcgccacgaagagcgtttaaaaggtagccgcacgcacaagcaggtagcaagatgtcggacggcacggcgacctgcatcgacatcatcctcgccatcatcctgccgccgctcggggtcttcttcaagttcggctgcggggttgagttctggatctgcctcatcctcaccttcttcggctacctccccggcatcatctacgccgtctgggccatcaccaagtagccagccggagcacacggtccccttcttcaaggccggtgatctgatgatgggggacgtggtgcgcgtgactccatggcgcccgctgtgaaatatggtgtcggtcgatttgagatgttattccttctttctttgttattagttgccgctgctggtggtgtctccaatccctttcttttcttaattagtctgttcggctgaagaatctggacgcatggcgcgattcaccgcgttgggcgtgctgtacatgtccctggtgtagtccatgttcttctacgcctccctttccgtggggtgcggatgtgcctcctccgctgcgtcgtccagttcctctgcacattctcctccgtgtactacttcgattgatggatcattaattagttgtttgtttaaccagtttgtcttcttttaccttggattgtgttaattgttcggttacgtactactgtatcttcatcttcagatcagtagtgcttggtttctttgggttggcactgggagatgggaatcatgcatgtttccaccagcagccattactgttttgtttggggaggcggtttaaacggaacggcggtggaacggatcgcggaagggaagggcgaaaaaaacctgggccgattgtccgttaccagaaggccacacccagggagtgggggaccctgcttcgcttcaagaccctcgc

SEQ ID NO: 1422 - DNA, 1242 bp, Saccharum officinarum
  misc_feature (1007)..(1007): n is a, c, g, or t
  misc_feature (1115)..(1115): n is a, c, g, or t
gccgtgggagtccgaacaggatcggaccaggcgggcggcgaaccttgggatcggacgccgatgccgatgcagtgcccacgcacgcgctcttgggtcctggcgtcttggcaagctcgggccacgtgccgactgccgaccccggacccccgcccgctctcctccgtctttataagcccagccccagcggcggagcgagctcaggctctcagctcatcgcattcaccaccacacgcacccccacctcgcctgccttctttctgctctctgatattttcggtcgcgctcgctgtcgcccgccgtccgccgtcgatcgacggggtcctagcctgcagctgcagggctcgccacgaagagcgtttaaaaggtagccgcacgcacaagcaggtagcaagatgtcggacggcacggcgacctgcatcgacatcatcctcgccatcatcctgccgccgctcggggtcttcttcaagttcggctgcggggttgagttctggatctgcctcatcctcaccttcttcggctacctccccggcatcatctacgccgtctgggccatcaccaagtagccagccggagcacacggtccccttcttcaaggccggtgatctgatgatgggggacgtggtgcgcgtgactccatggcgcccgctgtgaaatatggtgtcggtcgatttgagatgttattccttctttctttgttattagttgccgctgctggtggtgtctccaatccctttcttttcttaattagtctgttcggctgaagaatctggacgcatggcgcgattcaccgcgttgggcgtgctgtacatgtccctggtgtagtccatgttcttctacgcctccctttccgtggggtgcggatgtgcctcctccgctgcgtcgtccagttcctctgcacattctcctccgtgtactacttcgattgatggatcattaattagttgtttgtttaaccagtttgtcttcttttaccttggattgtgttaattgttcggttacgtactacngtatcttcatcttcagatcagtagtgcttggtttctttgggttggcactgggagatgggaatcatgcatgtttccaccagcagccattactgttttgtttggggaggnggtttaaacggaacggcggtggaacggatcgcggaagggaagggcgaaaaaaacctgggccgattgtccgttaccagaaggccacacccagggagtgggggaccctgcttcgcttcaagaccctcgc

SEQ ID NO: 1423 - DNA, 716 bp, Saccharum officinarum
ctcaggctctcagctcatcgcattcaccaccacacgcacccccaccttgcctgccttctttctgccttcggccgtccgccgtcgatcgacggggtcctagcctgcagggctcgccacgaagagcgtttaaaaggtagccgcacgcacaagcaggtagcaagatgtcggacggcacggcgacctgcatcgacatcatcctcgccatcatcctgccgccgctcggggtcttcttcaagttcggctgcggggttgagttctggatctgcctcatcctcaccttcttcggctacctccccggcatcatctacgccgtctgggccatcaccaagtagccagccggagcacacggtcccctgccaggtgatctgatgatgggggacgtggtgcgcgtgactccgtggcgcccgctgtgaaatatggtgtcgatctgagatgtgattccttccttctttctttgttactgctggtgtcagtctccaatcccgctgaagaagaatctggacgcatggcgcgactcaccgcgttgggcgtgttgtgcatgtgcctggtgttgatactcagctccatgttcttctacaaccggttctccctgctggtggtctactcggccctctccggtgggtgcgggatgtgcctcctccggttggttatccaagtcctctggacaatctcctccatttaacttcgatggatggaaaataaataagttggttggt

SEQ ID NO: 1424 - DNA, 767 bp, Saccharum officinarum
  misc_feature (499)..(499): n is a, c, g, or t
  misc_feature (634)..(634): n is a, c, g, or t
  misc_feature (647)..(647): n is a, c, g, or t
  misc_feature (659)..(659): n is a, c, g, or t
  misc_feature (669)..(669): n is a, c, g, or t
cagctcatcgcattcaccaccacacgcacccccaccttgcctgccttctttctgctctctgatattttcggtcgcgctcgctgtcgcccgccgtccgccgtcgatcgacggggtcctagcctgcagggctcgccacgaagagcgtttaaaaggtagccgcacgcacaagcaggtagcaagatgtcggacggcacggcgacctgcatcgacatcatcctcgccatcatcctgccgccgctcggggtcttcttcaagttcggctgcggggttgagttctggatctgcctcatcctcaccttcttcggctacctccccggcatcatctacgccgtctgggccatcaccaagtagccagccggagcacacggtcccctgccaggtgatctgatgatgtgatgggggacgtggtgcgcgtgactccgtggcgcccgctgtgaaatatggtgtcgatcgatttgagatggtattccttctttctttgttagttgccgctggtggnggtgtctccaatccttttctattcttaattaagctgtcggctgaagaatctggacgcatggcgcgactcaccgcgttgggcgtgttgtgcatgtgcctggtgttgatactcagctccatgttcttctacaaccgnttctccctgctgntggtctactcgnccctctccgntgggtgcgggatgtgcctcctccggttggttatccaagtcctctggacaatctcctccatttaacttcgatggatggaaaataaataagttggttggt

SEQ ID NO: 1425 - DNA, 651 bp, Panicum virgatum
ctcagccgctacaacttgctcgctcgatctgggctctatctgatattttctcccctcttcctcctactcggcggccgagataaaagagatcgatcgagaagatgtcggacggcacggcgacctgcatcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagaagatcgacatcttcttcattcgaggtgataatgtgggacctcaagcgcgtgattattctggtgtaatctgctagctgcagctgtttgaaacgttgtaatttttttttcttctagtagtttctggttttccttgtttcttttgctttgggcgcggcgtacagtgcgcaccgtgctgggcgcgtcgtacgtcggcctggtgttattgctctgtatcgtccagttcctctgcacatttccgtccctgtactttgattaattaattgattcgtccttaatttcttcggtggaagaaaatcgaatcccctactggacccacactcactggactgtttgagtaatgacattaccaatttccccctttgtttttcaaagccggcc

SEQ ID NO: 1426 - DNA, 592 bp, Panicum virgatum
gatcgcacttactcaagctcagctacaattaacttgctcgcaagctcgcgatctcggctctgctattttctcccctcctcctactcgatcggcggcagagataaaagagatcgatcgagaagatgtcggacggcacggcgacctgcatcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagacgacatctccttcgaggtgataatgggacctcgtgcgcttgatattctggtgtaatctgctacagctgttttgagacgatgtaatttcttttttttctagcttctggtttttcttgttttttttttcctttgggcgcggccctgttcctggggtacgggctgcacctcctccactgtatcgtccggttcctctgcacatttccgtccctgtactttgattgattaattgtttcgtcctttcttcggtggaaaatccgatcccctggctacttgagcaatgacattatccgttttcccc

SEQ ID NO: 1427 - DNA, 602 bp, Panicum virgatum
gatcgcacttactcaagctcagctacaattaacttgctcgcaagctcgatctcggctctgctattttctcccgtcctcctactcgatcggcggcagagataaaagagattgttcgagaagatgtcagacggcacggcgacctgcatcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagacgacatctccttcgaggtgataatgggacctcgtgcgcttgatattctggtgtaatctgctacagctgttttgagacgatgtaatttctttttttttctagcttctggtttttcttgttttttttttcctttgggtgcggccctgttcctggggtacgggctgcacctcctccactgtatcgtccagttcctctgcacatttccgtccctgtactttgattaattaattgtttcgtcctttcttcggtggaaaatccgatcccctggctacttgagcaatgacattatccgttttccccctttgtttttc

SEQ ID NO: 1428 - DNA, 530 bp, Panicum virgatum
ggacacatgagccaagcagcagcctagggaagggaagaaagaaaagggatcgaccgaccggatcggagccgcacctcgcttcttgccgttcggatcggagcaccatgtcggagggcccggcgaactgcatcgacatcctcatcgccatcatcctccccccgctcggcgtcttcctcaagttcggctgcaagctcgagttctggatctgcctcctgctcaccttcctcggctacctcccggggatcatctacgctgtctacgccatcaccaaatagtagtatgaacaggacagaaacagttcagcccggaggaactggagcctgaagatgtgctgtgccgtttggagatttaccagttgtccaactaccaccgaccgagctttcctgttcgtgttatgtatgtacagtatatatgactgtatgtagcctgtgaaagtttcatccgaaaccgtagcaaaccgatttacgaaccccagtccatcttgtattcttgttgtttcagctgaaattgtagtagtatcgttctgcgag

SEQ ID NO: 1429 - DNA, 528 bp, Artemisia annua
ggggacaagaaaaacatcacaaatcattcaaatcctatttgaaattcagtacccaattctaaagaaaaaaaaaaaaaaaatgccttcagaaggtacattaaactgcatcgacatcatccttgcaatcatccttcctccacttggtgttttcttcaagtttggctgccatgtggagttttggatttgtgtgttgttgactttgttcggatggatccctgggattatctacgccatttatgccatcaccaagtgatcctacccacggtgggtgggctcgtttctggtgttatcggataaaagttgatagtgtgtcgtgctactacttctgggtccctatttgtgttttctagtttcgaattgacgtgtcagttaatatcttgttctttcgtaattcttttccttgctatgtcttcttgtcgacttgtgtatgttgtcaattaaaattttaatgtaaaatagattggattgatatcttttgtgctaagtatgcgactcttttacatttgctttttataattagtttacttg

SEQ ID NO: 1430 - DNA, 420 bp, Saccharum officinarum
tcacggctgctcaattggtcacaggctcacagctgttcagtaccgtggacgcataaatcgaccagtgggaagaaagaggagacacatccatcctccggggctccagagatcgactgatcgagcaagatgaaggagggcacggcgaactgcgtcgacatcctcatcgccatcatcctccccccactcggcgtcttcctcaagttcggctgcaaggtcgagttctggctctgcctcttgctcaccttcctcgcctatcttccggggatcatctacgcgatctacgccatcaccaaggactagcatggtaccagctgggtatcggacaaggtgagagctgatcaacatcccgtctgcaggaaccgcaccgcaggatgtaaaattctacgtacaagtgtcttttggagattgaatctcagctgt

SEQ ID NO: 1431 - DNA, 889 bp, Artemisia annua
  misc_feature (640)..(640): n is a, c, g, or t
atcacaaatcattcaaatcctatttgaaattcagtacccaattctaaataaaaaaaacatgccttcagaaggtacattaaactgcatcgacatcatccttgcaatcatccttcctccacttggtgttttcttcaagtttggctgccatgtggagttttggatttgtgtgttgttgactttgttcggatggatccctgggattatctacgccatttatgccatcaccaagtgatcctactacggtaaaaaaaaaattaacgtaattctatccgctaatataccaaatttgctttatgtcattttcgctttcctttatgatgatctatgatctacttttgattgagatgtttgcttttttatataaaaatttcttacccgtatgtcattgctttctagagacatctgcttttttcctttggttcattaaatggtctagtttcgtcaataaggtagcaattgtgtaaaactgaattgttcacaacaattatcttttaattaaccaaacaaaccaacttacctcttaatgctactcatagtagtgatcctcaacgatttttattttccatgtcaccttagctttctctcttgcgactttttttaagatacaataagacacctacactataaaaaatataccccncaaatatacattttaattaaattaaaacacacaacgaccaacactacatgaaggtcgagaccacgaccttggtctccaaaattgccctcagcgacctttacccaacgacaaggacgaccctcatcgaccttcacgacccgtcgagtaggtcgagtaccttattgtgagtagcctaaatatttgtagatttaaattttattttaggacatgtgaaagtgagattgtaagtttatgtttaaaaaagccggg

SEQ ID NO: 1432 - DNA, 545 bp, Festuca arundinacea
  misc_feature (20)..(21): n is a, c, g, or t
ggcacgaggcggcacgaggnntcaccacatccctttcctccttgctgtttcatctccccagcttggcctgtagatttcccttggagagaagagagaagatgtcggacgagggcacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtagagggctccccctccctgccatccacaggtgatggccatcctgttctgtgcgctggcggtataatctgttcgtttgagacggttcatggtgctggtctgcatgtctgtctgtgttcgtgttgtacatctgttctgtgtttgtgtgattagtttgctcctcttcccgcaccttctccactccagtgtaaccatcatcatcatccagttcatccgcttgtgtccccgtccctgtaatttcgattaattaatggattaatcaattgattggcggagg

SEQ ID NO: 1433 - DNA, 610 bp, Zea mays
aattgttgacagtagcgtggacgcatcgtcatcattcgagcagaggggagagagagagagagagagagagagatgaaggagggcacggcgaactgcatcgacatcctcatcgccatcatcctcccgcctctcggcgtcttcctcaagttcggctgcaaggtcgaattctggctctgcctcctgctcaccttcctcgcctatctccccgggatcatctacgcgatatacgttatcaccaaggactagccagctagcgccgtaaaccgggacaaggtgagagagctagctgatcagccagcggaggtaatggagatgaactgctgagatcacttgccctgctgctcaatgtttctggatggagactgaatctcagctgtgctgtgctgtgctgtgctgtgctgtgatgctgctatatactaccgattgatcctgaaatttgtcgcttttcgttcgtgtctgcatagtatgtgatgcatagtctgtaaaatttctctcagactcttgtgctatagtatgtgatgcatgcatgtgtttgcttgatgaatttggatgtacgtacctcaacgatcgacgaggcgctgcctgtaactcgtttcgtggtttttgggag

SEQ ID NO: 1434 - DNA, 864 bp, Zea mays
ctgtgtaagaatccaaccaactaaaacgactaatgtttttgacagcaacaggaaaaaaagaagaagaaaacaatacttaaacgctcggtgtcgcattgcatcatccgtcgttacgtttcccactaggagccctcgcccgcctgagctgtttctgcagagtcataaatcccagccacccactgtgtgcaccgatcagtcaaccagcgtgaacaaacaggagacgcatccagcctccagcagagggctccagagatcgagcaagatgaaggagggcacggcgaactgtgtggacatcctcatcgccatcatcctgcccccactcggcgtcttcctcaagttcggctgcaaggtcgagttctggctctgcctcttgctcaccttcctcgcctatcttccggggatcatctacgcgatctacgccatcaccaaggactagcgcggttccagttgggtgagagctgcaggctcctcctcttctcagctgtgaagctactactactagtctactaccgattggtgaacctgaacctgtcgcttcgttcgtgtccttcgatcgctctctggttatattggtcgtggatcttgttattaccgatttatttatcatacagtaacttgtaacatgtgctgttctgtatttattcagtggtccgcgtaaaatctgcctcaaacctgtgctatagtgtgatgcacgtgtctggaactcgtttcttggtggttggcgtgaaggttgagcgcttcagcacatgtcacagccggcggcctccagtattctacggctgctggcactagtggtagtaccatcagatcgcgtgctggttggtctgtctggttgaaatgcattgtgtcatgtccctgttatat

SEQ ID NO: 1435 - DNA, 448 bp, Pinus taeda
ttgatttcttttttggctgagttcatacactcactctctttgcttctctgtgttgggtctcttggtttctgttcacttttcttaaaaactggtcattatttcggtcataatgagggacggcactgcaaactgttgtgacatcttgttggccatacttctgcctcctctgggagtttttttcaaatacggctgccatgctgaattctggatatgtctgctgctcacgatattggggtatataccgggaattatatacgccatctacgccatcaccaagcaaaatccatgattttttgggggatgtggatgtaactggggctgcggtctgtgcaaccaaccagatttgattcagcaacaatcctgttctgcagtgttcttcattattgttattgaggtttcttcattgttaaccataggttgtaatttcatatctatatacacttggcac

SEQ ID NO: 1436 - DNA, 453 bp, Pinus taeda
ctttttgatttccttttttggctgagttcatacactcactctctttgcttctctgtgttgggtctcttggtttctgttcacttttcttaaaaactggtcattatttcggtcataatgagggacggcactgcaaactgttgtgacatcttgttggccatacttctgcctcctctgggagtttttttcaaatacggctgccatgctgaattctggatatgtctgctgctcacgatattggggtatataccgggaattatatacgccatctacgccatcaccaagcaaaatccatgattttttgggggatgtggatgtaactggggctgcggtctgtgcaaccaaccagatttgattcagcaacaatcctgttctgcagtgttcttcattattgttattgaggtttcttcattgttaaccataggttgtaatttcatatctatatacacttggcac

SEQ ID NO: 1437 - DNA, 2023 bp, Oryza sativa
atcgatatatctttatttcgagctacttttgactttccatccgatttgccgaatcgctcggggtcacgagcaccccgaccgccggcccaaaatcctcattgcttgtagtagtagtaggtatctatcaatatatacaagtcatctacgagaattaagcctccgcactgcctgcgccggccggtgatctgatcgatatcggcagtcagccatacatcgatcgagcggcaaagcgcctatagctgctgcaagacatgtcggacggcacggccaactgcatcgacatcctcatcgccatcatcctccctcctctcggcgtcttcctcaagttcggatgcaaggtggagttctggctctgtcttctgctcaccttcttcggctatctcccggggatcatctacgcggtctatgctatcaccaagtagtagttacatctcatctttactatacatctaaggtgattgaagctagctagtagtactagtgaaacctgtcttgcgtctatgtatcgattcatgtggtctacgtacgtactggatctcaactacttgatctgtatcggttcatgatcaggcctctgggctacttcacgtcataagggagaagaattcttgtgcaatcagtgttgagtgctttgccgacctttcatctaactgcccttcaagctcccaaatgggtaatcagtagaatagatcgttaccgcagatccttcttatggaagggagaagaccctgacaaaacaaatccgggaagtagcttggtaaattgggtacagtctgtagaccaaaaattttaggaggccttggaattccagaccttgagaaattttttcgcgctctaagactacggtggctctggttcaaatggaaagaggacaacaagccttgggttggaatggatttaccttgcgatgactgccaccaaagacttcttcaggctgccactacgataaatgtcggcaatggagaaaaaataaatttttggcatgataaggggctgcaaaatacatgtccaaaagacattgcacccttgtgtttcaacctagctaagcgcaaacaaagatcggttaaaacggaattgacaaacaaatcctggcttccttcctttcggcaaaaaaacacaaatgaagaaaaccagcgatcttgtccagcttgggggaatgctgcaaaatgttcagcttctaccgcaaaaccaatgacgacatcacttggaacctgaacgaatcgggatcctactatgcaaacagtgcttatttatttcagttccaagggtccttctcttcgattgactttcattccatttggaggtgcccagctgaactaaagatgcgcttctttggatggctaatccttcaccaaaactctcacggcccaaaatcttttgcgccggcactggccttgcaattggatttgtagcctgtgtggagaggcgtttgaagacactaaccatctcttcaatgtctgccccttcttcagaaaagtttggcttatggtgtgccaatggcaaaacataccgggggcacaacctgcagatgacactgcagcttgatgggctgatctcaatcaactacaccccaaacctttcaaattcaaggttaaaggatctcttctcgccacttggtggaacgtttggttggaaagaaacagaagaatttttcaaaacatctcttacacagaggatcgcgttgcgagaatagtaaaggaggaacttgatctcagacacactgctttccaacccccctaattgccttttctttttcagattccgttttgtttgtttcaggtttactcccttctccttcaatgtcttcccctgtattctctgaactgtttttctctcctctaatgaaattccggcagagctcctgccatcgttcacctaaaaaaaaatgatcaggcctctggatatacatgtatatatcctggaaaactgaattttctgcaattagttacccatctggattttctgtatcgattttgaaacttgtggaccaactggatttcaactaattttataatgtcttaat

SEQ ID NO: 1438 - DNA, 999 bp, Sorghum bicolor
gtcgtttcgttttccacattatgtaggagtcctcgcctgagcctgtttctgcacaggcataaatcccaatcaccccttggagctcccggtcacggctgctcaagctcaattgtactgtgtcagcgggaagaaagaggagacacctccagcctccggggctccagagatcgagcgagcaagatgaaggagggcacggcgaactgcgtcgacatcctcatcgccatcatcctcccccctctcggcgtcttcctcaagttcggctgcaaggtcgagttctggctctgcctcttgctcaccttcctcgcctatcttccggggatcatctacgcgatctacgccatcaccaaggactagcatggtaccagttgtggacaatcaacatcccgtcagtttctgtcagtttctttctcctcagcaacagtcgagtgagcgcttgatcaacaagcggagtaatggaaatgaactagctagtacctcgctgccatcgtaataatcgctgcttgccctgctgctcgatgtttgtggatgcaggaactgcgccgcaggatgtaaaattcattactacgtacaattgtcctttggagatcggttgaatctcagctgctgtgaagccactactagtctactactgattgagcctgaatttgtcgcttctcgttcgtgtattccgtcgatcgctctggttgttggtcgtggatcttagtaccagtttgtttaacatcacagagtaacttgtgctgttctgtttctgtattcgattcagtggtctgcgtaaaatttgtctccaacttgtgactgtgatatactagtgtgatgcatatatattgcttggtgaatttggatggacctcaacgacaaggccctcttggttgaattgggacttggtacttgggaggccgccagcccgccacgccagttgcttgatgtttgcgtggagcttgaaagcttcggcacatccgcatatgttgtcttgtttgtttgtctcataaaccataacag

SEQ ID NO: 1439 - DNA, 540 bp, Sorghum bicolor
cccttggagctcccggtcacggctgctcaagctcaattgtactgtgtcagcgggaagaaagaggagacacctccagcctccggggctccagagatcgagcgagcaagatgaaggagggcacggcgaactgcgtcgacatcctcatcgccatcatcctcccccctctcggcgtcttcctcaagttcggctgcaaggtcgagttctggctctgcctcttgctcaccttcctcgcctatcttccggggatcatctacgcgatctacgccatcaccaaggactagcatggtaccagttgtggacaatcaacatcccgtcagtttctgaactgcgccgcaggatgtaaaattcattactacgtacaattgtcctttggagatcggttgaatctcagctgctgtgaagccactactagtctactactgattgagcctgaatttgtcgcttctcgttcgtgtattccgtcgatcgctctggttgttggtcgtggatcttagtaccagtttgtttaacatcacagagtaacttgtgctgttctgtttc

SEQ ID NO: 1440 - DNA, 590 bp, Fragaria vesca
acacaaatccagagccagagcagttaccgaaataccaacaactctttcttaataattctcagtttcgaaatcagagtttaagcaaacatgccgagtgaaggaacagccaacttcatcgatatcatcatcgccatcctcttgcctcctctcggggtcttcctcaagtttggctgccatgtggagttctggatctgtctgttgctgaccattttcggttacatccctgggattatctatgccatctatgtcatcaccaagtgaagtagctagtcctgcttttctgtagtagtgataaggatgtgaagtgaagggcacatatatatgtcttctggtttctgcattcaaagcttgttttccaccattggattgcatagttacttgtttggtttggccaatggacagttgatatttcatgtagtgcgtgtgtgtcttctttttctctattcccccctccttattcccttattgagttcatccatgatttgtccttctgttgaagaaggtagaatatatagtgaagtattgaggagctgatgtatcaatcttagctctccaatttaataaaagaaattaaatttgttctcccatta

SEQ ID NO: 1441 - DNA, 511 bp, Triticum aestivum
  misc_feature (461)..(461): n is a, c, g, or t
gtcatcattcgagcagaggggagagagagagagagagagagagagatgaaggagggcacggcgaactgcatcgacatcctcatcgccatcatcctcccgcctctcggcgtcttcctcaagttcggctgcaaggtcgaattctggctctgcctcctgctcaccttcctcgcctatctccccgggatcatctacgcgatatacgttatcaccaaggactagccagctagcgccgtaaaccgggacaaggtgagagagctagctgatcagccagcggaggtaatggagatgaactgctgagatcacttgccctgctgctcaatgtttctggatggagactgaatctcagtgtgctgtgctgtgctgtgctgtgctgtgatgctgctatatactaccgattgtcctgaatttgtccctttcgttcgtgtctgcatatatgtgatcatatcgtaaaattctctcanactcctgtgcaaagtattgatcatcattgttgctgatgaaaaaaaaaaaa

SEQ ID NO: 1442 - DNA, 459 bp, Artemisia annua
gcaatcgaattcatttctattcgtaaaaaaaaaaaagttaagacacaaaatgtctggtacagctaactgcgtcgacattattctagcgatcatccttcctcccctcggtgttttcttcaagtttggctgccaagtacagttttggatatgtttgttgctgactttacttggatggatccctggtgttatttacgcaatttatgtcatcaccaagtgattcttacagcaagtgggtggacctgcattcatcgcttggttttggataaaaactgaactcgtgtggcttctagtttctaataattcatgtataagttgttacgttttttctctgtaattcctctttatttcggctttggtttccgttttggatatatatagttgtttatatcaaaggtttttggtctgttttttgtaacgttcgaatttttgtatgtgtgtgttttttatccccgtcggagt

SEQ ID NO: 1443 - DNA, 530 bp, Panax ginseng
ctttattctgatatatttttgctcaggatttgtaagaaaaaacagcagagggaattaagatgggaacagccacctgtatagatattatcttggccatcttcctccctcctctcggtgtcttcctcaaattcggctgcaaggtggagttttggatctgtctgttgctgaccatccttggatatatccctggaattctctatgctctttatgtcatcactaaataaatccacctactactctgacctgaccttggcacgagatgtgaagcctcaccaaagtcatcttcttttttgctaaaggagatgatctctagaatgattttgtcgtttatttgttggacatatatttaatttggttttatatatttatattcctgtcaaggggtcctaccgtttagtttttgtccatttactcttctttccattaattagtggttggtaattattatggtgctttcctaacatgtattttaaaatgtgttttggattattgtgtattgtgcattttttaattagaataaaactcttttg

SEQ ID NO: 1444 - DNA, 574 bp, Sorghum bicolor
cacggtgtgcatgccattgctggacgtcgtatcggacgcggcggcatccatggatcccaccgtccataccctgctgtctataaagtgagccccaagccatagaaaaggaggaatctgatccccatccaatccaagccaaggcagagaagaagaagaagaggcaggagatcgagaaggcggcagagaagccatgtcggcgaactgcgtggacatcctgatcgccatcatcctgccaccgctgggtgtgtttctcaagtttgggtgcgggcaccagttctggatctgcctcctcctcaccttcctcggctacctccccggcatcatctacgccgtctacgccatcaccaagtagtcgtcgtcgtcgttgctgctgctgctgtttgttgatgttcctgcttgctcttgccgatcgatgaatatatgccgattctaatacctagtagctagtggtatgtagcatcgatgtactcttcttaattgtatctctatatgttcatatgccccgttccaacggatttgtgtgtcagtgtgtgataaacagttattaagctgctactatgtcctccttgtctca

SEQ ID NO: 1445 - DNA, 550 bp, Trifolium pratense
ttagtctttactgtgtaaactgaatttgtactaaaaagaagaaaatgggtacagctacctgcgtcgacatcattcttgccatcatccttccaccacttggtgtcttcctcaggtttggctgcaaggtggagttctggatctgtttgattctaaccattttgggctatcttcctggaatcatctatgctatatacgctatcactaagtgatccatcatcttctatctacaccccctcaatttagcttttgtggatcgtgaatagttgtcagggggcgtcattcattcagttattgttattggtttctttgtactgtaaaattgtttagtgatggacaaaacaaaagttattcttttttagggtactttgagtgtcaatattcctttttttttttttttctctatttttaacctaagtttttgtcttgtgtggaatcaaagtgtgtgagtcttgtgaactctagaaatggtagttcatctcaataatgttgttcatctatcatcctttgactttaatagattcatttagatatttgttcaatgttaaatctt

SEQ ID NO: 1446 - DNA, 502 bp, Festuca arundinacea
ggcacgaggctgctgcttcgcatagttcatctcatccacctgttcatcacgatcaagaagagggagatcgatcatgggcgcggccacctgcatcgacatcatcctcgccatcatcctcccgcccctcggcgtcttcctcaagtttggttgcgggattgagttctggatctgcctcttgctcaccttcctggggtacatccccggcatactatacgccctctacgtcctcacacagtagaatcaaggcctcgtcgcaagtattttctttcctgatgatgcaaattcctatggtgtttcgttggactgtgtgaagaagaaggtgaagctctctgtatatgtattatgtatgggtgttcccagatgggagttcgtctttgtaaaagttgatcgtccctgttgaagtttggaatctgtgacatgtatctactcgagtttgtttgtcacttggttgcctcagcttttcctctataaataaagaagcatctggtttctactgtgaaaa

SEQ ID NO: 1447 - DNA, 508 bp, Lactuca sativa
tacactaccatcctcatcccatcgaaatcgaaatagaaaacggaatcggtttccaatcgaaagagaaatagagcgaagatgggtacagcaacctgcatagacataattctcgcaatcatccttcctccccttggtgtgttctttaagtttggatgcaaggttgaattttggatatgtgtgttgttgactttgtttggatggatccctgggattatatatgcaatttatgccatcaccaagtgattcttatggtgggtgggctcgcatatcctttttatggatagaacatcgactttcatgtcacttcttgttttatgtttggattgtttttggtttttgaattgatgtattgtaaattcttttttaatgttgtgttggtttaagtattttgcttgaatatagttgatgtgtcgtgattgacttgttaatgtaaagtaaattatattaaataagatacaggttaacattatattgtaagaaagaataaaaaaacatctaagttggtacc

SEQ ID NO: 1448 - DNA, 506 bp, Lactuca sativa
  misc_feature (291)..(291): n is a, c, g, or t
cactaccatcctcatcccatcgaaatcgaaatagaaaacggaatcggtttccaatcgaaagagaaatagagcgaagatgggtacagcaacctgcatagacataattctcgcaatcatccttcctccccttggtgtgttctttaagtttggatgcaaggttgaattttggatatgtgtgttgttgactttgtttggatggatccctgggattatatatgcaatttatgccatcaccaagtgattcttatggtgggtgggctcgcatatcctttttatggatagaacatcgantttcatgtcacttcttgttttatgtttggattgtttttggtttttgaattgatgtattgtaaattcttttttaatgttgtgttggtttaagtattttgcttgaatatagttgatgtgtcgtgattgacttgttaatgtaaagtaaattatattaaataagatacaggttaacattatattgtaagaaagaataaaaaaacatctaagttggtacc

SEQ ID NO: 1449 - DNA, 512 bp, Saccharum officinarum
gatcggccgccggagtgcgatcaccgacaccgagcagcttgcagatcgagaagaaggcaggcaggcagcagccatgtctgcgaactgcgtggacatcctgatcgccatcatccttcccccgctgggggtgttcctcaagttcgggtgcgggcaccagttctggatctgcctcctcctcaccttcctcggctacctccccggcatcatctacgccgtctacgccatcaccaagtagctgttcctttgcttgctcagctcgccgatatgtatgcatggatgccgattccaatacctgctagtagataggtaccacctagtgctctgctcttctatgattgtatctatgtgttcatatgccgtgccgacttgtgtgtgatcgtcgatgaatcgaacaaccagttattaagctactagtagtatgttcatgggtatgtcctgcttgtctcaagttactgctgtctgtcttttgctatatatcaccgcgacgcaagcataataagttcagagactga

SEQ ID NO: 1450 - DNA, 756 bp, Saccharum officinarum
cgtccgctgtgtctataaatttagtgaacccaagccataggaaaggaggaatcaatccgatccatccaagccaaggcaaggcagagaaaagcttggcactgcacaagagaggaagaggatcggccgccggagggcgatcaccgacaccgagcagcttgcagatcgagaagaaggcaggcagcagccatgtctgcgaactgcgtggacatcctgatcgccatcatcctgcccccgctgggggtgttcctcaagttcgggtgcgggcaccagttctggatctgcctcctcctcaccttcctcggctacctccccggcatcatctacgccgtctacgccatcaccaagtagctactggtattagcttagctactactactgttccagtgttcctttgcttgctcgtcgatatgtatgtatggacgccgattccaatacctgctagtagataggtaccacctgctctgctcttctatgattctatctttctatctatcagtgtgtgatctttgaagaatcgaacgaacaatagtatattattcatgggtatatgtctgctgagcaaacagatactggctgattgcctgatatgaacatggaatttttggaaccccggcctaaagagggtttttgctcaaccgagaaacgatccgacattttggtacctttcggtgggaccgcccgaccaagggaaccaaacttaccttttaacctaaccacacgagccgggctggctcaagaacctgggttggaaacatt

SEQ ID NO: 1451 - DNA, 557 bp, Saccharum officinarum
  misc_feature (106)..(106): n is a, c, g, or t
cgtccgctgtgtctataaatttagtgaacccaagccataggaaaggaggaatcaatccgatccatccaagccaaggcaaggcagagaaaagcttggcactgcacangagaggaagaggatcggccgccggagggcgatcaccgacaccgagcagcttgcagatcgagaagaaggcaggcagcagccatgtctgcgaactgcgtggacatcctgatcgccatcatcctgcccccgctgggggtgttcctcaagttcgggtgcgggcaccagttctggatctgcctcctcctcaccttcctcggctacctccccggcatcatctacgccgtctacgccatcaccaagtagctactggtattagcttagctactactactgttccagtgttcctttgcttgctcgtcgatatgtatgtatggacgccgattccaatacctgctagtagataggtaccacctgctctgctcttctatgattctatctttctatctatcagtgtgtgatctttgaagaatcgaacgaacaatagtatattattcatgggtatatgtctgctg

SEQ ID NO: 1452 - DNA, 638 bp, Juglans hindsii x Juglans regia
ggggacacaataaatagcagttgcataactccctgatctatctctctctctcgttaatcagttcagaccagcttccaatttttctcttccacaaacgtacagtaacccaaaaatggtacatgaagctggcaccgctacctgcgtagacatcatcttggccataatcttgcctcctcttggtgtctttctcaagtttggttgcaagatggagttttggatctgtttgttgctgaccatcttggggtatatccctgggattatttatgctgtctatgccatcaccaagatgtgaagtagttgatttttcttgtaagcagtatacatctctctccctcggtggaggtgaattaataattaagcgcatccatgcctttccgtttctgatttggagttcgtttatttgtagccataatggatggacgtacagttgaatccgagtttagtgtgtcaaagtgtatggtttttcctttcctttgtatttgctgcatgtaaaggtatggaatatttgtaattttgtgatgaattaagacgatggtaacggtactggatcgtaaaacatattcttatatatatattcttatatatatatatatgttaatgtgattgtgtttttatccatggaaggcatcattccttat

SEQ ID NO: 1453 - DNA, 533 bp, Juglans hindsii x Juglans regia
ataaatagcagttgcataacggcctgatctctctctctctcgttgatcagttcagaccagcttcaaatttttctcttccacaaacgtacggtaacccaaaaatggtacatgaagctggcaccgctacctgcgtagacatcatcttggccataatcttgcctcctcttggtgtctttctcaagtttggttgcaagatggagttttggatctgtttgttgctgaccatcttggggtatatccctgggattatttatgctgtctatgccatcaccaagatgtgaagtacttgatttttcttgtaagcagtatacatctctctccctcagtggaggtgaattaataattaagcgcatccatgcctttccgtttctgatttggagttcgtttatttgtagccacaatggatggacatacagttgaatcttcgtttagtgtgtcaaagtgtatggtttttccttttctttgtatttgctgcatgtaaaggtatggaatatttgtaattttgtgatgaattaagacgatggtaagtggta

SEQ ID NO: 1454 - DNA, 663 bp, Heritiera littoralis
ggcacccaaacctcaaaaccaagtagttatctttatcatcactcgctctttcagaattgtaagtacttgaagcttcttgagttacatctctgtcctgttgtctcggtgattgtcctgttggtttgctacaagaagcagaagaagaaaaaatggcagaagacggcacagctacctgcatagatatcctcttagccatcctcttgcctcctcttggggtcttcctcaagtatggttgcaaggcggaattctggatctgtctggtactgaccctttttggctacatccctggtatcatttatgctatctacgccatcaccaaatagtactccagctcctcgatctaattattcctccatcttctgtggagacaaatgaaaggtgatttgatgtaggatttgtgtttcaacgtgtgtcgattgtaccattcttcttccccactatcttggcgacttcttttatttttattactattattttttctaatattttgtttgtcaatttgatgtaagttgtgttggccgggtttcatgattaggataaatgggcagccatttgtcccgctatgttaattagtgtctgtcccctctgctctctttggcagtgatgcagaagtccttatccattgtttgttcatcgcactactaatggagttatggcttttta

SEQ ID NO: 1455 - DNA, 736 bp, Jatropha curcas
atggtatggtatatacgtacggtaatcgaccgggaaaggttaggatagcttacctcaatggtacctgagctcgcctagcagggttcaccagagtacgcgggacagtccagcaggcaaaaaagcagttgctcaacacaatcaaacacacccaattctctttgaatccaattcaagaaagcaagataaagaaagaaaaatgccaagtgaaggcacagctacttgcatagatatcctcttggctgttatcttgcctcctcttggcgtcttccttaagtttggttgcaaggcggagttttggatctgtttgcttctgaccattttgggatatattcctgggattatctatgctgtctatgcaatcaccaagtgatcttccatctacggtggaaagctacataaccatttgatttgatggaggggtctgttttggtgaagtcagatgtatcattctaattgtgtgtgtgtgtttacgtgtttgtcttctatgaagatttccatttcattttttaattttctgtagttaaaaaaaaattagccattgagttgggtttgtgagtagaaacaatggcttgtcaattatcattttagtttatctttgaacttgaaatttgttttaattttaaatgtgattgtataattattgtctacctatttatcttcttgattgttcattattattatgagcaaaacagcatatcccctgaggattctgaataaaaaagggggggcccggtac

SEQ ID NO: 1456 - DNA, 513 bp, Avena sativa
catacctgcaacctccctttcctcctccttgctcagttggtcttttgggttttcctgcgagagagaagatggcggacgagggcacggcgaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaggtagagagggagcccctccctgccctcacacaggtgatggcgattgctggtatcagtgagctgtctgtttgagacccgagccacggctcatggtgctgccgtgtgatgtgcatgtgtgtgtgtctaatgtcttcgtgttgtacatctctttcgtgtttgtgcttagtttttttcctcctgctctgctaccttctcccctccagtgtatcatcgtcatcagcctgttcccccgcgtgtttacccttccctgtacttggattaattaattaatcaaa

SEQ ID NO: 1457 - DNA, 611 bp, Hordeum vulgare
ctctagccgtctcgctctcctagtttcttccatcaacctcctctcctctcctctcctctcgcctggggttctcccttcgactgcttcgagacaaggaaagaagatggcggacgaagggacggccaactgcatcgacatcatcctcgccatcatcctgccgccgctcggcgtcttcttcaagttcgcctgcgggatcgagttctggatctgcctgctggtcaccttcttcggctacctccccggcatcatctacgccgtctgggtcatcaccaagtagccgcccctgcctgcctgcttgtctctaagtgatccatggccaactttgtccgtttgtcccagacgcgagccaagtgatccatggtgctgcgtacgcgttgtgtgttcatgctgtgtgacatctggttgttgctcttgcttgaagattaaactcctcttctcctgtcccctttcccagtgtatccatgccttcagttgttcctttgtacattttcgtcgtccatgtacttttgatgaattaattaattaatacactgattggtggaaaaattttcccgttctagacaaaatataagtagcaaagatgatatcagtatacgaagttacaacgtgac

SEQ ID NO: 1458 - DNA, 656 bp, Brachypodium distachyon
gagctcgtccgtcgcctttataaagcgggctctttgctgcttggctgcttccagtagaccagtactctccacctaccaatcgctctcactctcctttggattcgattttccacgaagtccccggctaagcctcaggagaggaagaatggcggacgaaggcacggcgaactgcatcgacatcatcctcgccatcatcctgccgccgctcggcgtcttcttcaagttcgcctgcgggatcgagttctggatctgcctgctgctcaccttcttcggctacctccccggcatcatctacgccgtctgggtcatcaccaggtaggagtgaccgaccactacggtcctccttcgtcaccaattgcgtaggcgatgtcatggcgatcctgtatctttcttccgtgcccgttgtgagctagcagcttgtttcacaacacgtacgctagctgtaagctgttgtatgtatgtgtgtgtgttgtaaaatcggttctgcttgtgctcagttttctttctcttctggtctccactgtacgtgtcccatctttccctctagctctctccctccttcccatccggatgttgcatgtagcatcccgttccgtcccctgtctgtacctcgattgattattaattgtttgtggagaaatccccttgttcttgag

SEQ ID NO: 1459 - DNA, 592 bp, Brachypodium distachyon
ctctccacctaccaatcgctctcactctcctttggattcgattttccacgaagtccccggctaagcctcaggagaggaagaatggcggacgaaggcacggcgaactgcatcgacatcatcctcgccatcatcctgccgccgctcggcgtcttcttcaagttcgcctgcgggatcgagttctggatctgcctgctgctcaccttcttcggctacctccccggcatcatctacgccgtctgggtcatcaccaggtaggagtgaccgaccactacggtcctccttcgtcaccaattgcgtaggcgatgtcatggcgatcctgtatctttcttccgtgcccgttgtgagctagcagcttgtttcacaacacgtacgctagctgtaagctgttgtatgtatgtgtgtgtgttgtaaaatcggttctgcttgtgctcagttttctttctcttctggtctccactgtacgtgtcccatctttccctctagctctctccctccttcccatccggatgttgcatgtagcatcccgttccgtcccctgtctgtacctcgattgattattaattgtttgtggagaaatccccttgttcttgag

SEQ ID NO: 1460 - DNA, 679 bp, Manihot esculenta
atctcataaaaaggaaagacaaagaagtaggtttccagagggagagagttcttaaagtgtttgtgataattactcaatagaaaacgtttgaattctaaagaaaaacaagtgaacatggcagatgagggaactgctacttgcatagatatcctcttggctatcctcttgcctcctcttggtgtcttccttaagtatggttgtaaggctgagttttggatctgtttggttctcaccttttttgggtacattcctgggattatctatgctgtttatgccattaccaagtgatgatcttcatcttcttcagtggaaagctaataaccatttgatttgatggagttgtgctgtttaatttgatgtagtcatatggatcattcttgtgtgtgtgtgtgtgtgtattttaatatagaattttctatttattctatatattaatttgatgtaaaaagggtcattgccattggatttgagtggctttgtgagtaggagaatggcttgtcaatgatcatgttactgttagtgtctctttcaacttcaaatttgtttccaatgtgatttgtattattattattattatcattataaccctattctctcatgaccaagtggtgataaagatctctgcttttggttgttggaattatggttggatatgtgcttggaatgacgatcaggaatc

SEQ ID NO: 1461 - DNA, 643 bp, Manihot esculenta
gatctcataaaaaggaaagacaaagaagtaggtttccagagggagagagttcttaaagtgtttgtgataattactcaatagaaaacgtttgaattctaaagaaaaacaagtgaacatggcagatgagggaactgctacttgcatagatatcctcttggctatcctcttgcctcctcttggtgtcttccttaagtatggttgtaaggctgagttttggatctgtttggttctcaccttttttgggtacattcctgggattatctatgctgtttatgccattaccaagtgatgatcttcatcttcttcagtggaaagctaataaccatttgatttgatggagttgtgctgtttaatttgatgtagtcatatggatcattcttgtgtgtgtgtgtgtgtgtattttaatatagaattttctatttattctatatattaatttgatgtaaaaagggtcattgccattggatttgagtggctttgtgagtaggagaatggcttgtcaatgatcatgttactgttagtgtctctttcaacttcaaatttgtttccaatgtgatttgtattattattattattatcattataaccctattctctcatgaccaagtggtgataaagatctctgcttttggttgttggaatt

SEQ ID NO: 1462 - DNA, 722 bp, Citrus sinensis
atttaaaactcagacaaaaactattaaaaatctaacattgataaaaacaacttccgcagacataaacaaaaataccaagtacaaataacaaaagcagttactcaaaaccttaaacacttctttaatcaaagttcttgttttttgactctaaattttattttattccattttacactttttaagaatcaatcaaagatggcagatggaagcacagcaacatgcgtagatattctcttggctgttatcttgcctcctcttggtgtctttctcaaatttggttgcaaggctgagttttggatctgtttgctcttgacaattctggggtatatccctggaattatttatgctgtttatgccatcaccaagaagtgatctctcttcttcatctattgagagatcccaagggcatcatgtgtttatgagatcttttatttacaaccgtttgatggacagctctgatttgatgtagccagatgggttctgattcttaatcaactggggtgtgcgtgtgtgtgggagagagcacttgtttcgtttgttaatctttgtcgttttgttttctttaatttgtcctttttaatgaattttaattcaatatgttgatgtaaagtggagtattattgagtgtgtaaattgccttgtgaatcattacaagtccccacaaaactaaatttgttctgaattattgtgactgctgaataattactaaatattcttttttg

SEQ ID NO: 1463 - DNA, 1270 bp, Gossypium hirsutum
cggggacccactctcccttggctactagaaccctctcaaaaaacaatcctcttcctgaaagaaacgaaagtcttgaatttatttgcttggggcttgtaaagaaggagaagaaaaaaatggcagatgatagcacagctacctgcgtagatatcctcttagccatcattttgcctcctctcggtgtcttcctcaagtttggttgccaggtggagttctggatatgtcttgtactcaccctgtttgggtacatccctggtattatttatgctatctatgccatcaccaagtagtcctctaatcccatccttctcatctgtggagatttggagtaggattctggttttgtttgaatatgtgtcggttatagtattttatttcaattaatattttgtctgttaatttgatggtgatgtaaagcttgttgttatgttatgatgatgatttatataaagggggggggggttgaagggtcatgttacgtttgtgtttatctcctcatcccctttggcaatgatgtggtacaactccattccatttatttagtgtttttttttttggtttcaatatttcattaatttagtgttcatcaaataaagatgttttaatggtgggatccggtttcagtataaacccagtatgccattcaagttatatgatttgttttatgtttctatgggcagtttgatttccatcaattttatataaatttaattagtataataataaattggattggggtggaggaaagagaggcgggggggggggggggggggggggggagggggggagctggggagtgctggtagaacaagccgaaccccaataggttgagccacccgggtggggagccagaggagaggacccggggcgccctgtggggggggggtggcggggggctggtccgggtgggcggcggggggacggggaaagccatagcagggcccggcgggtgaacctggggaagaaagccccttttgccgctgtgttgagggtggataatcccaggcggatcgccctactcagcgtggggcgacctagacattataacgtgcccatttcgggggcgcccgcgtttaatactcctcgccctttgtgagggtggatgtacccaatcggctcttttagcgcatttgagtacccgtgctgaatggctaggccgatgccgggttgtcctccccccgtcccgttgtttattccaccccttccaggtacgtattgtcccgtgtcccactggttccgcatgtattaacccacccgccgtgtgtgcgtt

SEQ ID NO: 1464 - DNA, 609 bp, Vigna unguiculata
ggtcaacttacaaattcggcagttaaaggttttcggtgttttgttcaaatcagaattgttcctctgcgttttttgtgagttgcaactttacagagaaaagcttccaagttaagaaatccagagagcaaaaatggcaggtgacggtacagctacatgcatagacatccttcttgctatcatcttgcctcctcttggggtttttctcaaatatggctgcaaggtggagttctggatttgtttggtgctaaccctttttggttatatacctgggattatctatgctgtctatgccatcaccaagtgatcacactttagcttttgaagacaataaacaaatgtcatgggcgtttctgtcattcaagtcacatattagtgtttctttactgtatcattgtcaatgtcatccatttttttttatgctctgtttctaaaattcctctgtttttagcttaagcgagcgtggagtgtgtagcttgtatgtagtctctagtgttaatcgatttgaaatacacaatttgatttgtatcaatggtgttgttcaagtatgtaatgtaaattgtgttattcttgactttcaaatgaataaattgaaattttttcttatgacat

SEQ ID NO: 1465 - DNA, 534 bp, Vigna unguiculata
gaaagaagaaagaagcaaaaaggtaaaagaaaatggccggtgacagcacagctaactgcgtcgatatcctcattgccatcatcctccctcctctcggagtttttctcaagtatgcctgcaagtgtgagttctggatctgtttgctgctcaccattcttggttacattcctggaattatctatgctgtctatgccatcaccaagtgaaactcatccaccttttgtggacagtgattgaatttcaaaggagcgtgtgtatgttcttctgtactcatcgtttgatctttggtggacgcacgtgatgctttcgttttctgtttatccgtgtcaatattccgttttagtgttgtgttttttgttactgttattgccttatgtggaaccaaacgtcgacgttgtgtcctttagttttaacgtatgcttatcaaattgaattcgtaataattatattcttcttcttctttcgtatatattaatgcattttgtaaattttcttcctatttaaaagaaatgttttagattgacattactatga

SEQ ID NO: 1466 - DNA, 596 bp, Cucumis melo
gaccttcatcactacccattacctcattccaataatctctctctctctctctctctctctctctctctctcactctctgtttgtttgttttgtgcaaatcagaagaagaagaagaaagaaaaagaaaaatggcagacgaacgaacaacaaattgcatcgatatcctcctcgctattctcctccctcctcttggtgtctttctcaaatttggatgccaagttgagttttggatctgcttggtcctaactttctttggttacatccctggcattatttatgctgtttatgccatcaccaagtgatcaccgaattcaaaggattgatggaaggaattattggaactcatcatcatggtctctcctcaccgacactctcccttcctttttctattttcctttttgctaatttctcttgatctctgttttgtgtgtttgcttgtgtgataatcatcccatccatcaaagacatctacacaattgctgcttctttttttttttttttttgtaatttgtaatttgaattatttgtgggggtaatttaattgtgtgtcgttcttgttgtattgattgaattggttgctgtaaagaagaaaaagc

SEQ ID NO: 1467 - DNA, 458 bp, Avena sativa
agaagatggcggacgagggcacggcgaactgcatcgacatcatcctcgccatcatcctgccgccgctcggcgtcttcttcaagttcgcatgcgggatcgagttctggatctgcctgctgctcaccttcttcggctacctccccggcatcatctacgccgtctgggtcatcaccaggtagagagggagcaggacctgctccccctccctgccctcacacaggtgatggcgattgctggtatcagtgagctgtctgtttgagacccgagccacggctcatggtgctgccgtgtgatgtgcatgtgtttgtctaatgtcttcgtgttgtacatctctttcgtgtttgtgcttagttttttgctactgttctggcaccttctcccctccgatgtatcatcgtcatcatccagttccctccgcgtgtttcggtccatgtacttggattaattaattaatcaaa

SEQ ID NO: 1468 - DNA, 504 bp, Avena sativa
tttgggctttcctgcgagagagaagatggcggacgagggcacggcgaactgcatcgacatcatcctcgccatcatcctgccgccgctcggcgtcttcttcaagttcgcatgcgggatcgagttctggatctgcctgctgctcaccttcttcggctacctccccggcatcatctacgccgtctgggtcatcaccaggtagagagggagcaggacctgctccccctccctgccctcacacaggtgatggcgattgctggtatcagtgagctgtctgtttgagacccgagccacggctcatggtgctgccgtgtgatgtgcatgtgtttgtctaatgtcttcgtgttgtacatctctttcgtgtttgtgcttagttttttgctactgttctgctaccttctcccctccgatgtatcatcgtcatcatccagttccctccgcgtgtttcggtccatgtacttggattaattaattaatcaaattgatttggtggagaaatttgtgttt

SEQ ID NO: 1469 - DNA, 428 bp, Secale cereale
  misc_feature (187)..(187): n is a, c, g, or t
  misc_feature (294)..(294): n is a, c, g, or t
ccacgcgtccgctccgagagacagagaaggaggaagatggcggacgaggggacggccaactgtatcgacatcatcctcgccatcatcctgccgccgctcggcgtcttcttcaagttcgcctgcgggatcgagttctggatctgcttgctgctcaccttcttcggctacctccccggcatcatctacnccgtctgggtcatcaccaagtaggtgtagtcggaggggctcctctgcctcggcctgcctctaggtgatccattccatggcgaacttgttctgcgtctggtacaagcngtttgtctgagaagcgagccacggttcatggcgctgcctgcctacgtgtgtgttgatgctgttgtacatctgattgttgttcgtgcttgatgattagcctctcctcccttgtcaccttcccctgttccccagtg

SEQ ID NO: 1470 - DNA, 404 bp, Gerbera hybrid cultivar
aaaaaaacataaacacagagtacgttgaagttaggatgtcggaaggtacggcaaactgcgtagacattatacttgcaatcatccttcctcctcttggtgttttcttcaagtttggttgccatgtagagttttggatatgtttattgctgactttatttggatggatccccgggattatctatgctgtttacgccatcaccaagtaattcttatggtaatattttaaaaaggtggacggggctcgcaccaaacgtttgactagcgtgttttttatgttttcaatacgagccttatgtattgtgatataaattttattgtaatatagatcgattttatatggtgtgatgttattttgacattattgaaaattcattatttagtattcaaaaaaaaaaaaaaaaaaa

SEQ ID NO: 1471 - DNA, 359 bp, Panax ginseng
attctcttcttctgcctctgcttaattctatcggcatttgctcagtttttgtgttcaatatcccaagtagaaagggaagatgaaagagggaacagccaccttcatagatattctcttggccatcatccttcctcctcttggtgtcttcctcaaattcggctgcgaggtggagttctggatctgtctgttgctgaccctctttgggtatctccctggaattatctatgctatttatgccatcactaaatagacccactacagctctgtccttggtaggagacgtcaagcctcattaaaagtcttcatctttccagctaaaggagaggaatgattttatcttttatttgatggacagctat

SEQ ID NO: 1472 - DNA, 466 bp, Tragopogon dubius
tcggggatcacaaccattcccatccaaatcgaaatcgaaatcgaaatcgaaatccgaagagaatttcaaatccagagagtacgaaaatgtcagggggaacagcaacttgcatcgacataattctcgcaatcatccttcctccacttggcgtcttcttcaagttcggttgccagatagagttttggatatgcgtgttgttgactttgtttggatggattcctgggattatctacgcaatttacgccatcaccaagtgattcttatggtggctgggctcgcagcgttgttttcgtatgaacattgatacccatgtaacttttcgttttgtgttttcgtatttagcctcgaattgatgtaaacgttattcttttttaatattgtgttggttctcgtattgtgattaaatataattttgtgttgtgaatgaattattggtgtaagttatatctatcatatgttattgagt

SEQ ID NO: 1473 - DNA, 639 bp, Ricinus communis
atccctcgccggacaacaaaaaccaaaggaaagcaaaaaagagagtattaagcaggaagtagttagttacccacaaaacacacacacatacttaaacgtttttgcgcagcacaagtgaaagatcatatggcagacggcgcagctacttgcatagatattctcttggctatcatcttgcctcctctcggtgtcttccttaagtatggttgcaaggtggagttttggatctgtttgatcctaaccctttttgggtacattcctgggattatctatgcagtttatgctatcaccaagtgatcatcttcttctacatatgcatggtggagattttataatcatatttgatttcatggagcatttctagtttggagcagtcagactcagatggatcgttcttgtgtgtcaacgtcttttttctttttcctcttttcttttgttttgttttttttttttaaatttctgacaatttatttaattgcccttttgttaattttacctattaattcagtgtaattaaagagggtggatttgttgtcggtagggcaatgagttgcccattatcatgtttgatgttagtgtctctttgaattatgcaagtgatgatatatatttctttgtcatcatgtcttcgttttcttt

SEQ ID NO: 1474 - DNA, 586 bp, Ricinus communis
gcaaaaaagagagtattaagcaggaagtagttagttacccacaaaacacacacacatacttaaacgtttttgcgcagcacaagtgaaagatcatatggcagacggcgcagctacttgcatagatattctcttggctatcatcttgcctcctctcggtgtcttccttaagtatggttgcaaggtggagttttggatctgtttgatcctaaccctttttgggtacattcctgggattatctatgcagtttatgctatcaccaagtgatcatcttcttctacatatgcatggtggagattttataatcatatttgatttcatggagcatttctagtttggagcagtcagactcagatggatcgttcttgtgtgtcaacgtcttttttctttttcctcttttcttttgttttgttttttttttttaaatttctgacaatttatttaattgcccttttgttaattttacctattaattcagtgtaattaaagagggtggatttgttgtcggtagggcaatgagttgcccattatcatgtttgatgttagtgtctctttgaattatgcaagtgatgatatatatttctttgt

SEQ ID NO: 1475 - DNA, 527 bp, Nuphar advena
gcaaggcaaactcatcgttcttccttatccagcgctgcgccctttctttccatctccctcgttgagaagtagagcaaaaaaaaatcaaaggagacagtgaaagatgtcagacaacaccgccaattgcgtcgacatcctcatcgccatcctccttcctccccttggggtcttcctcaagttcggctgccaggtggagttctggctttgcttattactgaccttcttagggtacctgcccggaatcatctatgccatttacgccatcaccaagtgaccataaagaacccttctctcccttttttttctggtgaaatatggggctggttgaatggttggtgatgtaggccgtggatttcgtcattgaaatttgcgtgtgtggttttttcatggtgtagctgtgtgagggtgctgatgccgcttttttccctttccagtttcttcatttaactctctctctctctctcatctactctgtaataatctgtatgtcatatcaagatctcaaattgaatttgtggtaataaacc

SEQ ID NO: 1476 - DNA, 706 bp, Arachis hypogaea
aggtgcgggggagcactatcaaatacgaaatcttctcaaatacaagcagcagaagcagttattgtaacttaagtttaatcaaaaatggcggaaggcacagccacctgcatagacatcctcctcgccatcatccttcctcctcttggggtcttcctcaagtatggctgccatgtagagttctggatctgtttggtactcaccctttttggatatctccctggaattatttatgctgtctatgctatcaccaagtgatcatcatctttggtggccaatgaacagtatagttctcaagtgcattccgcgtgtttcagttcagatattcctgtttttctgtagccgtttgatctttgatgggttaattaaaaagtgattcttttttcttctttttttttctcttttgttttattctcagtgtatcactgtcaatatcccttttttagtgacgtgttaattaattattattttccgtgctttattttgttgtatgtaacaaccaagagtgggacttggtgtggtctctatacttgtttggagtttggacaaccgaatgaattgaaagatagtacttgctagtcagggtcaataattttgtttacttgtattagacctcaatcctaattagtaatgtattcattcatgtcaaaatgttctaatagttatcaattattattttcaaattaataaaattgatttattcatcaaa

SEQ ID NO: 1477 - DNA, 597 bp, Panicum virgatum
gatcgcacttactcaagctcagctacaattaacttgctcgcaagctcgcgatctcggctctgctattttctcccctcctcctactcgatcggcggcagagataaaagagatcgatcgagaagatgtcggacggcacggcgacctgcctcgacatcatcctcgccatcatcctgccgccgctcggggtcttcttcaagttcggctgcggggttgagttctggatctgcctcgtcctcaccttcttcggctacctccccggcatcatctacgccgtctgggccatcaccaagtagacgacatctccttcgaggtgataatgggacctcgtgcgcttaatattctggtgtaatctgctgcagctgtttgagacgatgtaatttccttctttctttcttagcttctggttttcctctttttttttttccctttgggcgcggccctgtcgctggggtacgggctgcacctcctccactgtatcgtccagttcctctgcacatttccgtccctgtactttgattaattaattgtttcgtcctttcttcggtggaaaatccgatccccttggctacttgagcaatgacattatccgttttcccc

SEQ ID NO: 1478 - DNA, 611 bp, Medicago truncatula
ggggaactaacaactgtgtcttgtgtgtaaactaaactaaattgtccttttgtaacactttctttctctctttctttcaaatttcaactcaaaatattgaaaatgggcactgctacatgcgtcgatattattcttgccatcatccttccacctcttggtgtcttcctcaagtttggttgcaacgtcgagttttggatatgtttgattctcaccattttgggctatcttcctggaattctctatgctatctatgttatcactaagtgatccatatcatcatcttccaattaccccctcgaaatataaggatgatcatgaatagttgtcaggggcgtcattctagtacttcaattcagatattggtttcatgtaaaattgttcagtgaaggacaaaagttgattcttttttgtttttatctttcggtgtcaatattcctttttcttttcttttttagctctgtcttttaatgaaagaaatgaaagtgtgaagcttgtgaactctagaaatggttgtagaattgaactatagtggtagtccatgtcggtaatcttgttcgtatatccttgactttaagatattcattaaatatttatatgtatgttttgttcca

SEQ ID NO: 1479 - DNA, 762 bp, Pinus taeda
tcttgatcttgagcttcttgattgcttttttggctcacttcatacactcactctctttgcttctctgtcttgggtctctcttcacttttctgaaaaagttgtcattatttccgtcataatgagggagggcactgcaacctgtgtggacatcttcttggccatagttctgcctcctctgggagtttttttcaaatacggctgccatgctgagttctggatatgtctgctgctcacgatattggggtacataccgggaattatatacgccatctacgccattaccaaggaaaatccatgattttttgggggatgttgatgtaactggggctgctgtctgtgcaaccaaccagatttgattcagcaacaatcctgttctgcagtgttcttcgttattgttattgagcgttcttcattgttaaccataggttgtaatttcttatctatatacacttggcacatgacaaccataggttgtaatttcatatctatatacacttggcacatgactgtacatttacttagtgaacagttctctgtcacatgtatgtttaatgacttctaaaggattatacatataagtttttcaatatcctgtatgtttactcaagtctctgtgtcaacatgtttgtcattggcatattcaacatttgaacattcatgactgtgaaaatggtaaagatgaaaaaattggaaatttttttccaatttggcaaatcacatctgattctccatgttaaactgagattttgtgatttttgtaat

SEQ ID NO: 1480 - DNA, 420 bp, Brassica oleracea
gtggaagtggaagtggaagtggaacagctaattgcatagatattgtgcttgctatcctcttgcctcctctcggcgtcttccttaaatttggctgccatgtggagttttggatatgtttggcgttaacgttcttaggatacattccggggatcatatatgctatctatgccatcaccaagaagtagtgatctctctctctgccttcttgagtcttgttatatggctaccacttgtatatttcatgtacaactatagtttatacatgataaatcacagctcttctcttctactgcactaggacgatacgattgatgaaggaacggtggtgttattttgatagtttctttttttattgttcatttcaatattgtaagataaacttattaaatatggtaaagttaatataaatggagttgaatt

SEQ ID NO: 1481 - DNA, 506 bp, Centaurea maculosa
  misc_feature (16)..(16): n is a, c, g, or t
gcggggatacaattancattagaagaatacagcagagagaaacagaggcagttaattagaagcggaagaagaagaagaagaagaagatgggtacagcaaccttcattgacatcattctcgctatcatccttcctccccttggcgtcttcttcaagttcggctgccaggtggagttttggatatgcgttttgttgaccttgtttggatggatccctggaattatctacgccatttatgccatcaccaagtgattcattcattcttatggtgggtgggctcacatcaaatgatagaggataaacattgaatttggtttcattgctggttaaatagtgtgcatctctcttttcaatatatgtgtcggttacagtcttctttacgtaaatttttttcattttctttttcttttggttatgcatagagtttgttgtatgctgtgttgaatttttaatgtaaaaatagttctcggacttgttgtgttatttattgtgatttactcttactac

SEQ ID NO: 1482 - DNA, 511 bp, Castanea mollissima
ttattggatcatcatcagtgaccaattttcatttactactcttttttccaacaaaaagaaaagaaatatgacagctgctacctgcatagatatcatcttggccattattttgcctcctcttggtgttttcctcaagtttggttgcgaggtcgagttttggatttgtttgttgctgaccattttgggctatctccctgggatactttatgctatctatattatcaccaagtcaccttacagattgagttaatggagtagatgaggcatcactacagatatgctagaatggtattttggtgcagcttgatcacatgacgttatgtcatatacaatctcaggagcatcaaatcaggaaaaactctatagtgtccagatttgctaatgcaacttgttgtgaaagcagaattcgttcatcattgaaagtgagcaatgctttaaagatagaaaattgatgaactattcggtaacagtaaaatgtaaattgtctaccaaagttcttaataatataaaa

SEQ ID NO: 1483 - DNA, 467 bp, Lactuca sativa
  misc_feature (52)..(52): n is a, c, g, or t
  misc_feature (102)..(102): n is a, c, g, or t
  misc_feature (113)..(113): n is a, c, g, or t
  misc_feature (137)..(137): n is a, c, g, or t
  misc_feature (392)..(392): n is a, c, g, or t
tatcactaccattcccatccacatcgaaatcgaaatagaaaacggaatcggngtccaatcgaaagagaaatacagcgaagatgggaagtacagcaacctgcntagacataatnctcgcaatcatccttccacccctnggtgtgttcttcaagttcggatgcaaggttgagttttggatatgtgtgttgttgactttgtttggatggatccctgggattatttatgcaatttatgccatcaccaagtgattcttatggtgggtgggctcgcatatcttctatatggatagaacatcgattttcatgtcacttcttgttttatgtttggattgtttttggctttgaattgatgtattgtaaattcttttttaatgttgtgctggttttaagtantttgtttgactattgatgtgtcgtgatggactcgtcaatgaaaattaaattatattaaataagatacatgttaac

SEQ ID NO: 1484 - DNA, 526 bp, Lactuca sativa
tcggcggggatctacattcaatcgaactcgaaatcggaatcgaaatccaaatcgaagttgaaatcgaaagagaaagagaaagaagatgggtacagcaacctttattgacataattctcgcaatcatccttcctccccttggtgtgttcttcaagttcgggtgtcaggtggagttttggatatgtgtgttgttgactttgtttggatggatccctgggattatttatgcaatttatgcaatcaccaagtgatttttatggtggttgggctcggatcggttcttatcagatagaacacccatattcttgtctcacttcttgttttcctttggatttttttagtttctaattgatgtatcgtaatttttttctatatttgttttggtttcagtattcgatttggatacagttgtgtgttgtccttgttaatgtaaatcaatcatatgttacatattatcaatcatatgttatatatgatgatgtggataagatttaattaaatgaattatatattactctttggtttag

SEQ ID NO: 1485 - DNA, 513 bp, Lactuca sativa
acattcaatcgaactcgaaatcggaatcgaaatccaaatcgaagttgaaatcgaaagagaaagagaaagaagatgggtacagcaacctttattgacataattctcgcaatcatccttcctccccttggtgtgttcttcaagttcgggtgtcaggtggagttttggatatgtgtgttgttgactttgtttggatggatccctgggattatttatgcaatttatgcaatcaccaagtgatttttatggtggttgggctcggatcggttcttatcagatagaacacccatattcttgtctcacttcttgttttcctttggatttttttagtttctaattgatgtatcgtaatttttttctatatttgttttggtttcagtattcgatttggatacagttgtgtgttgtccttgttaatgtaaatcaatcatatgttacatattatcaatcatatgttatatatgatgatgtggataagatttaattaaatgaattatatattactctttggtttag

SEQ ID NO: 1486 - DNA, 553 bp, Eragrostis curvula
tggctacatatctccccagtccctcggacttcagccgccgctgtgcatagctgtttcagtgtttacgcttcaatataccatcaaccaacggtcgcagctcgcaggggagtctgtaaaagccactccagctgcaagatgtcggagggcacggcaaactgcatcgacatcctcatcgccatcgtccttccccctctcggcgtcttcctcaaattcggctgcaaggtcgagttctggctgtgtctcctactcaccctcctcgcatatctcccgggcatcatctacgcgatctacgctatcaccaagacaacagagtagcagaacgagtttggccgggccaaggatgttaaattaagtgcacactgcacagttgtgtcgtttcggagattatttgtagtgtatatcgagctttctttcttcacgcccagcacgattgtgggtctgaaccatttgtggctcttgtatgttcatgtaaagtagcagtttctttctttcttcacgcccagcatgattgttggtctgaaccatttgtggatcatatatgatcatgtatact

SEQ ID NO: 1487 - DNA, 513 bp, Eragrostis curvula
  misc_feature (21)..(21): n is a, c, g, or t
cgggaaaaaaaaaaaaccagncaggttctgcgcaaccgtctgcgtaacttgcgatcgagctcgcttagcttctctgtctctgtctgtctggtctttcatattttcctcccacccgctcgccagttgtcgtcggctaggtgccaagtccgcaggtgaggaaggtagaaaaagaagaagaagaagaagaagatgtcggacagcacggctacctgcatcgacatcatcctcgccatcatcctcccgccgctcggcgtcttcttcaagttcggctgcggggttgagttctggatctgcctgctgctcaccttcttcggttacctccccggcatcatctacgccgtatggatcatcaccaagcagtagagcagcacgaccccccaaggtgatgggaaccttggtcggcccgtgatccgtcgtgtccgtgttaatttgagatataatttttcttgtttccctagtttgtttccttgctccgatccttcgttggtagctgctggctggatggtgcgcact

SEQ ID NO: 1488 - DNA, 470 bp, Zea mays
gttacgtttccactaggacgccctcgcccgcctgagctgtttctgcagtcattaaaatcccagccacccacttggggggcacccgatcagtcaaccagggggaccaaacaggagacgcatccagcagagggctccagagatccagcaggatgaaggagggcacggcgaactggggggacatcctaatggccataatcctgcccccactcggggtcttcctcaagttcggatgcagggtcgagttctggctctgcctcttgctaaccttcctcgcctatcttccggggatcatctacgcgatctacgccatcaccaaggactagcgcggttccagttgggtgagagctgcaggctcctcttctcagctgtgaagctactactactagctagtctgctaccgattggagaacctgaacctgtcgcttcgttcgtgtccttcgatcgctctctggttatattggtcgtggatc

SEQ ID NO: 1489 - DNA, 825 bp, Pinus taeda
  misc_feature (99)..(99): n is a, c, g, or t
cttttttggctcacttcatacactcactctctttgcttctctgtcttgggtctctcttcacttttctgaaaaagttgtcattatttccgtcataatganggagggcactgcaacctgtgtggacatcttcttggccatagttctgcctcctctgggagtttttttcaaatacggctgccatgctgagttctggatatgtctgctgctcacgatattggggtacataccgggaattatatacgccatctacgccattaccaaggaaaatccatgattttttgggggatgttgatgtaactggggctgctgtctgtgcaaccaaccagatttgattcagcaacaatcctgttctgcagtgttcttcgttattgttattgagcgttcttcattgttaaccataggttgtaatttcttatctatatacacttggcacatgacaaccataggttgtaatttcatatctatatacacttggcacatgactgtacatttacttagtgaacagttctctgtcacatgtatgtttaatgacttccaaaggattatacatataagtttttcaatatcctgtatgtttactcaagtctctgtgtcaacatgtttgtcattggcatattcaacatttgaacattcatgactgtgaaaatggtaaagatgaaaaaattggaaatttttttccaatttggcaaatcacatctgattctccatgttaaactgagattttgtgatttttgtaatgagaatttataattccatggctttgtccttatccaaattggaaaagtcattttctgtcaatatatataagacaagccattttcagtt

SEQ ID NO: 1490 - DNA, 596 bp, Pinus taeda
gtctaaactatgatcccccgggctgcaggtggaattgagattggctggttgtttggtttttgggcgagagtctttacatttctcatctgaataataagattattagtaaaggattatatcaccatcatcatgaaggagggcactgcaaactgcgtagacatctttctggctataattctacctcctctgggagtctttttcaagttcggctgccatgccgaattctggatatgtctgctgttgactttgcttgggtacttaccgggaataatatatgccgtctatgctatcacccagtgatactaagcggtggctgaacacgcttcatttgctttgggatttcatgccatctatttcttctcctcacgtacacagatttggatttctttattcagttgcttcctcatgaacaaaacttatgctgcagcagttgcagctgcatggcgtttctactttattcagttgtttgtatgaaccggtggatttgttattgttaagcggccctcagaaccgctgatgctcttcgtctgcctcctctttttcgcttttcattggcaataaatgaatcataatttgaaataaaaaacaaaaaaaaa

SEQ ID NO: 1491 - DNA, 566 bp, Pinus taeda
ggaattgagattggctggttgtttggtttttgggcgagagtctttacatttctcatctgaataataagattattagtaaaggattatatcaccatcatcatgaaggagggcactgcaaactgcgtagacatctttctggctataattctacctcctctgggagtctttttcaagttcggctgccatgccgaattctggatatgtctgctgttgactttgcttgggtacttaccgggaataatatatgccgtctatgctatcacccagtgatactaagcggtggctgaacacgcttcatttgctttgggatttcatgccatctatttcttctcctcacgtacacagatttggatttctttattcagttgcttcctcatgaacaaaacttatgctgcagcagttgcagctgcatggcgtttctactttattcagttgtttgtatgaaccggtggatttgttattgttaagcggccctcagaaccgctgatgctcttcgtctgcctcctctttttcgcttttcattggcaataaatgaatcataatttgaaataaaaaacaaaaaaaaa

SEQ ID NO: 1492 - DNA, 600 bp, Prunus persica
cttgcactgtaaactctcacaaagttctcatttttccttaaagaagaagaaaaaaagggtcctccacatctacagccatgccgagtgaaggaacagcaaacttcatagacatcctcatagccatcctcttgcctcctcttggcgtcttcctcaagtttggctgccatgttgaattctggatctgtctgttgctgactatttttggttacatccctgggattatctatgctgtctatgccataactaaatgagacttcaatttctgtacgtagagatgtgaagggcacatatgtcttttggtttctgaattatgggattgttttcaacggtttgatggatagtactttatctggtgtatccagatggacggttgatacatcatgtagtgtggttttgtccattgttcatttatttttcttttcttccttttgattttatcctccttccacctccttatcaatctgttgtaaagggtggatggtaggtctggtgattcatgtcccttaaaacattagttatttatttttcaatgtgacttgtgttctaatcccaccctattgggtttggaggtatcagtggctttttgactgcttcatattt

SEQ ID NO: 1493 - DNA, 699 bp, Prunus persica
aaagaagaagaaaaaaagggtcctccatatctacagccatgccgagtgaaggaacagcaaacttcgtagacatcctcatagccatcctcttgcctcctcttggtgtcttcctcaagtttggctgccatgttgaattctggatctgtctgctgctgacttttttcggttacatccctgggattatctatgctgtctatgccatcactaaatgagacttcaatttctgtatgtagagatgtgaagggcacatatgtcttttggtttctgaattatgggattgttttcagccgtttgatggatagtgctttatctggtgtatccagatggacggttgatacttcatgtagtgtggttttgtccgttgttcatttatttttctttcttccttttgattttatcctccttccacctccttatcaatctgttgtaaagggtggatggtaggtctggtgattcatgtctcttaaaacattagttattgattttcaatgtgacttgtgtacgttctaatcccaccctattgggtttgggggtatcagtggctttttgactgcttcatatattattatatgtaacttcagtattaagcaaagagaacatcagaacaacccctccaatcataatccttcttctatctagaattagcatattggttattataaaatttgattagaaaatcccgtattgggttaaaaaaaa

SEQ ID NO: 1494 - DNA, 529 bp, Carthamus tinctorius
gaatatcaaccaaattaataatcccccttccctttggatttggaaacacagagaggcagttttagaagaagatgggtacagcaaccttcatagacataattctggctatcatccttcctccccttggcgtcttcttcaagttcggctgccaggtggagttttggatatgcgtcttgttgaccttgtttggatggatccctggaattatctacgccatttatgccatcaccaagtgattcttatggtgttacaatcacatcaaatggaaatggaaatggaaatggtagcggggggataaacattgaatttggtttcattgctgtgtgcatctttatgtgtcggttaattactattcgtaaatctttttctttttctttttctttttctttttctttttcttttgtttgttgtatgctgtgttgaattattttttttaatgtaaaaatagttgtcggacttgtgtttgtgttatactgattttctcttgctttctttaactgtaaagtagttgccaaactgtctttaatca

SEQ ID NO: 1495 - DNA, 575 bp, Picea glauca
gcaaggataaggattgggattgggattgagtagtgcttctgtgatttgttgggtgtattgatatcttctaatctgataagcttcacagcacaagtttgtattgaatcgccagcatcatgggcactgcaacctgcgtagatatcttgttggccataattcttcctcctttgggagtttttctcaaattcggttgccatgccgaattctggatatgtctgctgctgacgctgcttggatacttaccaggaatactatatgccatctatgccatcacccagtgatattgtaaatgaacataatccaatttctttggattttggtgccatttatatctcctccttatgtacacagaattggatttctttactcagttgttcgtaaatatattataggaatgattggatctgctaccgttaagcagcccctcacgttctaagtttgtttgttttgtttaggagttattggatctgctactgttaagcagagcccctcacaataagtttgtttgttcggtttatttttttcaaataaatgatatttgtttttacagatatccacaatatcatcatgttaca

SEQ ID NO: 1496 - DNA, 612 bp, Helianthus annuus
  misc_feature (434)..(434): n is a, c, g, or t
  misc_feature (438)..(438): n is a, c, g, or t
  misc_feature (440)..(440): n is a, c, g, or t
  misc_feature (450)..(450): n is a, c, g, or t
  misc_feature (457)..(457): n is a, c, g, or t
gcggggatcacaagcaaacctatagagccttctggaatcaaaatcacacacacaaatacacacagtaactgaattcaaagagaagaagatgccgtctgaaggtactcttaactgcatcgacatcatcctcgccatcatccttcctcctctcggtgttttcttcaagttcggttgtcatgtggagttttggatatgcgtgttgctgacgctgttcggatggattcctggagtcatttacgcgatttacgccatcacaaagtgatcatggaccggatcggatcggagtttgtgaatctgtttatctgtttttcgtagtttgttgattttatgttttgatttcatttcagtcgttcgctatgaatattgaatagaattgtggttgtgattaaacgtttgatttgaggtaaaattgagtgaattgtttgttgttatcnaaananaaaataaaanaaaaaanaaacttgtgggccgcgttggcccaacccactctagacccgggcaagtttatttatgggggggctattcccggcaaaatggactgggggttgttttaaaagggctagtccgacccaaactccggggaaccgacctcaaattcgggcttaaaaaaaa

SEQ ID NO: 1497 - DNA, 461 bp, Helianthus annuus
  misc_feature (408)..(408): n is a, c, g, or t
agcaacctatagagccttctggaatcaaaatcacacacagtaacagaattcaaagagaagaagatgccgtctgaaggtactcttaactgcatcgacatcatcctcgccatcatccttcctcctctcggtgttttcttcaagttcggttgtcatgtggagttttggatatgcgtgttgctaacgctgttcggatggattcctggagtgatttacgcgatttacgccatcacgaagtgatcatgaccggatcggatcggagtttgtgaatctgttttctgtttatcgtagtttgttgattttatgttttgatttcagtcgttcgctatgaatattcaatagaattgtggttgtgattaaacgtttgaggtaaaattgagtgaattgttgttatggatgttgtttcgtggngaattgtttactcctcgttaacgtaatttgaatttgaagagtaatttgaaagt

SEQ ID NO: 1498 - DNA, 470 bp, Helianthus annuus
atatcgattacagctaccattcgaattcaatttagaatacaaatacaaacactagccaagtaatccgagttgatcgaagatgccgtcgaatggtacgctaaacttcatcgacatcatccttgcaatcatccttccacccctcggagtgttcttgaagttcgggtgtcgggtggaattctggatatgtgttttgctaactttgttaggatggatcccgggaattatttatgcagtttatgtaatcaccaagtgattcaattattatggatggtggatggacccgcatctgatgctacttgtcaatgttgtcggtgtgttttttagtttgaaatttatgcaacagttattattgtgttccattcatttttgtggtcagtgtgttttttactttggaatttatgtaacagttattgtgttccattcatttttccgttttgtggttgatttttttaatgttatagatattatgt

SEQ ID NO: 1499 - DNA, 556 bp, Panicum virgatum
  misc_feature (131)..(131): n is a, c, g, or t
  misc_feature (381)..(381): n is a, c, g, or t
  misc_feature (517)..(517): n is a, c, g, or t
ggcggcaactgccagttggagaggaacctccccggaggccggagcaagatgaaggagggcacggcgaactgcgtcgacatcctcatcgccatcatccttccccctctcggcgtcctcctcaagttcggctncaaggtcgagttctggctctgcctcttgctcaccttcctcggctaccttccggggatcatctacgcgatctacgccatcaccaagtagtagtatggccgtatgggaacagagcaacacaaggagagaaggatgtaaaattcttaccggtgtcttctagttggagatggattgttgattgtcgtctgtcaagctactgctgagtaccgacgattgagctctagtttcttgcttcctgtccaccgatccctntgatgattatttgcggatcatatatatgacgatacggtgtttcgtgtgagaaattcctgccatttcctgctgtttttctcgcacgcagtggtctctgtaaatatctctgtcgttgttgataataataatgtatctntcttggtgattttggatttggatggttctccatctgcgt

SEQ ID NO: 1500 - DNA, 1928 bp, Hordeum vulgare
gcactcgcagccatgccattcgcaagcttcagcggccgtagacagagcaccggccgggaacggcgtataaattaagagaccatcacccaccaggccaccaccaccgccgcctagacagcgcgcagtggccggcgaatcgacggagctagcagcagcagcctgtatataggcgatgaggacgccggcgacgacgacgctcccctgcgtccttgtccttctcgtcgccgtcgcgtcccgggcgtctgcggcggcgatcaccaagggcgacttccccccgggcttcgtcttcggcaccggctcctccgcttaccagattgaaggtgcggttgcagaggatggaagaaaacccagcatctgggacacattcacacactcaggctactctgccgatggtgccactgctgatgtgactgcagatcagtatcataagtacaaggaagatgtaaagcttttgagtgagatgggcgtcgacgcatacagattttccattgcctggcctcgccttattcctgatggccgaggagctgtcaatccgaagggactgcagtactacaataaccttatcaatgaactcctgagtcatggaattcagcctcacgtgacgatataccatttcgacttccctcaggctcttcaagatgaataccatgggatgcttagtcgtaaattcatagatgactacacagcgtatgcagatgtgtgcttcaagaactttggcgacagggtgaaatactggagcacactgaatgagccaaacattgagcccattggcggatacgatgtaggattccttccaccaaggcgatgctcatcccccttcggcataagttgcgacaacggcaactctaccacagagccctacatagtagctcaccatcttctgcttgcacatgcctcagcagcgtccctgtataaagagaagtatcaggccatgcaaggaggaaaaattggactcacattgctcggctggtggagcgagcctgcgacacaaacacccgaggatatagcagcagctgcaaggatgaatgatttccacattggatggtatatgcatccattggtgcatggagactaccctccggtgatgaggaagaatgttgggtccaggctaccatctttcactgctgaagagctgaagagagtacttgggtcttttgattttgtaggatttaaccactacggtgccgcatatatgaaggctgatcttagcaaactggatcagaagctgagagattacatgggtgatgcagccgtgaaatatgacacattgccatttttgaactcaaagaaccagctcctgtttggactgaaaacgggttttgggtcatcaacaccgtggtctatgaggaaaatactggagcatctccaggtcgaatacaagaatcctgtggtcatgatccatgagaacggagctgccagcattgctgatccctccagtgggaacgcccctgacgacgaattcagattgcagtacctgcaggattacattgaggcgactctccaatccagcaggaatgggtcgaacgtgcagggctactttgtgtggtcattcctggacgtgttcgagtacctcttcggctaccgcatgggctttggcctctacagtgtggacttcagctccatggagaggacgaggtaccagaggcattctgccaagtggttcgccggcttcctccatggtggtgagctcaggccggtggctctgcccggcaaggcctattctcaatgatcttgcacttcttcaggcctccgtagcccacaaagagaaggatgcatgaataagcccggatagttgggtgttatttttggatggaagttgaatttagcttgggcagcaggttttacaggtctctgcttcactggattggattgttcctaatcctatgtatatgtttatgtcgatgtatatgctgaaaatattaatacag

SEQ ID NO: 1501 - DNA, 1902 bp, Triticum aestivum
gaagaagagagaagccaccatcacctccagcctccacgagagagggaccgcggacggagctagcactagcaggcgggccgatcgatgatggcggcggcgaaggcgctctcctccgtgctcctcctcctcctgctcgtcgccgtcgcgactccggaggcggcggcggcgaccatcaccaagcgcgacttccccccgggcttcatcttcggcaccggctcctcggcctaccagatcgaaggtgcggtcgcagaggacggaagaaaacccagcatctgggacacgttcacacactcaggccattctgtcgatggatcgaatgctgatgtgactgcagatcaataccataagtacaaggaagatgtaaagcttttgagcgacatgggcgtcgacgcatacagattttccattgcttggcctcgccttattcccgatggccgtggagctgtcaatccaaagggactggagtactacaacaatcttatcaatgaactcttggctcatggaattcagcctcatgtcacgatatatcatttcgacttccctcaggctcttcaagacgaatacaacgggatgcttagtcgcaaattcatagatgactacacggcgtatgcagaagtgtgcttcaagaactttggcgacagggtgaagtactggagcactgtcaatgagccaaacatagagccgattggcggatatgatcagggtatcctcccaccacggcgatgctcattcccattcggcgccctcagttgcgacaacggcaactctaccacagagccatacatagtagctcaccatcttctgcttgcacatgcctcagcagcgtccctgtataaagagaagtatcaggccaagcaaggaggaaaacttggactcacattgctctgctggtggttcgagcctgcaacacaaacacctgaggatatagcagcagctgcaaggatgaatgacttccacattggatggtatatgcatccattggtgcatagagactacccaccagtgatgaggaagaatgttgggtccaggctaccatctttcaccgctgaagagctaaagagagtgcgtgggtcttttgattttgtcggatttaaccattacggtgccgcttatgtgaaggctgatcttagcaagctggatcagaagctgagagattacatgggtgatgcagccgtgaaatatgacaccgtgccatttttgaactcaaagaaccagctcttgtttgggttgaaaatgggtttcatgtcatcaacagcgtggtctatgaggaaaatgctggagcatctgcaggtcaaatacaagaaccctgtggtcatgatccacgagaatggagctgccagcattgctgatccctccggtgggaacgcccccgacgacgagttcaggtcgcagtacctgcaggattacatcgaggcgaccctccaatccagcaggaacggctcgaatgtgcagggctatttcgtgtggtcattcctggacgtattcgagtacctcttcggctaccgcatgggctatggcctctacggtgtggacttcagctccaaggagaggacgaggtaccagaagcactccgccaagtggttcgccggtttcctccatggtggtgagctcaggccggcggctctgcccggcaaggcctattcccaatgatcttgacacttcttcaggccttcgtagccagcaaagagaaggatgcacgaataagcccggatagttgggtgttatttttggatggaagttgaatttagcttgggcagtaggttttacaggtctctgcttctttggattcgattgttcctaatcctatgtatatgtttatgtcgatgtatatgctgaaaatattaatacattgctacacaaattgtcgggtttagtcattagtctgtgagtgaaatcacatac

SEQ ID NO: 1502 - DNA, 1960 bp, Avena sativa
gcagagacagctagagaccactactaagacgccaccaccacgcagagagcgggggcgagcgagcacgcccgatcagcaggcgatgaggtcggcggcgctctcctgcgcggcgctccttcttctgctcgccgtcgcgtctccggcggcggcggcggcggcgatcaccaggggcgacttcccgccagggttcgtcttcggcaccggctcctccgcctaccagatcgaaggcgcgttcgacgaggacggaaggaaacccagcatctgggacaccttcacgcacgcagggtattctagcgatggatcgaacgctgacgtgactgcggatcagtatcacaagtacaaggaagatgtgaagcttctgagcaagatgggcgtcgacgcctaccggttctccatcgcctggcctcggcttattcccgacgggcggggagctgtcaatccaaaggggctggagtactacaacaaccttattgatgaactcctgagccacggaattcagcctcacgttacgatatatcatttcgacttccctcaggctcttcaagatgaatacagcgggatgcttagccgtaaattcattgatgactacacggcgtatgccgaagtgtgcttcaagaattttggcgacagggtgaagtactggagcaccgtcaacgagccgaacatcgaaccgattggcgggtatgatcagggtatcctcccgccgcggagatgctcgttcccctttggcaccctcagttgcgacgacggcaactctaccaccgagccatacattgtggcgcaccatcttctgcttgcacatgcctctgcggcaaccctgtataaagagaagtaccaggccacgcaaggaggcaaaattggactcacattgctcggttggtggtacgagcctgcgacgcaaacacctgaggatgtagcagcagcggctaggatgaatgatttccacattggatggtatatgcatccattggtgcatggagactaccccccagtgatgaggaagaatgttggatccaggctaccatctttcaccactgaagagctgaagagagtgcgcggatctttcgattatgtcggatttaaccactatattgcagtatacgtgaaggctgatcttagcaagctagatcagaacctgagggattacatgggtgatgcagcagtgacatatgacatgccatttttgaactcaaagaacaagttgctgttcggtttgaaaaccgatttcatgacgtccaccccgtgggctctgaagaaaatgctggagcatctccaggtcaaatacaagaatcctgtggtcatgatccacgagaacggagctgccagcatacgtgacccctctggcgaaattaacaacgacgacgacttcaggtcgcagtacattcaggattacatcgaggcggccctcgaatccagcaggaacgggtcgaacgtgcagggctacttcgtgtggtcgttcctggacgtgttcgagtacctcttcggctaccaaatgggcttcggcctctacggcgtcgacttcaacaccgaggagaggacgaggtacgagaggaactcagccaagtggtacgccagcttcctccgtggcggcgagctcaggccggttgctctgcccggcaaggcctactcccagtgatctttgcacattccaagcttctgctgctggacataggtgatgatgagaatgcacgaataagcctcaaagcctggacagttgggtggtgatatgatagtaattacgttccttgttttcttggatgtacattgatttttgtttggtttcgattgttcctagtatatccatgtcaatgtatgttctgaaaataatactataaaagatatacagatataaagtgtcaaaagttttgtcaataattttgtgttcaaaatcatatactccgaatgtatgatcagagcctgctattttcttcaaatatacggatggccggacatgattcgg

SEQ ID NO: 1503 - DNA, 1057 bp, Pseudoroegneria spicata
cgcaccctcctgcgccgccttctcttctccagcgtcggatctcccccactcgccgccctcaccgcacctccattccccgccccctccaccaccatccctccctccctccacgcgcccgtctatataaggaggaggaccggatgtcggacgcgccggcgagccccccgggcggcggcggcggaggaggaggcggcagcgacgacggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggcaacgctggggtttgaggagtacatcgagcccctcaaggtttatctgcagaagtacagagagacggagggtgatagtaagctagctgggaagtctggcgacgtctctgttaaaaaggatgcacttggtcctcatggaggagcaagtggcacaagtgcgcaagggatgggccaacaagtagcatacaatccaggaatggtttatatgcaacctcagtaccataatggggacatctcaaactgaagatatggaccttctccgtgactgctgctgctctcctaggtgggttttcgtcatgtggagggcactaagcagtcaaggaaggaaacttagtagtacccccattagtctcgtgttgttcggtctgccagaactgatgctccaaggctgcttcccagatgtaaattgctttttcctgagaatagattcagttgtggtttagcatggttgttgttgttgctgttgtctgtatatttattatgatgatttaacagtttagccttgtcgtggctgtcattcggttccatataatttgggtatttgggggagacataactcctccaggtgtagtttgtcctgaactagctgtatcagactctgagaagagttccttttattca

SEQ ID NO: 1504 - DNA, 1095 bp, Triticum aestivum
cgcggccgcgtcaaacgaatcgcacccgcctgcgccgccttctcttctccagcgtcggatcttcccccactcgccgccctcaccgcacctccattcccctccaccaccttccctccctccacgcgctcctctatataaggaggagggccggatgtcggacgaggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggtgatgtctctgttaaaaaggatgcactgggtcctcatggaggagcaagtggcacaagtgcgcaagggatgggccaacaagtagcatacaatccaggaatggtttatatgcaacctcagtaccataatggggacatctcaaactgaagatatggaccatctccgagactgctgctactctgctaggcgggttttcgtcatgtggagagcactaagcagttaaagaaaactcttagtacccccattagtctcgtgttgttgggtctgccagaactgatgctccaaggctgcttcccagatgtaaattgctttttcctgagaatagattcagttgtggtttagcatggttgttgttgttgtctgtatatttatgatgattagcctcgtcgtggctgtcattcggttccatataatctgggtatttgggggagacataactcctccaggtgtagtttgtcctgaactagctgtatcagactcttgagaagagttgcttttagtccttcaccgactcccatgtgctaagatcgctcttgagacaa

SEQ ID NO: 1505 - DNA, 1024 bp, Brachypodium distachyon
ccggttgcggctgtggtgcaggaggaatggcggacgcgccggcgagccccgggggcggcggcggcggaggcgggagccacgacagcggcggcagccccaggggcggcggctacggtggcgtcagggagcaggacaggttcctgcccatcgccaacatcagccgcatcatgaaaaaggccataccggccaacgggaagattgccaaggacgccaaggagaccgtgcaggagtgcgtctccgagttcatctccttcatcaccagcgaggcgagtgacaagtgccagagggagaaacgcaagaccatcaacggcgacgacctgctgtgggcgatggcaactttggggtttgaggactacatcgaaccactcaaggtctacctgcaaaagtacagagagatggagggtgatagtaagttaacttcaaagtctggtgatggttctgttaaaaaggatacacttggtcctcatacaggaacaagtagctcaagtgcgcaagggatgggccaacaagtagcttacaaccaaggaatgggttatatgcaacctcagtaccataatggggacatctcaaactgaaagatacctactctgtgactgctgctgctccgcaaggtgggttttgatttgtcgacattcgctgatatacaccttatggggagcactaagcggtcaaggaacttactacccccattaggttgttgtctgccagtctgccagaactgattctccgaagggtcaaacgctgcatatgccaaggctgcttcacagatgtaaattaggttttcctgagaatagtttcagttctggttctggatcatttctgtctgtatatttatgacgatttggcaattttgccttttggctgtcatttgtttgcataggatttgtattgggggaggcataaatccagtgtaactcatcctaaactagtgtgttagtcttatccgactctgaggagacttgcttcagttgtcataaacaccatgcaaacgtgttctatatgctaagataagaatgtttgccat

SEQ ID NO: 1506 - DNA, 589 bp, Brachypodium distachyon
gaggaatggcggacgcgccggcgagccccgggggcggcggcggcggaggcgggagccacgacagcggcggcagccccaggggcggcggctacggtggcgtcagggagcaggacaggttcctgcccatcgccaacatcagccgcatcatgaaaaaggccataccggccaacgggaagattgccaaggacgccaaggagaccgtgcaggagtgcgtctccgagttcatctccttcatcaccagcgaggcgagtgacaagtgccagagggagaaacgcaagaccatcaacggcgacgacctgctgtgggcgatggcaactttggggtttgaggactacatcgaaccactcaaggtctacctgcaaaagtacagagagacagggtgatagtaagttaacttcaaagtctggtgatggttctgttaaaaaggatacacttggtcctcatacaggaacaagtagctcaagtgcgcaagggatgggccaacaagtagcttacaaccaaggaatgggttatatgcaacctcagtaccataatggggacatctcaaactgaaagatacctactctgtgactgctgctgctccgcaagg

SEQ ID NO: 1507 - DNA, 1159 bp, Panicum virgatum
cgcgcccgcccgggccgccttctcttctccagcgtccgatctcccactcgccgccctcaccgcagctccctccgctcggtcgcttccccacctccgccttccccgcgcgcgcgcgcgcccgccacctcgccctcccttccctccacgtcgcgcgcgcccgcccttatataagtgcgggaggagcgcatggcggacgcgccagcgagccccgggggcggcggcgggagccacgagagcgggagccccaggggcggcgccgggggcggaggcggcggcgtcagggagcaggacaggttcctgcccatcgccaacatcagccgcatcatgaagaaggccatcccggccaacgggaagatcgccaaggacgccaaggagaccgtgcaggagtgcgtctccgaattcatctccttcatcaccagcgaggcgagtgacaagtgccagagggagaagaggaagaccatcaacggggacgacctactgtgggccatggccacgctggggttcgaggactacatagaacccctcaaggtgtacctgcagaagtacagagagatggagggtgatagcaagttaactgcaaaagctggtgatggctctattaaaaaggatgcccttggccatgggggagcaagtagctcagccacacaagggatgggacaacaaggagcgtacaaccaaggaatgggttatatgcaacctcagtaccataacggagacatctcaaactaatgaagatatggaccttttctgcaacagctgctcttacccgagttatttactaagacacccttcagtgagcagttaaagagtagtaaccagccaccccaacaggtccgtttttatcaggcagaactgatgaggcagcttgctaggtgtaaatcgcttccctgggaatagtttcggtttgtgggctagccccgcccttgtatgtatattaagaataatttaatgattggtctttgggctatcatttcgttacatgtatttgtatttggaggcataaatattgtgtaatgtgttcaactagtgtattgaactaccagaagagctgctctagctgtaaccatctttggatatcctgtcttaggcaaaaggagaaattgtggcgtggacaccaaatctatcgtaggtcaagaatatttcagttgctcatattttc

SEQ ID NO: 1508 - DNA, 1058 bp, Cenchrus ciliaris
  misc_feature (940)..(940): n is a, c, g, or t
cacccgcccgggccgccttctcttctccagcgtccgatctcccactcgccgccctcaccgcagctcgctccgctcggtcgcttccccacctccgcctcttcccccccgcgcgcgctcgccacctcgccctcccctgcctccacgtcgcgcgcgcccgcgcttatataagcggtgggtggtggtcctgcacccgcagcgcgggaggaggagcgcgcatggcggacgcgccggcgagccccggtggcggcggcgggagccacgagagcgggagccccaggggcggcggtgggggcggaggtggcggcgtcagggagcaggacaggttcctgcccatcgccaacatcagccgcatcatgaagaaggccatcccggccaacgggaagatcgccaaggacgccaaggagaccgtgcaggagtgcgtctccgagttcatctccttcatcaccagcgaggcgagcgacaagtgccagagggagaagcgaaagaccatcaacggggacgacttactgtgggccatggccaccctgggcttcgaggactacatagaacccctcaaggtgtacctgcagaagtacagagagatggagggtgatagcaaattaactgcaaaagctggcgatggctccattaaaaaggatgcccttggtcatgggggagcaggtagctcagccacacaagggatgggccaacaaggagcatacaatcaaggaatgggttatatgcaacctcagtaccataatgggaacatctcaaactaattgaagatatggaccttttctgcaactgctgctcttacccgagttagttactaaaacaccctgcggtgagcagttaagaatagtaaccagccaaccccccaacaggtccatttttatcaggcagaactgatgaggcagcttgctagggtgtaaatcgcttccctgcggatagtttcggttgngggctagcgccgttgttgtatgtatattaagaataatttaatgattgaaatttcggctgtcatttcgttacatgtatttgtattgggaggcataaatattgtgtaatgtgttaaacta

SEQ ID NO: 1509 - DNA, 1189 bp, Sorghum bicolor
tccctcgcatcgcaccctcgcgggccgccttctcttctccagcgtccgatctcccactcgcctccctcaccgcagctctctctgctcggtcgcttggccccccgtccggcctctcccctgcgcgcgcgctcgccacctcgctctcccctccctacacgtcgcccgtgcccgcgcttatataagtgcaggaggagctcatggcggacgctccggcgagccctgggggcggcggcgggagccacgagagcgggagccccaggggcggcggaggtggaggcggtggcagcgtcagggagcaggacaggttcctgcccatcgccaacatcagtcgcatcatgaagaaggccatcccggctaacgggaagatcgccaaggacgccaaggagaccgtgcaggagtgcgtctcagagttcatctccttcatcactagcgaagcgagtgacaagtgccagagggagaagcggaagaccatcaacggcgacgacctgctgtgggccatggccacattggggtttgaggactacattgaaccactcaaggtgtacctgcagaagtacagagagatggagggtgatagtaagttaactgcaaaaaccggtgatggctcaattaaaaaggatgcccttggtcatgtgggaggaagtagctcagctgcacaagggatgggccaacaaggagcatacaaccaaggaatgggttatatgcaacctcagtaccataatggggatatctcaaactaatgaagatctggaccttttctgcgacagctgctcttccctgagttatttactgagacaccttgcggtgaccattaaagagtaaccagtcacccccggtaggtccaagaactgatgaaggtccaagaactgatgaggcagctttgctaggtgtaaattgcttccctgggaatagtttcggttgtgagctagcgccgttgttgtatgtatattattaagaataactttatgattggtcttttgactgtcattcagatacctgtatttgtattgggaggcataaaatttgtgtaatttgtgttaagactaggtattgaactatgagaagagctgctttagttgtaaccatcattggatgcccgtgtaataggaaaaagaaagatcgtgggcgtgcacaacatatttactgtaggccgtgataattacgcgtattgccgtattttcgtggtccc

SEQ ID NO: 1510 - DNA, 1215 bp, Zea mays
atccctgcatcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcgattaaaaaggatgctcttggtcatgtgggagcaagtagctcagctgcacaagggatgggccaacagggagcatacaaccaaggaatgggttatatgcaacctcagtaccataacggggatatctcaaactaatgaaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacatatttactgttcaccgaaatacttgtattgatgtatttccgcatcaattatagtcatcgtcagcttaactacggcaatgaataaataaaaattcactgagta

SEQ ID NO: 1511 - DNA, 1035 bp, Sorghum bicolor
atcgcaccctcgcgggccgccttctcttctccagcgtccgatctcccactcgcctccctcaccgcagctctctctgctcggtcgcttggccccccgtccggcctctcccctgcgcgcgcgctcgccacctcgctctcccctccctacacgtcgcccgtgcccgcgcttatataagtgcaggaggagctcatggcggacgctccggcgagccctgggggcggcggcgggagccacgagagcgggagccccaggggcggcggaggtggaggcggtggcagcgtcagggagcaggacaggttcctgcccatcgccaacatcagtcgcatcatgaagaaggccatcccggctaacgggaagatcgccaaggacgccaaggagaccgtgcaggagtgcgtctcagagttcatctccttcatcactagcgaagcgagtgacaagtgccagagggagaagcggaagaccatcaacggcgacgacctgctgtgggccatggccacattggggtttgaggactacattgaaccactcaaggtgtacctgcagaagtacagagaggtgcagggtgatagtaagttaactgcaaaaaccggtgatggctcaattaaaaaggatgcccttggtcatgtgggaggaagtagctcagctgcacaagggatgggccaacaaggagcatacaaccaaggaatgggttatatgcaacctcagtaccataatggggatatctcaaactaatgaagatctggaccttttctgcgacagctgctcttccctgaggtgcatatttggtcatagttatttactgagacaccttgcggtgaccattaaagagtaaccagtcacccccggtaggtccaagaactgatgaaggtccaagaactgatgaggcagctttgctaggtgtaaattgcttccctgggaatagtttcggttgtgagctagcgccgttgttgtatgtatattattaagaataactttatgattggtcttttgactgtcattcagatacctgtatttgtattgggaggcataaaattt

SEQ ID NO: 1512 - DNA, 1138 bp, Zea mays
cagccccgcatcgcaccctccctggccgccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataagtgcaggaggagctcatggcggacgctccggcgagccctgggggcggaggcgggagccacgagagcgggagccccaggggcggcggaggtggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcagcaaggaacatacaaccaaggaatgggttatatgcaacctcagtaccataacggagatatctcgaactaatgaagacatggaccttttctgcaacagctgctcttccccgaggcgggtttttggtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatgagaagagctgctttagttgtaagatcacatgacacatccaagaattcccaaaaaaatgttcgt

SEQ ID NO: 1513 - DNA, 1223 bp, Oryza sativa
taccccgaccccttcaatcgcgcccgcctcagccgccttctcttctccagcgtccgatctccccctctcgcctctccgcctcacctccgctccgcttcccacccccgcttcctctctctctcctctccccctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagaggtgcggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctagcgcaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattccc

SEQ ID NO: 1514 - DNA, 1264 bp, Leymus cinereus x Leymus triticoides
  misc_feature (47)..(47): n is a, c, g, or t
  misc_feature (50)..(51): n is a, c, g, or t
  misc_feature (59)..(59): n is a, c, g, or t
  misc_feature (71)..(71): n is a, c, g, or t
  misc_feature (154)..(154): n is a, c, g, or t
  misc_feature (1251)..(1251): n is a, c, g, or t
ccgttgctgtcgccgttgctgtcgcagcagaagagagagagaggagnggnngagacgangacgacgatganggggtggagagaggaggtggtggcgctgtcgctggaggcgcacggccccggcgacgaccggccggagaagccgcgccgctacngggtgacggagatgaggagcccctgctactccttccgccccgcccaccacgcgctccaggaaatattagataatctcggtccttttgttgatggtctgaagttttccggtggatctcatagtttgatgggaaaggaactcatcagagagattactgatttggcacacaagcatgacatgtatgtgagcactggtgattgggcagagcaccttctgcgtcaagggccctcttctttcaagcaatatgtagaggattgcaaagagttaggattcgacaccattgagctcaatgctggatctctcaagctccctgaagaggctatcctgagactagtccgcctcataaagaacactggtttgcgagccaagcccctgttttcagtgaagtttgacagttctgatatccttgcatctggtgatagggcgtttggggcttacatagctccagtgaagcagagctcagaaagagttgaagacgttgacctgttgatcaggagggcggagagatgcctggaggcaggtgcagatatgatcatgatcgacgcggacgatgtctgccagcgtgcagactctctcagagcggacatcatcgcgaagattgtcggccggctcgggctcgagaaaaccatgttcgaaacgtccaatgtcaacacctccgagtggttcgtcaaacgatacggcccacgggtgaacctctttgtggaccactccgaggtgatgaacctggagcgcctccgatgctttgacgggcgcaggagcgtccggcccttgctcccttcgccgttcttcctgatgtgataggacctttgtgagttctgatatgagctgaactgagacataagcgaagtgttgatggagttgagttcgtactggctactgatgtgagttgtgtgaaccgtactgaggacataagcactgtgttgatggagttgtttagttgtggagctgaggcagcgtgttggtagcaactagcaagtacaataaggcgagaccttgtgtgtgtttgctctgggagtaaattgtactgggagcgagtaccgagtagtactacaacttgtttcgtaggtgtgaatgtgatgatccatcttctagagcaanattgccagactga

SEQ ID NO: 1515 - DNA, 1195 bp, Triticum aestivum
gagaggacaacgatgaggggttggagagaggaggtggtggcgctgtcgctggaggcgcacggccccggcgacgaccggccggagaagccgcgccgctacggggtcacggagatgaggagcccctgctactccttccgccccgcccaccacgcgctccaggaaatattggataatatcggcccttttgttgacggtctgaagttttccggtggatctcatagtttgatgggaaaagaactgatcagagagatcaccgatttagcacacaagcatgacatgtatgtgagcactggtgactgggcagagcatctcctgcgccagggaccctcttcgttcaagcaatatgtagaggaatgcaaggagttaggattcgacaccattgagctcaacgccggatctctcaagctccctgaagaggctatcctgagactagtacgcctcataaagaacaacggtttgcgagccaagcccctgttttcagtgaagttcgacagctctgatatccctgcagccggtgatagggcgtttggggcttacatagctccagtgaagcagagctcagaaagagtcgaagacattgacctgctgatcaggagggccgagagatgcctggaggcaggtgcggacatgatcatgatcgacaccgatgacgtgtgccagcgcgctgactctctcagggcggacgtcatcgcgaagatcgtcggccggctcgggctcgagagaaccatgttcgagacatccggtgccaacacctccgagtggttcgtcaaacgatacggcccacgagtgaacctcttcgccgaccactccgaggtgatgaacctggagcgcctccggggcttggacgtgcgcaggagcgtccgccccctgctcccttcgccgttcttcctgatgtgatgacggccttcctgagctcagagcctcggctgagacctaagcgaagcgttgatggagttgagttcctgctggctactgatgtgagttgtgcgaactgtactgagactgagaacctaagcactgtcgatggagtcgtgagttgtggagccgaggccgcgtgttggtagcaactactgtgtgtgtgtgtgtgtgtgtgtgtgtgtgtgtgtgtgtgtgtgtgtgtgtgtgtgtgtgtgtgtttgatgtgggagtaaattgtaccgggagaaactagtacaacttgtttagtactgtgtgc

SEQ ID NO: 1516 - DNA, 1183 bp, Pseudoroegneria spicata
  misc_feature (674)..(674): n is a, c, g, or t
  misc_feature (734)..(734): n is a, c, g, or t
  misc_feature (834)..(834): n is a, c, g, or t
  misc_feature (838)..(838): n is a, c, g, or t
  misc_feature (845)..(845): n is a, c, g, or t
  misc_feature (847)..(847): n is a, c, g, or t
  misc_feature (850)..(851): n is a, c, g, or t
  misc_feature (957)..(957): n is a, c, g, or t
  misc_feature (1003)..(1003): n is a, c, g, or t
  misc_feature (1005)..(1005): n is a, c, g, or t
  misc_feature (1014)..(1014): n is a, c, g, or t
  misc_feature (1038)..(1038): n is a, c, g, or t
  misc_feature (1058)..(1058): n is a, c, g, or t
  misc_feature (1114)..(1114): n is a, c, g, or t
  misc_feature (1136)..(1136): n is a, c, g, or t
ggtggagagaggaggtggtggcgctgtcgctggaggcgcacggccctggcgacgaccggccggagaagccgcgccgctacggggtcaccgagatgaggagcccatgctactccttccgccccgcccaccacgcgctccaggaaatattggataatatcggcccttttgttgatggtctgaagttttccggtggatctcatagtttgatgggaaaagaactgatcagagagatcactgatttagcgcacaagcatgacatgtatgtgagcactggtgactgggcagagcatcttctgcgccagggaccctcttcgttcaagcaatatgtagaggaatgcaaagagttaggattcgataccattgagctcaacgctggatctctcaagctacctgaagaggctatcctgagactagtccgcctcataaagaacactgggttgcgagccaagcccctgttttcagtgaagttcgacagctctgatatccctgcagctggtgatagggcgttcggggcttacatagctccagtgaagcagagctcagaaagagtggaagacgtcgacctgttgattaggagggcggagagatgcctggaggcaggtgcagatatgatcatgattgatgccgacgacgtctgccagcgcgcagactctctcagggcggacatcatcgcnaagatcgtcggccggctcgggctcgagagaaccatgttcgagacatccggtgccaacacntccgagtggttcgtcaaacgatacggcccacgggtgaacctcttcgccgaccactccgaggtgatgaacctggagcgcctccggggcttcgacgtgcggncccngcccctncnccnntcgccgttcttcctgatgtgatgacggttctgatatgagcttcaactgagacctctgatgtgattacggccttcctgagttctgatatgagcctcaactgagaccnaagcgaagtgttgatggagttgagttcctactggctactgatgtgngntgtgtgaantgtactgagaacctaagcactgtngatggagttgtgagttgtgnagccgaggcagcgtgttggtagcaactagcaataaggcgagaacttgtgtggttcnctgtgggagtaaattgtactgngagcaacttatttcgtatgtgtgattgtgaatgcgatgatccatgca

SEQ ID NO: 1517 - DNA, 1291 bp, Triticum aestivum
agaagagagagagagagagagagacgatgagggggtggagagaggaggtggtggcgctgtcgctggaggcgcacggccccggcgacgaccggccggagaagccgcgccgctacggggtcacggagatgaggagcccctgctacaccttccgccccgcccaccacgcgctccaggaaattttggataatatcggcccttttgttgacggtctgaagttttccggcggatctcatagtttgatgggaaaggaactgatcagagagatcactgatttggcgcacaagcatgacatgtatgtgagcactggtgactgggcagagcatcttctgcgccagggaccctcttccttcaagcaatatgtagaggaatgcaaagagttgggattcgacaccattgagctcaacgctggatctctcaagctccctgaagaggctatcctgagactagtccgcctcataaagaacactggtctgcgagccaagcccctgttttcagtgaagttcgacagctctgatatccctgcggctggtgatagggcgtttggggcttacatagctccagtgaagcagagctcagaaagagtcgaagacattgacctgctgatcaggagggccgagagatgcctggaggcaggtgcagatatgatcatgatcgacgccgacgacgtgtgccagcacgcggactctctcagggcggacctcatcgcgaagatcgtcggccggctcgggctggagagaaccatgttcgagacgtccggtgccaacacctccgagtggttcgtcaaacgatacggcccgcgggtgaacctcttcgccgaccactccgaggtgatgaacctggagcgcctccggggcttggacgtgcgcaggagcgtccggcccctgctcccttcgccgttcttcctgatgtgatgacggccttcctgagctctgacatgagcctcagctgagacccaagcgagaagtgttgatggagttgagttcctactggctactgccgtgagttgtgtgaagtgttactgagaacctaagcactgttgatggagttgtgagttgtggagccgaggcagcgtgttggtagcagctagcaataaggcgagaacttgtgtgtgtgcgtaaattgtactcggagtaactagtacaacttgtttcgtatgtactctttccgttctaaaatagatgacttaactttatactaactttagtataaagttagtataaatttgggtcatctatttcggaacgtgatgatccatgtagagcaagattgcctgaattgccgagatgaacac

SEQ ID NO: 1518 - DNA, 1275 bp, Triticum aestivum
  misc_feature (12)..(12): n is a, c, g, or t
caggaattcggnaccagcggcagaagagagagagagagagagagagagagagaggaggagcacgacgatgagggggtggagagaggaggtggtggcgctgtcgctggaggcgcacggccccggcgacgaccggccggagaagccgcgccgctacggggtcacggagatgaggagcccctgctactccttccgccccgcccaccacgcgctccaggaaatattggataacatcggcccttttgttgacggtctgaagttttccggcggatctcatagtttgatggggaaggaactgatcagagagatcactaatttggcgcacaagcatgacatgtatgtgagcactggtgactgggcagagcatctcctgcgccagggaccctcttcgttcaagcaatatgtagaggaatgcaaggagttgggattcgacaccattgagctcaacgccggatctctcaagctccctgaagaggctatcctgagactagtccgcctcataaagaacactggcttgcgagccaagcccctgttttcagtcaagttcgacagctctgatatccctgcagctggtgatagggcgtttggggcttacatagctccagtgaagcagagctcagaaagagtcgaagacattgacctgcttatcaggagggccgagagatgcctggaggcaggtgcggatatgatcatgatcgatgccgacgacgtgtgccagcgcgcggactcgctcagggcggacatcatcgcgaagatcgtcggccggctcgggctcgagagaaccatgttcgagacgtccggtgccaacacctctgagtggttcgtcaaacgatacggcccacgggtgaacctcttcgtcgaccactccgaggtgatgaacctggagcgcctccggggcttggacgtgcgcaggagcgtccggcccctgctcccttcgccgttcttcctgatgtgatgacggccttcctgaggtctgatatgagcttcagctgagacctaagggaagtgttgatggagttgagttcctactggctactgatgtgagttgtgtgaactgtaccgaggacctaagcacttgtgagttgtgtagccgaggcagcgtgatggtagcaactagcaataaggcgagaacttgtgtgtgggagtaaattgtactgggagcaactagtacaacttgtttcgtgtatgtgtgaatgtgaagatccatgtagagcaatgttgcccgttgtgagatgaacacaaagagaacgtgtgcccgggctcctgaaaaaaaaaaaa

SEQ ID NO: 1519 - DNA, 1226 bp, Brachypodium distachyon
aagcttccacctccttcgacgcccttgctctttatcgatcagagagagagagagagggaggggagagagacgacgacgatgaggcggtggagagaggaggtggtggcgctgtccctgcagggccacggctacggccacggcgatgaggccgacgaccggccggagaagccgcggcggtacggcgtgacggagatgaggagcccctactactccttccgctccgcccaccacgcgctccaggaaattttggattctatcggtccttttgttgatggtctgaagttttctggtggatctcatagtttaatgggaaaagaattgattagagagattaccgatttagcacacaagcatgacatgtacgtgagcacaggtgattgggcagaacatcttttgcgtcaaggaccttcttctttcaagcagtatgtacaggaatgcaaagagttgggttttgacacagttgagttgaatgctggatctctcaagctacctgaagaggctatcctgagattagtccgcctcataaagaacagtggtttgcgggcgaagcccctgttttcagtcaagttcgacagttctgatatccctgcatctggtgatagagcgtttggtgcttatacagttccagtaaagcagacctcagaaagagtcgaagacgttgacctgttgataaggagggccgagaggtgcctagaagcaggtgcggatatgatcatgatcgacgctgatgatgtttgccagcgggctgactctctaagagcagacgtcatcgcgaagattgtaggccggctcgggctcgacaagaccatgtttgaaacgtccaacgccaacacctccgagtggtttgtcaaaagatacagtccacgggtgaacctctttgtcgaccactcagaggtgatgaatctggagcgtctccgaggctttgacatgcgcaggagcagtccgtccttgctcacctctccgttcttcctgatgtgacgacctttctcataccagctgagatgagacctgatcaatgtatgtgtgttcaagttgagttgcagtcccgtcaccatcgagtcaggaaccgaggcagcgcgtgctggtagctcgtaatgcgatgatctcagtgtctttccggcggtgtgaactgttgtagtacctggatcatgtgtagtgttggtgtggatgttcatgttgggtggttattgtactaaataaatctgcgaatcagtactcccttgcta

SEQ ID NO: 1520 - DNA, 947 bp, Brachypodium distachyon
gagagagagagagagggaggggagagagacgacgacgatgaggcggtggagagaggaggtggtggcgctgtccctgcagggccacggctacggccacggcgatgaggccgacgaccggccggagaagccgcggcggtacggcgtgacggagatgaggagcccctactactccttccgctccggccaccacgcgctccaggaaattttggattctatcggtccttttgttgatggtctgaagttttctggtggatctcatagtttaatgggaaaagaattgattagagagattaccgatttagcacacaagcatgacatgtacgtgagcacaggtgattgggcagaacatcttttgcgtcaaggaccttcttctttcaagcagtatgtacaggaatgcaaagagttgggttttgacacagttgagttgaatgctggatctctcaagctacctgaagaggctatcctgagattagtccgcctcataaagaacagtggtttgcgggcgaagcccctgttttcagtcaagttcgacagttctgatatccctgcatctggtgatagagcgtttggtgcttatacagttccagtaaagcagacctcagaaagagtcgaagacgttgacctgttgataaggagggccgagaggtgcctagaagcaggtgcggatatgatcatgatcgacgctgatgatgtttgccagcgggctgactctctaagagcagacgtcatcgcgaagattgtaggccggctcgggctcgacaagaccatgtttgaaacgtccaacgccaacacctccgagtggtttgtcaaaagatacagtccacgggtgaacctctttgtcgaccactcagaggtgatgaatctggagcgtctccgaggctttgacatgcgcaggagcagtccgtccttgctcacctctccgttcttcctgatgtgacgacctttct

SEQ ID NO: 1521 - DNA, 1140 bp, Panicum virgatum
gagagagagagagagagagagagagaggggacgacgacggcgacgatgaggggttggcgagaggaggtggtggcgctgtcgctgcgcgggtacggcaacgaggaggacgaccggccggagaagccgcggcggtacggggtgacggagatgcggagccccttctactccttgcgccccgccaaccaggcgctccaggaaatattggattctcttggtccttttgttgacagtttgaagttttctggtggatgctatagtttgatgggaaaagaattgatcagagagattactgatttagcacataagcatgacatatacgtgagcacaggtgactgggcagagcatcttttacgtcaaggaccctcttctttcaagcaatatgtggaggaatgcaaggccttagggtttgacacaattgagctgaatgctggatctctcaagctccctgaagaatctctcctgagattggtccgcctcatcaagagtagcggtctgagggcaaagccactgttttcggtgaagtttgacagttctgatattcctgcatctggtgatagggcgtttggggcgtacatagctccagtcaaggagcggagctcagaaagaatcgaagatgttgacctgttgattaggagggcagagagatgcttggaagctggggcagatatgatcatgatcgatgctgatgatgtctgccagcatgctgactccctaagggcagacatcgttgcaaagatcataggccggctcgggctcgagaaaaccatgttcgaagcttcgaaccccagcacatccgagtggttcgtcaaacgatacggcccaagggtgaatctcttcgtcgaccactcggatgtgatgaatctggagcgcctccgggggttcaacatgcgcagaagcaacccttcctcccgtttcgcctcacccttcttcctgatgtagcgagcttttccttgatcccggagctgagacggttccagtgtccatggagtcatagctccgcgcctctggccgtgcagctttttatggcctcagtgtaactactagcgaccaatgtgctagcatgtgttgtgttataaacaactgctgtaataattggttctatatgcaacagtttgtgttcattgccgtcgttgcaccaga

SEQ ID NO: 1522 - DNA, 1376 bp, Panicum virgatum
agcgagagagagagagagaggagaagggaggacggagtgatagaggcggcgacggcggcgatgaggaggtggcgagaggaggtggtggcgctgtcgctgcgcgggtacggctacggcaacgaggatgatgaccggccggagaagcctcggcggtacggggtgacggagatgcggagccctttctactccttccgccccgccaaccaggcgctccaggaaatattggattctcttggtcctttcgttgacggtttgaagttttctggtggatgccatagtttgatgggaaaagaactggtcagagagattactgatttagcccataagcatgacatatacgtgagcacaggtgactgggcagagcatcttttacgtcagggaccctcttctttcaagcaatatgtggaggaatgcaaggccttagggtttgacacaattgagctgaatgctggatctctcaagctccctgaagaagctctcctgagattggtccgcctcatcaagagtagcggtctgagggcaaagccactgttttcggtgaagtttgacagttctgatattcctgcatctggtgatagggcgtttggagcgtacatagctccagtcaaagagcggacctcagaaagaatcgaagatgtggacctgctgattaggagagcagagagatgcttggaggctggggcggatatgatcatgatcgatgctgatgacgtttgccagcatgctgactccctgagggcagacatcgttgcaaagatcataggccggctcgggctcgagaagacaatgttcgaagcttcgaaccccagcacctccgagtggttcgtcaaacgatacggcccaagggtgaatctcttcgtcgaccactcggacgtgatggatctggagcgcctccgggggttcaacatgctcagaagcaacccttcctcccgtttcgcctcaccgttcttcctgatgtaacgagcttttcctgaaacccggaggtgagacgattccagtgtccatggaattgtagttgcgcgccactggccgtgcagcttactatggcctgtgtaacttgttaccagcgaccaatgagctggcatctgctgtgttatcaacaactgctcaaataattggttttgcatagcaactgtttgtgctcattgccgtcgttgcaccagattgtgttcgacttgctatgttagtgcgtgtgagcgtagctcgggcggctagcgctccgggttgtggaggcagccgatcctggttcgagctcgaccctggatttctactgtagcgtgcgtgcgttgtgagtgttgcagtatgacgtgttccgagactactcggagtctcgtttacgttgagttcggtcaatgtgggcatctaaaatcttacac

SEQ ID NO: 1523 - DNA, 1500 bp, Zea mays
ccacgacacgtcattgccgtggcccagcgctagtttccagaagcagccgcgagcttccaccgccttcttcccgtgcattttctcgagcgacggagcgatccgttcgggccgtccaccacagcgagagagagcggcagaggcgcagagcgcaaccgagcgagagagagaggacggcgacggcggagatgatggggtggggagaggaggtggtggctctgtccctgcgaggctacggctatggcaacgaggaggacgaccggccggagaagccgcggcggtacggggtgacggagatgcggagccccttctactccttccgccccgcaaaccaggcgctccaggaaatattggattctcttagtccattcgttgatggtttgaagttctctggcggatgccatagtttgatgggaaaggagttggttagagagatcactgatctagcacacaggcatgacatttatgtgagcacaggtgattgggcagagcatttgctgcgccaaggaccctcttctttcaagcaatatgtagaggaatgcaaggccttagggtttgacacaattgagctgaatgctgggtctctcaacctccctgaagaggctctgttgagactagtccgcctcatcaagagtagtggtttaagggcaaagccaatgttttcggtgaagtttgacagttctgatattcctgcgtctggtgatagggcctttggggcttacatagctccagtcaaagggaagacctcagaaagagttgaagatgttgacctgctgattaggagggcagagagatgcttggaagcaggcgctgatatgatcatgatcgatgctgatgatgtttgccagcgtgctgaatctctgaggacagacatcatcgccaagattgtaggccggctcgggcttgataaaaccatgtttgaagcttccaactccaacacctcggagtggttcgtcagacgttatggcccaagggtaaatctctttgttgaacactctgacgtgatgaatctggagcgcctccggggcttcaacatgcgcagaagcaactcggcctcccgttttgcctcgccgttcttcctgatctaatgggctaatggccattccccttcctgagatgtggaagatacttctacttgttctcaccctcgcagagcttgttatggcctagagatgtaaccgcctttgttaatgcctcgatgtagcccccagcgagcagcgcatagcacctgttatgttgtcagcgtcgctactgataatcggttctgttggtcaatgctactataataatcggttgtggtgcaagtaatgtgaatagtgtaagagtgttttgtgttccattgcatcggtgagccaggtccttggattcatgtttgtactattgtatgcgtgtgaaatatcggaactttcagtttccagggcatgagagcacgtctccacatgaacttcaaaaattatttggtctcaaaagcaggacaacgccgaaaattgttttttggcacgg

SEQ ID NO: 1524 - DNA, 1524 bp, Sorghum bicolor
cacgtcgtcgccctctcgtttccagaagcagccgcgagcttccactgccttcttcccgtgccttttctcgagcgatccgttctgtccgaccaccacagcgagcaagagagagagagagagagagagagagagagagagcaactgagcaagagagtggacggcgaaggcgacgatgagggggtggcgagaggaggtggaggtggtggctctgtcgctgcggggctacggctacggcaacgaggaggatgaccggccggagaagccgcggcgttacggggtgacggagatgcggagccccttctactccttccgccccgcaaaccaggcgctccaggaaatattggattctcttggtccatttgttgatggtttgaagttttctggaggatgccatagtttgatgggaaaggatttggttagagagatcactgatctagcacacaagcatgacatttatgtgagcacaggtgattgggcagagcatttgctgcgtcaaggaccctcttctttcaagcaatatgtagaggaatgcaaggccttagggtttgacacaattgagctgaatcctggatctctcaacctccctgaagaagctctgttgagactagtgcgcctcatcaagagtagtggtttgagggcaaagccaatgttttcagtgaagtttgacagttctgatattcctgcatctggtgatagggcctttggggcgtacatagctccggtcaaggagaagacctcagaaagagttgaagatgttgacctgctgattaggagggcagagagatgcttggaagcaggcgcagatatgatcatgatcgacgccgatgatgtttgccagcatgctgaatctctgaggacagacatcattgccaagattgtaggccggctcggacttgataagaccatgtttgaagcttccaatcccaaaacctcagagtggtttgtcagacgatatggcccaagggtaaatctcttcgttgaccactccgatgtgatgaatctggagcgcctccggggcttcaacatgctcagaagcaacttgggctcccatgttgcctcgccgttcttcctgatgtaatgggttaatgatcgttcccgtatcctgagctgtgacaagctaagtttctacatggacttgtgagcctcgcacagcttgctatggcctccatgtaaccaccatcgagcaggcatctgttatgttatgagtaacgctactgtaataatcagctctgtggtgtaagtagtgtatgggcgtttgtgttcattgcatcaatgagccagattcttggattcatggttgtgcggttgtatgcgtgtgaatatcggcattttctgtttttcgagcatgagagcacgtctctgcatgaacttcggttatttactggtttcaaaagcaggacacaggtgtacaatagtgaaaatagttttccagctcggacttcatgtttgccgtcatcttgcagctcgttggatcaaaccaacgtggatcaggagctagcaatttgttcttgacatcgaaacaat

SEQ ID NO: 1525 - DNA, 3317 bp, Sorghum bicolor
ttcggcggtccccacgacacgtcgtcgccctctcgtttccagaagcagccgcgagcttccactgccttcttcccgtgccttttctcgagcgatccgttctgtccgaccaccacagcgagcaagagagagagagagagagagagagagagagagagcaactgagcaagagagtggacggcgaaggcgacgatgagggggtggcgagaggaggtggaggtggtggctctgtcgctgcggggctacggctacggcaacgaggaggatgaccggccggagaagccgcggcgttacggggtgacggagatgcggagccccttctactccttccgccccgcaaaccaggcgctccaggaaatattggattctcttggtccatttgttgatggtttgaagttttctggaggatgccatagtttgatgggaaaggatttggttagagagatcactgatctagcacacaagcatgacatttatgtgagcacaggtgattgggcagagcatttgctgcgtcaaggaccctcttctttcaagcaatatgtagaggaatgcaaggccttagggtttgacacaattgagctgaatcctggatctctcaacctccctgaagaagctctgttgagactagtgcgcctcatcaagagtagtggtttgagggcaaagccaatgttttcagtgaagtttgacagttctgatattcctgcatctggtgatagggcctttggggcgtacatagctccggtcaaggagaagacctcagaaagagttgaagatgttgacctgctgattaggagggcagagagatgcttggaagcaggcgcagatatgatcatgatcgacgccgatgatgtttgccagcatgctgaatctctgaggacagacatcattgccaagattgtaggccggctcggacttgataagaccatgtttgaagcttccaatcccaaaacctcagagtggtttgtcagacgatatggcccaagggtaaatctcttcgttgaccactccgatgtgatgaatctggagcgcctccggggcttcaacatgctcagaagcaacttgggctcccatgttgcctcgccgttcttcctgatgtaatgggttaatgatcgttcccgtatcctgagctgtgacaagctaagtttctacatggacttgtgagcctcgcacagcttgctatggcctccatgtaaccaccatcgagcaggcatctgttatgttatgagtaacgctactgtaataatcagctctgtggtgtaagtagtgtatgggcgtttgtgttcattgcatcaatgagccagattcttggattcatggttgtgcggttgtatgcgtgtgaatatcggcattttctgtttttcgagcatgagagcacgtctctgcatgaacttcggttatttactggtttcaaaagcaggacacaggtgtacaatagtgaaaatagttttccagctcggacttcatgtttgccgtcatcttgcagctcgttggatcaaaccaacgtggatcaggagctagcaatttgttcttgacatcgaaacaataatggtaggattatgtagaacagagctgacaagaactatatttctatatactgtctttccactgtggtaatgcaaattttccatgataaaagaacaagaaagtacaagaaagtacaagaaacctaggcacatcatagtgctgcagcgtaggaacaagaatggagacatctgtgctaaacagagatgtttctagtttatatgttggtctgagtctgtcgtatgtttgtagttttgcttttaactatctccgtgtagtgagttatctagggttgtttggtatcaagcaaacattaatcgggcagcagtcacatggacactagctttcagcaatttggatgttgcccaaactgctgatagctagtactacggcagtctgaaatctcttctgaaatctcttcttcatctaatgctagaagctcccatcaaaaccgtgtgatgttcacatgatcagtaaacccttgttcttctgcaaactaagctcccatcaaaaccgtgtgatgttcacatgatcagtaaacccttgttcttctgcaaactgtaagatgttccaagaaattctgcatgttctggaactatatatatcaatcagaaggctatggagggatatcaaaaaagtaaactcctaaatatcctcctcaggcagctaagagaaaggacccagctcactgtgaaaatactgatcattaacgaaagacctaaagtgctcatgctgaactctgcattcccttttgaatattccctttgaactctccaataatacagatcattaaggaaatgcctaatgtgctcatgtctgaattcctatttgaatattgtctttcccctttgaaaacataaatcgcatctgaaaaatgagggacattacaaaaggacatcctagtaggaaaaaaaaagaatttgcacgatccaccaaatgaattgttctaacagcactagttctcatgcttggcaggtcaaaagcacttcggcagctactgcaaatggaaaaaggcctcatcattatcatcaccaatccaccaaataaaatgtgtaaattgtttgtaactgtaatcacagataccggctctgtggaccgattgagatacagcccacaggttcctataaacatgtgaaatgtggacaccactctgtataggcctaatcatagcatcaccagtcaatgcccacagctactggagacgtggcatcaggctcataaaaaaatcagaacagtacatataaacaagatgctttatgtagtaatcacacaaagacaagattaaagcactcaccctagtggtcatccaacaatggaaaaaccactggccatacaattataagcaaagtgaggaatgttggacatcgggatgcacacacggtttgagaaggcaatgaatgcatgataacttattccatcctcactattggcaacgtacagcactgaatgtgctacagaaaagcacatcagagactctaatttgttgcctctcaagacacaatatgaccagtgataattattgaagcctcaaaacaagaaatattaacatcagttacagggtaaacatgctgaatatgcaaatgggacaaacagctcagaaaatcctgatggctcagttcagcgggatattcggcatacaggttaatctcatctaaagagattgacatgtgatttggtctgttgagcttgaatattaccaagtcgtcactgccatcactcctaaattcatttatcaaggtatcaaaccaaacaaaattcagatttagttacattcacaagattgcctgtcctgcaacaat

SEQ ID NO: 1526 - DNA, 1191 bp, Saccharum officinarum
gagtgagagagagagagcggcagaggcgcagagcgcaaccgagcgagagagtggacggcgacggcgacgatgagggggtggcgagaggaggtggaggtggtcgctctgtcgctgcggggctacggcaacgaggaggatgaccggccggagaagccgcggcggtacggggtgacggagatgcggagccccttctactccttccgccccgcaaaccaggcgctccaggaaatattggattctgttagtccatttgttgatggtttgaagttttctggaggatgccatagtttgatgggaaaggagttggttagagagatcactgatctagcacacaagcatgacatttatgtgagcacaggtgattgggcagagcatttgctgcgtcaaggaccctcttctttcaagcaatatgtagaggaatgcaaggccttagggtttgacacaattgagctgaatgctggatctctcaacctccctgaagaagctctgttgagactagtccgcctcatcaagagtagtggtttgagggcaaagccaatgttttcagtgaagtttgacagttctgatattccagcatctcgtgatagggcctttggggcgtacatagctccagtcaaggagaagacctcagaaagagttgaagatgttgacctgctgattaggagggcagagagatgcttggaagcaggtgcagatatgatcatgatcgacgctgatgatgtttgccagcgtgctgattctctgaggacagacatcgtcgccaagattgtaggccggctcgggcttgataaaaccatgtttgaagcttccaaccccaatacctcagaatggtttgtcagacaatatggcccaagggtaaatctctttgttgaccactcggacgtgatgaatctggagcacctccggggcttcaacatgggcagaagcaacttggcctcccgtttcgcctcgccgttcttcctgatgtaatgggctaacgaccattcctgtatcctgagctgtgacagttacgtttctacatggacttgtgagcctcgcacagcttgttatggcctcgatgtaaccaccagtgagcagcggcatagcatctgttatgttatcagcaacgctactgtaataatcagttatgtggtgtaagtggtgtatgtgtgtttgtgtttcattgcatcgatgagccagatccttggattc

SEQ ID NO: 1527 - DNA, 1217 bp, Saccharum officinarum
  misc_feature (1127)..(1127): n is a, c, g, or t
  misc_feature (1153)..(1153): n is a, c, g, or t
cgtttggtccgaccaccacagcgagagagtgagagagagagagcggcagaggcgcagagcgcaaccgagcgagagagtggacggcgacggcgacgatgagggggtggcgagaggaggtggaggtggtcgctctgtcgctgcggggctacggcaacgaggaggatgaccggccggagaagccgcggcggtacggggtgacggagatgcggagccccttctactccttccgccccgcaaaccaggcgctccaggaaatattggattctgttagtccatttgttgatggtttgaagttttctggaggatgccatagtttgatgggaaaggagttggttagagagatcactgatctagcacacaagcatgacatttatgtgagcacaggtgattgggcagagcatttgctgcgtcaaggaccctcttctttcaagcaatatgtagaggaatgcaaggccttagggtttgacacaattgagctgaatgctggatctctcaacctccctgaagaagctctgttgagactagtccgcctcatcaagagtagtggtttgagggcaaagccaatgttttcagtgaagtttgacagttctgatattccagcatctcgtgatagggcctttggggcgtacatagctccagtcaaggagaagacctcagaaagagttgaagatgttgacctgctgattaggagggcagagagatgcttggaagcaggtgcagatatgatcatgatcgacgctgatgatgtttgccagcgtgctgattctctgaggacagacatcgtcgccaagattgtaggccggctcgggcttgataaaaccatgtttgaagcttccaaccccaatacctcagaatggtttgtcagacaatatggcccaagggtaaatctctttgttgaccactcggacgtgatgaatctggagcacctccggggcttcaacatgggcagaagcaacttggcctcccgtttcgcctcgccgttcttcctgatgtaatgggctaacgaccattcctgtatcctgagctgtgacagttacgtttctacatggacttgtgagcctcgcacagcttgttatggcctcgatgtaaccaccagtgagcagcggcatagcatctgttatgttatnagcaacgctactgtaataatcagttntgtggtgtaagtggtgtatgtgtgtttgtgtttcattgcatcgatgagccagatccttggattc

SEQ ID NO: 1528 - DNA, 1154 bp, Gossypium hirsutum
cattatctcatctcagtcgtctcctctttcctcttttctccagcgttcgatcccctctctttcttcccctcaagtaatccaatccccatctctcccgcccttttttttcctttttatttttttatatataatatatatatttcaattttcatttctactaagggttttgtccatggcggaagcactggcaccggcgagtcccggcggaggaagccacgagagtggcgagcagagcccgaaatcgaatgtgcgagaacaggatcggtttctacctatagctaatatcagccgtattatgaagaaggctcttcctgctaacggcaagatcgctaaagatgctaaggagactgtacaagagtgcgtctctgagtttatcagcttcatcactagcgaagctagtgataagtgtcagagagagaagaggaagactattaatggggatgatctgctctgggctatggcgactttagggtttgaggattacattgatccgcttaagatttacctttcccgatacagagagatggagggtgatgctaagggctcggctaaaggtggagatgcgtctgctaagaaggatgtccaaccaggcccaaatggccagcttgttcatcaaggttcattctcacaaggtgttaattatgggaattctcaagcccatctgatgcttccgatgcaaggcactgattagtgatcactgatcaccgttctgcaaattccattatctatatccagtaattatcgtgtttcggctctgcaacaaatagtttccaggcatccatctgatatggaggaccgacatcatggatggtatgcatactctttatcttgtaagctattattttctagtaatatttgtctctatcagatgttctttggaatagattcattttttgttttcaaagaattgtgtaaatcttgtcagattattatcgtaggtttaacgacgtcatttaggtaaacctgtttgtgctacttaaatgttcatccaatttttataatggctttggaaccaaatataagattgttttttttttttttttttttttttttttctttcgcaggccccattaaaataaatttaaaaaaaaaaaatttttcaaaaacattttttgcaaaaaaaaaaaccggaattcgggggccaaaaaaacttt

SEQ ID NO: 1529 - DNA, 1042 bp, Trifolium pratense
  misc_feature (524)..(524): n is a, c, g, or t
gagaacgaacggtggtgataggtctccttctctcatctcaatcgtctcctccttcctctcttttccagcgtccgattcccactccattcttcccgatctcatcttaatcacacaccaacacgcgccaaatacaaatttattcagggttccgccgatatgtccgaagctccggcgagtcctggcggtggtagccacgaaagcggcgaacacagtcctcgttctaacatccgtgaacaagataggtttcttccaattgctaacatcagtcgtatcatgaaaaaagctcttcctgctaatggcaaaattgctaaagatgctaaagaaactgttcaggaatgtgtttctgagttcataagcttcattactagcgaggcctctgataagtgtcagagagagaagaggaagacgattaacggcgatgatttgctttgggctatggctactctagggtttgaggattatattgatcctcttaagatttaccttacaagatacagagagatggagggtgatactaagggctntgctaagggtgacacatctgctaagaaagatgttcaacaaggttccaaccctcagcttgctcatcaaggttctttttcacaaggagttttttatgcaaatgctcagggtcaacatatgatggttcctatgcaaggcccagaataggtaataagccaattgacctgcttacggcggttgttgtgtttacagtgctggtagagctttactgaatgttctcggcataattgaatgtattttatgttatattaataccgacataagacacattagttcttgtgtcctgatttttttaaattaaggtttgtatattatgtctggagtgaaattattatttcaaagttacatttgtaagtgttggagccatgttagtttgattccttctggcggcttggcaaaggctgtagaatttaggtaactgattgtaagcataattgttttcctttttaaagcttatttgggtgtacaatcatggatgaagatggtttgagtatttaaaatacatttgttagacatttgg

SEQ ID NO: 1530 - DNA, 1048 bp, Carica papaya
tccttcaaatcaaaccactctctccatatccttcttacgattctctctctccagaaaaattttctttcgcttttgagtgaacctagggtttctgtttatggatttgcgaatcttccttattgttgttattgtggttatgcaggttttgggagatggcggagcagcaggctcagggacaaggggcgccggcgagccccggtggtggaagtcacgagagcggcgaccatagtccgagatcgaacgtgcgcgagcaggataggtacctgcctattgctaacatcagccgaatcatgaagaaggcacttcctgctaacggcaagattgcaaaggatgctaaggagaccgtccaggaatgcgtttctgagttcattagctttatcaccagcgaggcaagtgataagtgccagagagagaagaggaagacaattaatggggatgacttgctttgggccatggtgactttaggtttcgaagattatattgatccactcaaggtttacctcactagatacagagagatggagggtgacacaaagggatctgcaaagggtggtgattcatccattaagaaagatgttcaaccaagttcgaacacacagcttgctcatcaagcctctttctcacaaggtgttaattatggaaattcccaatcgcaggcgcaacatcttatggttcctatgcaaggcacagagtagaatctgctcctccagcttattttattacttaatcccattcaagaagcttgtttagtgcccacagcaaatattgtatccaaatcttgatatggttcgctgctgacgtcctagacagtttctgtcctctggttgagtccgcaggttcattactggtaaagttatgtatattatactttataggatgaaaatttgaagtgctgtacatcttgggaggatttcttttcctaggatttgtagacgggcactttgcaagccatctaatactctgttctgaaactgcatgttcaatatcactttgaatatgattttggacaatgtaaggatgaatggactggaagtatttgttttgccca

SEQ ID NO: 1531 - DNA, 1018 bp, Phaseolus coccineus
gggggttgttgtgtaataaaagaaaacgaacggtggtgataggcttcaatctaaatctcaatcgtcaccaccttgctttcttctccagcgtccgattccctcaccgatctcgcgccaaatacaaactaattcataccatcacagggttccggcgaacatggccgacggtccgtccagtccgggaggcggcagccacgagagcggtgagcacagtccccgctctaacgtgcgcgagcaggacaggtacctccccatcgctaacataagccgcatcatgaagaaggcgctccctgctaacgggaaaatagccaaagacgccaaagagactgttcaggagtgcgtctctgagttcatcagcttcatcaccagcgaggcctctgataagtgtcagagagagaaaagaaagactattaacggggacgatttgctctgggcaatggctacccttggtttcgaggattatatcgatcccttgaagatttacctcacaagataccgagagatggagggtgataccaagggctcagccaagggtggagagacctctgctaagaaagatgttcaaccgaatcctaatgctcagcttgctcatcaaggttctttttcacaaggtgttagttacacaaattctcagggtcaacatatgatggttccaatgcaaggtccagagtagttgtcaagtctattttccctcctgttctaatgtaatatctacgctggttagcaagtcctcacgacatattgaatatgttaatgttatgtgcatactgacataggagatctttgttcttgtgtccagatatttttttttttctgaattaaggtttgtatattatctatggagtcgaattattatttgaaagttattatattgtaaatcctagagtcgtgttgtctgaatacattaggcgggcttggcaaagactgagattttaggactgattgtaagcataaatcggaatattcttttccttttcttgtacaataatgtatgaagaagagtcgagcttcttctgtt

SEQ ID NO: 1532 - DNA, 996 bp, Medicago truncatula
gtggtgataggtctcattctgtaatctcaatcgtcctcctccttcctttcttctccagcgtccgattctctctccattcttaccgatctacgctcgcgccaaatacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatgagggtgatactaagggctctgccaagggtggagacacatctggcaagaaagacgttcaacaaggttctaatcctcagcttgttcatcaaggttctttctcacaaggtgtttcctacacaaattctcagggtcaacatatgatggttcctatgcaaggtccagagtaggtaataagccaattgatcttctcacagtggttgcggtgttttcagttcggtgctggtagagctttactaaatgccgtcggcataattgaatgtatttcatgtaatgttaatactggcataagacacattggttcttgtgtcctgattttttttctctctaaaattatggtttgtatattatgtgtggagtaaaattatttatttcaaagttacatttgtaagtgctggacccatgttagtcttgattccttctggcggcttggcaaaggcttaagaatttaggtagctgattgtaagcataaattggtatattttttcgatccttattttggtgtacaataatggatg

SEQ ID NO: 1533 - DNA, 952 bp, Castanea mollissima
ctcattctctcatctcagtcgtctcctctcttctctcttctccagcgtccgatcctccatttcccaactccatccaaagcctctccctctctcgcgcccatttttctttattaagtgcttttgcgatggcggaagttccgacgagtccgaacggaggcagctacgacgagagcggcgatcagagcccgcgctccaacgttcgcgagcaggaccggtttcttccgatcgcgaacattagccggatcatgaagaaggcgctacccgccaacggaaagatcgccaaggatgccaaggaaaccgtccaagaatgcgtctctgagttcatcagcttcatcaccagcgaggctagcgataagtgccagagagagaagaggaagactattaatggagatgatttgctttgggctatggctactctagggtttgaagactacatcgatccgcttaagatttacctcgccagatacagagagatggagggtgacaccaagggatcagcaaagggtggagaatcatctgctaagaaagatgttcagccaagtccaaatgctcagattgctcatcaaggttctttctcacaaggtgttaattacgcaacttctcaatctcaggcacaacatctgatgattcctatgcaaggctcagattagatttctgctcgatgtttactaattccaccatttggcgtcctgcttgaggagatcttgttcagtgcccacaacaaatatttattctcatgtgaacactgacattttagggtttttgggcactattgtgcaatccatatgtattctaggtatggtttgtatatttaggggtgtctttcgattaaaatatttattttaagaaaacattgtaaatcttgggtcctgtgatttctttactgggtgttttggcaatatgttatggagctgattatgaaactgtttttcatttttttgccatattaaaa

SEQ ID NO: 1534 - DNA, 1063 bp, Cucumis melo
ctcctgaatttgccctgaaaaagggaaaaacaaaaaacgaacggtgctgataaacttgattctctcatctcagtcgtctcctttctcctatcttcaccatcgtccgattccattccaccactccatttccacccgatctaaatccttctctctcgcgcccaaattacaaatcttccgttttctcccaccagggttttggtgaagatggctgatgctccggcgagtcccggcggaggaagccatgagagcggtgagcagagtccgaggtctaatgttcgcgaacaggataggtttcttcctattgcgaatattagtaggatcatgaagaaggctcttcctgctaatgggaagattgctaaggatgctaaagaaaccgtacaagaatgtgtatcggagtttatcagttttattactagcgaggcaagtgataaatgtcaaagagagaaacggaagacgattaatggtgatgatttactttgggccatggccactcttggatttgaggattatatcgatccacttaaaacctacttgacgaaatacagagagacggagggtgacactaaggggtctgctaaaggtggtgatgggtcagctaagaaagaagctcatccaacccctattcctcagatggctcatcaagggtcgttttcccaaggagttaattatgcaagttctcaatcacaagcccagcatctgatggtccctatgcaaggtactgactgaaattgcctcaaatcgaccatgtaaactgttgaatttggagatctttgttcagtataacagcaaaatttgagtctatttatttaaagtttgggtggttttgatacttttaattgtagaaacagttgcaactttgtatattattatggctgtctattggattggaaggtaggacacagtatttgatagaggttccaagtcctggggatcgcatttattcatgcttgtaaaccttacaacctttgcaaggtcttgtaggtcttgaaaaagacttggtagcagtagcaccctctggattttttttagaatcattttcctaatcaaaagaataaattgtggc

SEQ ID NO: 1535 - DNA, 987 bp, Populus trichocarpa
tctctctctctctccctctctaaattatcttcctctgattgctgttttgatcaatcaattatgattattggtggtgagttagggttttcgatatggcggcagaggcaccggcgagtccagggggaggaagccatgagagcggagaccaaagtcctcgctctaattctaatgtacgtgaacaagacaggttcttaccgatcgcaaatatcagtaggattatgaagaaagcgctacctgctaatggaaagattgctaaggatgctaaagagactgttcaagaatgtgtttctgagttcattagctttatcactagcgaagcaagtgataagtgtcagcgagaaaagaggaagacgataaatggtgatgatttgctttgggctatggctacgttagggtttgaggattatattgatcctcttaagatttacctgtctcgatacagagagggtgataccaagggatctgcgaagactggagatacatctgctaaaaaggatattcaccctggtccaaatgcgcagatttctcatcaaggttctttctcacaaggtgttagttatggaaattcaaattctcaagctccgcacatgatggtccctatgcaaagcaacgagtagatatgtgctcttttacaatgaattctgtcatttagaaggtattgaatttctcatccagttcctagaaccaatagtgtttcaaaacataaaacattggtatggtgtaagcactgacagcttgagtggtttttattcacttgttgtatcctgggttgtttccggtaagatttgtataatttgggtatctatcggaggtagaatgactcttgaagcattgtaaataatgggaacttgtaacttgtgtcttgatttttagaatgggtacttggcaagggtatgtcactctgttcttatatataaaaccggggcatcttttaatgatgcggtgattttattcatactatgttaatgctataattggtttgaacgg

SEQ ID NO: 1536 - DNA, 1059 bp, Cucumis sativus
ctcctgaatttgccctgaaaaagggaaaaacaaaaaacgaacggtgctgataaacttgattctctcatctcagtcgtctcctttctcctatcttcaccatcgtccgattccattccaccactccatttccacccgatctaaatccttctctctcgcgcccaaattacaaatcttccgttttctcccaccagggttttcgtgaagatggctgatgctccggcgagtcccggcggaggaagccatgagagcggtgagcagagtccgaggtctaatgttcgcgaacaggataggtttcttcctattgcgaatattagtaggatcatgaagaaggctcttcctgctaatgggaagattgctaaggatgctaaagaaaccgtacaagaatgtgtatcggagtttatcagttttattactagcgaggcaagtgataaatgtcaaagagagaaacggaagacgattaatggtgatgatttactttgggccatggccactcttggatttgaggattatattgatccacttaaaacctacttgacgaaatacagagaggtaggtgacactaaggggtctgctaaaggtggtgatgggtcagctaagaaagaagctcatccaacccctattcctcagatggctcatcaagggtcgttttcccaaggagttaattatgcaagttctcaatcacaagcccagcatctgatggtccctatgcaaggtactgactgaaattgcctcaaatcgaccatgtaaactgttgaatttggagatctttgttcagcataacagcaaaatttgagtctatttatttaaagtttgggtggttttgatacttttcattgtagaaacagttgaaactttgtatattattatggctgtctattggattggaagttaggacacagtatttaatagaggtttcaagtcctggggatcccatttattcatgcttgtaaaccttacaaccttggcaaggtcttgtagatcttgaaaaagacttggtagcagtagcaccctttggatttttttttagaataattttcctaatcaaaataataaattgtg

SEQ ID NO: 1537 - DNA, 1500 bp, Prunus persica
  misc_feature (1125)..(1125): n is a, c, g, or t
  misc_feature (1245)..(1245): n is a, c, g, or t
  misc_feature (1265)..(1265): n is a, c, g, or t
  misc_feature (1295)..(1295): n is a, c, g, or t
  misc_feature (1298)..(1298): n is a, c, g, or t
  misc_feature (1316)..(1316): n is a, c, g, or t
  misc_feature (1319)..(1319): n is a, c, g, or t
acggaatctatctctctctttctttctctctcatctctcaaatacaaaaataaaaagctaggcaaatccagagagagagcccccaaaaaagaaaaccaacggtgctgataaacctcactctctcatcccactcgtctcctctctcctctcttctccagcgtccgatcaaattcccccacaaatctgagtctctcgcgccaaataaaagccctctaaatacaaacagggtttccatggccgaagctccgggaagtccaggcggcgggagccacgagagcggcggcgaccagagcccgcgctcgaacgttcgggagcaggatcggtatctcccgatcgctaacattagtcggatcatgaagaaggcgcttcctgctaatggcaaaatcgccaaggacgccaaagagaccgtgcaggaatgcgtttccgaattcatcagcttcatcactagcgaggcgagtgacaagtgccagagagagaagaggaagacaattaatggcgatgatttgctctgggcaatggctactttgggctttgaagattatatcgacccccttaaggtttacctcactagatacagagagatggagggtgacaccaagggttcagggaagggtggagattcatcttctaagaaagatgctcagccaagttcaaatgctcagatttctcgccaaggttctttctcccaaggagggaattactcaaattctcaaagccaacatatgatggttcctatgcaagggacagagtagatccagtcgtcttgtcgatgcaataatttagctgcctatttaaggagatcatattcggtgcccggaacatattaaattatttctctagtcaatgacataatgtgtgagtattagagctctgtgtcccgtcgtattctctgttgtgtaagtttaggagtttcttcgagttgaatgtctctctcatgagatggtattgtaagcctcaggaggatccttcattcttctcatctgtaacatgtgtcatggcatgtgttaatcaaactgattaggaaatttattcccttcaaatttctatgttatattattatttagtccgttttacgcggaattggaacgacaggtaaaaaaaaaaaaaaaaaaaaaaaactgagcngttctctgtcaatgaacttgctgcgcttgtcacaaaagcgggagaaaagcttggacttgatgtgcaaaccacatctgtgccaaacccaagagttgaagcagaggagcactactacaatgncaaacacaccaaacttatcnagttgggacttaaacctcaccttctctcanacnctcttttggattcattgntcnattttactatcaagtacaaggatcgtgttgacacaaagcaaataatgcccagtgtttcttggagaaaaatgggggctaagccgagaactgttacagcgtagttgagtggggtagtgtaaatgtgataaatagttgtatacgtgtttgaggacgttatagatctgcattgcctttgcctctg

SEQ ID NO: 1538 - DNA, 993 bp, Populus trichocarpa
tctctctctctccccctctccaaattctcttcctctgattgctgttttgatcaatcaattatgattattggtggtgagttagggttttcgatatggcggcagaggcaccggcgagtccagggggaggaagccatgagagcggagaccaaagtcctcgctctaattctaatgtacgtgaacaagacaggttcttaccgatcgcaaatatcagtaggattatgaagaaagcgctacctgctaatggaaagattgctaaggatgctaaagagactgttcaagaatgtgtttctgagttcattagctttatcactagcgaagcaagtgataagtgtcagcgagaaaagaggaagacgataaatggtgatgatttgctttgggctatggctacgttagggtttgaggattatattgatcctcttaagatttacctgtctcgatacagagagatggagggtgataccaagggatctgcgaagactggagatacatctgctaaaaaggatattcaccctggtccaaatgcgcagatttctcatcaaggttctttctcacaaggtgttagttatggaaattcaaattctcaagctccgcacatgatggtccctatgcaaagcaacgagtagatatgtgctcttttacaatgaattctgtcatttagacggtattgaatttctcatccagttcctagaaccaatagtgtttcaaaacataaaacattggtatggtgtaagcactgacagcttgagtggtttttattcacttgttgtatcctgggttgtttccggtaagatttgtataatttgggtatctatcggaggtagaatgactcttgaagcattgtaaataatgggaacttgtaacttgtgtcttgatttttagaatgggtacttggcaagggtatgtcactctgttcttatatataaaaccggggcatcttttaatgatgcggtgattttattcatactatgttaatgctataattggtttgaacgg

SEQ ID NO: 1539 - DNA, 857 bp, Euphorbia esula
  misc_feature (84)..(84): n is a, c, g, or t
ctcctatctcctctcttctccagcgtccgatcccttctctttcatctccctccaatcctctttcaagggtttcgcgatggcagncgaggcaccaccagcgagtcccggcggaggcagccacgacagcggtgatctgagcccccggtctcacggcaacgtccgtgaacaggataggttccttcctattgctaatattagccgtattatgaagaaggctcttcctgctaatggtaagatcgctaaggatgctaaggagactgtccaggaatgtgtgtctgagttcatcagcttcatcactagcgaggcgagtgataagtgccagagggaaaagaggaagacgattaatggtgatgatttgttgtgggctatggcgactttaggatttgaggattacattgatccactgaagatttacttgacccgatacagagagatggagggtgataccaagggatcagcaaagggaggagaaacgtcccttagaaaagatgttcaacagagtccaaatgtccagatgtcttaccaaggctccttctcgcaaggagtgaatcattcaaattctcaagtccagcatatgatggttcccatgcaaggtacagagtaaacatttgctttgctccccttcaataaatactttaatatgtcgttcccttccgaacaagtatgcattgtggattgttcttattcaattgtttgtctagaggtattttctcctaatgtttgtataattagggtacgttttgaagtagaaattacagtttatattgtatattatcattggaagatctaactgacaaggatctatctttatcctgtgatgaattgtctagaaaatttcatatgaatctcttcctttc

SEQ ID NO: 1540 - DNA, 653 bp, Lotus japonicus
ctcctccttactttcttctccagcgtccgattcctctctctccactctcaccgatctcatctcactcactcgctctctctcgcgccaaatacaaattcacagattagggttccgtccaccaccatgtccgacggtccaaccagtccaggcgccggcggcagccacgacagcggcggcgaccacagccctcgctccaacatccgcgaacaagacaggtaccttccaatcgccaacatcagccgcatcatgaagaaagctctccccgccaatggcaaaatcgccaaagacgcaaaggagactgttcaagagtgcgtctccgaattcatcagcttcatcaccagcgaggcctctgataagtgtcagcgagagaagaggaagacgattaacggtgacgatttgctctgggcgatggcgacgctcggtttcgaggattatattgatccccttaagatttacctcaccagatacagagagggtgatactaagggttcaggagcaaaaggtggagattcatctgccaagaaagatgttcagccgagtcctaatgctcagcttgctcatcagggttctttctcacagagtgttagttacacgaattctcagggtcaacatatgatggtccaaatgcaaggcccagagtaagcaataaatct

SEQ ID NO: 1541 - DNA, 997 bp, Medicago truncatula
  misc_feature (92)..(92): n is a, c, g, or t
  misc_feature (968)..(968): n is a, c, g, or t
gtggtgataggtctcattctgtaatctcaatcgtcctcctccttcctttcttctccagcgtccgattctctctccattcttaccgatctacnctcgcgccaaatacaaacataatattcagggttccgacgatatgtccgaaactccggcgagtcctggcggcggcagccacgaaagcggcgaacacagtcctcgttccaacatccgtgaacaagaccgtttccttcctatcgccaacatcagccgcatcatgaaaaaagctcttcctgctaatggtaaaatcgctaaagatgctaaggaaaccgttcaggaatgcgtctccgagttcatcagcttcatcaccagcgaggcctctgataagtgtcagagagagaagaggaagacgattaacggtgatgatttgctttgggcgatggctactttagggtttgaggattatattgatcctcttaagatttaccttacaagatacagagagatggagggtgatactaagggctctgccaagggtggagacacatctggcaagaaagacgttcaacaaggttctaatcctcagcttgttcatcaaggttctttctcacaaggtgtttcctacacaaattctcagggtcaacatatgatggttcctatgcaaggtccagagtaggtaataagccaattgatcttctcacagtggttgcggtgttttcagttcggtgctggtagagctttactaaatgccgtcggcataattgaatgtatttcatgtaatgttaatactggcataagacacattggttcttgtgtcctgattttttttctctctaaaattatggtttgtatattatgtgtggagtaaaattatttatttcaaagttacatttgtaagtgctggacccatgttagtcttgattccttctggcggcttggcaaaggcttaagaatttaggtagctgattgtaagcataaattggtatattttttcnatccttattttggtgtacaataatggatg

SEQ ID NO: 1542 - DNA, 1079 bp, Glycine max
atccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcaacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcacaataatgtatgaagaaggctcgagcttcttttata

SEQ ID NO: 1543 - DNA, 1006 bp, Glycine max
tgttgtgtaataaaagaaaacgaacggtggtgataggcttcaatctaaatctcaatcgtcaccaccttgctttcttctccagcgtccgattccctcaccgatctcgcgccaaatacaaactaattcataccatcacagggttccggcgaacatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagggtgatacgaagggttcagccaagggcggagactcatcttctaagaaagatgttcagccaagtcctaatgctcagcttgctcatcaaggttctttctcacaaggtgttagttacacaatttctcagggtcaacatatgatggttccaatgcaaggcccggagtaggtatcaagtttattaaccctcctgttgtaacgtatgttttccacgccagttaccaagtgctcacggcatattgaatgtctttttatgttatgtgaatactgacataggagatggttcttgtgtcctttttttttaaaaaaaaaagtaaggtttgtatattatctttggagtcgaattattatttgaaagttattatattgtaaatcctagagccctgttgtctgaatccatcaggcggcttggcaaagaccgagattttaggactgattgtaagcataaacccgaatattcttttcctaatttctttgtgcaataatgtatgaaaaaggctcgagcttcttttta

SEQ ID NO: 1544 - DNA, 899 bp, Nicotiana tabacum
  misc_feature (823)..(823): n is a, c, g, or t
ggggagagttagaagttagaaccaaaccaacggtgttgatagggcaaactccaaaactctgccttcatctcagtcgtctccctttttcccactttctccagcgtccgatcttcccttttctccttcaatctttcattcccctctcctcgcgcccaaattacaaatccccaggtatggcggatggtcaaggatcgtcaaggtcaccagcgagtccaaacggaggaggaagtcacgagagcggtggagaccaaagccctaggtctaatgtacgtgaacaggacaggtttcttcctatcgctaatattagtcgaatcatgaaaaaggcgcttcctgctaatggaaaaattgctaaagatgctaaggagactgttcaggaatgtgtttccgagttcattagcttcattaccagcgaggcaagtgacaagtgccagagagagaaaagaaagactattaatggtgacgatttgctatgggcaatggcaactctaggttttgaagattatattgagccactcaaggtgtaccttgctcggtacagagagatggagggtgacacaaagggatctgccaagactgctgatgggtctgctaaaagagatgggatgcaacctagtcctagttcacagcttgcacatcaaggttcattctcgcaaggaatgaattatggaaactctcagggacagcacatgatggtcccgatgcaaggaacagagtagaatcagttcttcactctgcttttggacttaaaacatgttctatatatagatcctctgcagtaagctctgtatcatggttgatttattttagggctctcaagtcaggnccatatgctatttaagtttgtaaatttaggagatgtcaagtaaagacctgattgttggtagtaattaacaagaacc

SEQ ID NO: 1545 - DNA, 1473 bp, Panicum virgatum
ccaccagtccaccaccgcaagctcgaggggccggcaggggaagcgcgagctcatcggctgagccgcagatggttccgcggctgcgggaggcttagcgtcggcgatcgaggacaggacgcggcgtgccacatgttgagcgcgcagacggcggctagcaccagcagcagcggcgtcgtcgtcgagcgggagaggagcgtcgtcgtcgagcaggagaggcggcggcagccggtgggggaggacgaggacgaggaggaggaggagccggagttcagggacatccacgcgctgagcccgccgccgagccagccgccgtcgtaccgcagggggcgcggggagtcgtgggggtccgccgcgggcgggagcaggcacacgtcgatccgctccgtcgggagcgacaccgcccccagcgagcccttcccgactatgagcagggagttctcggccatggtcgccgcagcagccaccgccaacgccgccagcgccaacggggccgggagcgatgccgagagggacgccgacgcgatgggcaggatcggggagggcgaggagctggaggagaccaacccgctggccatcgtgccggacagcaaccccatcccgtcgccgcgccggggcccgccgacccccggcgcggacgcggcgctggccggcaccggcgcccacggccagggccaggccggggtgtcggtcgggcaggtgaagaaggaggaggtcgagtccaagatcgccgcgtggcagatcgccgaggtggccaaggtcaacaaccgcttcaagcgcgaggaggtcgtcatcaacggatgggagggcgaccaggtcgagaaggccagcgcctggctcaagaagtacgagaggaagctggaggagaagcgtgccaaggcgatggagaaggcgcagaacgaggtggccaaggcgcggcggaaggcggaggagaagcgcgcgtcggcggaggccaggcggggcaccaaggtggcgcgcgtgctggagctcgccaacttcatgagggccgtcgggagggcgccctccaccaagcgctccttcttctgaatccctcccggcctcgtcgtcttcagtcagaacttcctcagcctggtgctcgtcgccgccggtgcactcgttttgttggattggatcgttcaccgcttcactacacgggatcagacagagtgatcagtgccgtgctagctgtgtggaacgcttgttttagtgttgtgtccacatgtatgatttgtaatgttatttctctctttttttcccctgttttgtgctttgtatggtattgcaaggtcgatggccaggacagacagggaacagtacacatgtcataagaaggatgtgctctgcctgagtcttgagggcaagagctgcctgtgttttcttgcaaatttcttttcatgaaggatcgtgtatgtcaatatgaacaagatatcaagtgaattaccgctctgtaaatttgcttatatgcttagattgagc

SEQ ID NO: 1546 - DNA, 3035 bp, Saccharum officinarum
cccacgcgtccggtgctctgaagtccgagccccttcatacacatcgtctcgtctccgatttttccccaaaatctggtcgcaggcgctacaggatccaggcaccactcggtcggcggctgccgcgtcgtcccgcccgctcgattgcggtcgcgtgtgcgataggaagttcgtcatacgcctcgcggtttttctagtttctgttttgatatctctatgcgcccaatgttttgtccgattgatcgatctgcttaggtatgcgagattgtttcgattgctcgtgagtgcgcgtggatgatgatcgctcgataatgtctgattgtttagatctgtgactagtcgctcgacttgattgtgctgactgattgtttcatctgtcgtgtaagctgtattcaatgtctatctaatcccttaattgctttgaaaccactgcatgtgcttgattaatttggtttgttaccgacagcttttggtgcctatttgtgatgagattgaacattctgctgcttgtgtttaatcctctaggttcgtgttctttatgtatgcatgattaatggttggctggtacttcgtttcaaaaaaaaaatggttggctagtacttctctgatgcgtggggatgatggttttcaagatgcctatcagctagtgatggactagaatttaacatttccctgtgccaaagtagttccctatgttctgtcgaaagcagcacactctgcagtattgctgcatatattttccgtcaaaaaaatatttgctacatatgcataccgcatttttttttcatctctccttgtggcacaatactacatcaattgacttcctctgttggccgacctttgcatatatcatcagtgagcagaaaaatagctattctttggctaaattaaagagaagtatcactcaatattagcagcgtaatgggggaacatatcatcttctggctgaattccgctatgtgccccagctatacacagatgagaacgggaaggagcagtttgtggactactggcaggctattgatttctgtattccttgggaaagaattgggaagcacatttttcttatacagggtgtgtaatcactggtgatatgagatggtctctattcgcttaggaagtagagataggttaaatttcaggtctgaacggtgaaaccttaaataaaatcttaggatgctgtgtgaaagaagcatgctggtttcctcgaaggtatgtctgatcgaagaatcaatggactgaaaatctcttatggatagaagtgcttattaactaaagatttggaagatgaagctgatgtctgctggagagaatggtgtggacaacgcggtaaatttggtgcagatggatgctgtgttcaaattgattggagttctctggatcgatacctatcgagtagtataattcctctctcagctcactgtccagataactagtgctatctgtgactattgggtaatcaagttatcgagattttgctggttggagctgtccggcgttgctttcatcttttgtcaatatgctcggtcttcagcagcatatggcgttccagaactgtgtgcagtggtttcctcgaatttaggaccttcgactgcattctgtattgagaacaatcctgctaaatacatgatacttgcaggtattgtgttgtttgcaacgtgatagcttgtaccggtaaaaaaaggtcaagatgggcgccttggacctacatcctgagtttgcttctgctcaacatggacaagccaagctaaatgtggaggaatatgccaagggctctttgctgtctgatggaaactacaatacagagaagatcaatggttcaaaccctgatgactatgagaaatttgagaaagggataatgcagtatgggtgtccacattatagaaggagatgccgcataagagctccttgctgcaatgaaatttttgattgccgacactgccacaatgaaactaagaattccattaaaattgaaaaaatgaagaggcatgaacttccacgccatgaagtgcagcaggttgtatgctcattgtgtggcactgaacaggaggtacagcaagtatgcatcaattgcggtgtttgcatggggaagtacttctgtggattgtgcaaactctttgatgatgatgtctctaaacagcagtatcactgcaacggatgtggaatatgtagaatcggagggcaggataatttcttccactgttcaaaatgtggatgttgctattcaattgcgctgaagaatagtcatgcatgtgttgaaggggcgatgcatcatgactgtccaatctgctttgagtacttgttcgagtcgacaaatgatgtttctgtcctgccttgtggtcataccattcatgtgaagtgcctgaaagaaatggaggagcactgccagtttgcatgccccctttgctccaagtcggtttgtgacatgtcgaaggcatgggagagactcgacatggagctggcaactctgtctgactcctgtgatgataaaatggtccgcatattatgcaacgactgcggggcaatatcagaggtgcagttccatttgattgcgcacaagtgccagaattgcaagtcatacaacacccgccagatctgaagtaagaattgcagtcacacaacaccgtcagatctgaagtaacaaatccttgtggggtttctgcattcttcaagaagcgtgatggctccttcccgtgggctgctgagcactgggatatctggcaagactccactgggtcctgcggaggcaaacagctcgagattatttatctgctgctagctgccgtccttcattatgcatcgtagtctactaggtcctcttgccccttaactcctgtcgttctgtgattctagtgtgataatgttatatttcctgttgcttcaagattgtagcattggagttcgtagatgagataattgttcaagctttgtagctggaattggttcatgaaggtgcctttgttgagcaaggaagagaggtcttggttgcgggtagctactagctaggcaagtgtggtagatgtgcacctgtgttggta

SEQ ID NO: 1547 - DNA, 3039 bp, Sorghum bicolor
gaatcgcagtcactgctctgaagtccgaaccccttcatacccatcgtctcgtctccgatttccccaaattcaggccgcaggcgctacaggatccaggcaccacgcggtcggcggctgccgcctcgtcgtcccgcccgctcgattggggtcgcgtgtgcgataggaagttcgtcatacgcctcgcggtttttctagtctctgttttgatttctatgcgcccaatgttttgtccgattgatcgatcttcttaggtacgtgagatcgtgtcgattgctcgtgagtgcgcgtagatgatgatcgctcgataatgtctgattgtttagatctgtgactatttgcgcgacttgattgtgccgactgattgtttcatctatcgtgttagctgtattaaatgttgaatcccttaattgctttgaaaccactgcatgtgcttgattaatctgttttgtactgacagcttttggtgcctatttgtgaattgtgatgagattgaacattctgctgcttgtgtgtaatcttctatgcatggttaatggttgactagtacttctctggtgcgtggggatgatggttttcaagatgcctatcagctattggtggactagaatttaacatttccctgtgcggaagtagtcccctatgttgtgtcgaaagcagcacactctgtggtaaccaatattgctgcatatattttccgtccaaaaaaatatttgttgcatatgcatactttgctttttcatctctccttgtggcacaatactacatcgattgaagagaagtatcactcaattttagcactttatgggggaacctatcatcttctggatgaattccactatgtgccccagccatacacagatgagaatgggaactgggaaggagcagtttgtggactactggcaggctattgatttctgtattctttgggaaagaattgggaagggcatttttcttatacaggttgtgtaaccactggtgatatgagatgatctctattcgcttgggaagtagagataggttaaatttcaggtctgaatggtgaaaccttaaataaagtcttaggatgctgtgtgaaagaagcattgctggtttcctcgaaggtatgtctgatcaaagaatcgatggactgaaaatcacttatggatagaagtgcttattaactaaagattttgaagatgaagctgatgtctgctggagagaatggtgtggacaacgcggtaaatttggtgcagatggatgctgtgttcaaattgattggagttctctggatggatgcctatcgagtagtataattcctctctcagctcactgtccagataattagtgctatctgtgactgttgggtaatcagattgtcgagattttactggttggagctgtccggcattgctttcatcttttgtcaatatgcccggtcttcggcagcatgtggcgttccagaactgtgcgcagtggtttcctcgaatttaggacctccgactgcattctgtattgagaacaatcctgctaaatgcatgatatttgcaggtattgtgttgtgtttgcaacgtgatagcttgtaccgtaaaaaaagatcaagatgggcgccttggacctacaccttgagtttgcttctgctcaacatggacaagccaagctaaatgtggaggaatatgccaagggctctttgctgtctgatggaaactacaatacagagaagatcaatggttcaaatcctgatgagtatgagaaatttcagaaagggataatgcagtatgggtgtccacattatagaaggagatgccgcataagagctccttgctgcaatgaagtttttgattgccgacactgccacaatgaaactaagaattccattaaaattgataaaatgaagaggcatgaacttccacgccatgaagtgcagcaggttgtatgctcattgtgtggcactgaacaggaggtacaacaagtatgcatcaattgtggtgtttgcatggggaagtacttctgtggattgtgcaaactctttgacgatgatgtctctaaacagcagtatcactgcaacggatgtggaatatgcagaattggagggagggagaatttcttccactgttcaaaatgcggatgttgctattcaattgctctgaagaatagtcatgcatgtgttgaaggggcgatgcatcatgactgtccaatctgctttgagtacttgttcgagtcgacgaatgatgtttctgtcctgccttgtggtcataccattcatgtaaagtgcctcaaagaaatggaggagcactgccagtttgcatgccccctttgctccaagtcggtttgtgacatgtcgaaggcatgggagagactcgacatggagctggcaactctgtctgactcctgtgatgataaaatggtccgcatattatgcaacgactgcggggctatatcagatgtgcagttccatttgattgcgcacaagtgccagaattgcaagtcatacaacacccgccagatctgaagtaagaattgcaagtcacacgacaccgtgagatctgaagtaacaaagccttgtggggtttctgcattcttcaagaagcgtgatggctccttcccgtgagctggtgagcactgggatatctggcaagactccactgggtcctgcggaggcaaacagctcgagattatttgtctgctgctagctgccatccttcattatacatcttattagcctactaggtcctcttgccccttcactcctgtcgctttgtgattctagtgtgataatgttatatttcctgttgcttgaagattgtagcatcggagttcgtagatgagataattgttcaagctttgtagctggaattgattcatgaaggtgcctttgttgagcaaggaagagaggccttggttgcgggtagctactggctaggcaagctttgtagatgtgcacctgtggttggttgtacggcaaaccggatctcctatttcccgtgttttatagtgttcttgtgttattttactccctccggcccaataaagtccaaatattgaaggtgcaactatgttttt

SEQ ID NO: 1548 - DNA, 3032 bp, Sorghum bicolor
gccgaatcgcagtcactgctctgaagtccgaaccccttcatacccatcgtctcgtctccgatttccccaaattcaggccgcaggcgctacaggatccaggcaccacgcggtcggcggctgccgcctcgtcgtcccgcccgctcgattggggtcgcgtgtgcgataggaagttcgtcatacgcctcgcggtttttctagtctctgttttgatttctatgcgcccaatgttttgtccgattgatcgatcttcttaggtacgtgagatcgtgtcgattgctcgtgagtgcgcgtagatgatgatcgctcgataatgtctgattgtttagatctgtgactatttgcgcgacttgattgtgccgactgattgtttcatctatcgtgttagctgtattaaatgttgaatcccttaattgctttgaaaccactgcatgtgcttgattaatctgttttgtactgacagcttttggtgcctatttgtgaattgtgatgagattgaacattctgctgcttgtgtgtaatcttctatgcatggttaatggttgactagtacttctctggtgcgtggggatgatggttttcaagatgcctatcagctattggtggactagaatttaacatttccctgtgcggaagtagtcccctatgttgtgtcgaaagcagcacactctgtggtaaccaatattgctgcatatattttccgtccaaaaaaatatttgttgcatatgcatactttgctttttcatctctccttgtggcacaatactacatcgattgaagagaagtatcactcaattttagcactttatgggggaacctatcatcttctggatgaattccactatgtgccccagccatacacagatgagaatgggaactgggaaggagcagtttgtggactactggcaggctattgatttctgtattctttgggaaagaattgggaagggcatttttcttatacaggttgtgtaaccactggtgatatgagatgatctctattcgcttgggaagtagagataggttaaatttcaggtctgaatggtgaaaccttaaataaagtcttaggatgctgtgtgaaagaagcattgctggtttcctcgaaggtatgtctgatcaaagaatcgatggactgaaaatcacttatggatagaagtgcttattaactaaagattttgaagatgaagctgatgtctgctggagagaatggtgtggacaacgcggtaaatttggtgcagatggatgctgtgttcaaattgattggagttctctggatggatgcctatcgagtagtataattcctctctcagctcactgtccagataattagtgctatctgtgactgttgggtaatcagattgtcgagattttactggttggagctgtccggcattgctttcatcttttgtcaatatgcccggtcttcggcagcatgtggcgttccagaactgtgcgcagtggtttcctcgaatttaggacctccgactgcattctgtattgagaacaatcctgctaaatgcatgatatttgcaggtattgtgttgtgtttgcaacgtgatagcttgtaccgtaaaaaaagatcaagatgggcgccttggacctacaccttgagtttgcttctgctcaacatggacaagccaagctaaatgtggaggaatatgccaagggctctttgctgtctgatggaaactacaatacagagaagatcaatggttcaaatcctgatgagtatgagaaatttcagaaagggataatgcagtatgggtgtccacattatagaaggagatgccgcataagagctccttgctgcaatgaagtttttgattgccgacactgccacaatgaaactaagaattccattaaaattgataaaatgaagaggcatgaacttccacgccatgaagtgcagcaggttgtatgctcattgtgtggcactgaacaggaggtacaacaagtatgcatcaattgtggtgtttgcatggggaagtacttctgtggattgtgcaaactctttgacgatgatgtctctaaacagcagtatcactgcaacggatgtggaatatgcagaattggagggagggagaatttcttccactgttcaaaatgcggatgttgctattcaattgctctgaagaatagtcatgcatgtgttgaaggggcgatgcatcatgactgtccaatctgctttgagtacttgttcgagtcgacgaatgatgtttctgtcctgccttgtggtcataccattcatgtaaagtgcctcaaagaaatggaggagcactgccagtttgcatgccccctttgctccaagtcggtttgtgacatgtcgaaggcatgggagagactcgacatggagctggcaactctgtctgactcctgtgatgataaaatggtccgcatattatgcaacgactgcggggctatatcagatgtgcagttccatttgattgcgcacaagtgccagaattgcaagtcatacaacacccgccagatctgaagtaagaattgcaagtcacacgacaccgtgagatctgaagtaacaaagccttgtggggtttctgcattcttcaagaagcgtgatggctccttcccgtgagctggtgagcactgggatatctggcaagactccactgggtcctgcggaggcaaacagctcgagattatttgtctgctgctagctgccatccttcattatacatcttattagcctactaggtcctcttgccccttcactcctgtcgctttgtgattctagtgtgataatgttatatttcctgttgcttgaagattgtagcatcggagttcgtagatgagataattgttcaagctttgtagctggaattgattcatgaaggtgcctttgttgagcaaggaagagaggccttggttgcgggtagctactggctaggcaagctttgtagatgtgcacctgtggttggttgtacggcaaaccggatctcctatttcccgtgttttatagtgttcttgtgttattttactccctccggcccaataaagtccaaatattgaaggtgcaa

SEQ ID NO: 1549 - DNA, 2235 bp, Pennisetum glaucum
cgttcctttatgtgccccacttacacacatgagaatggaactatagaaggaacagtctgtggattactggcagactactcatttctgtattccttgtgagagaattagggagggaatttctcttatgcaggtcgtgtaaatactgggttaccggtgatctgagacggtctctattcagttgggaagtagatataggttaaatttcaggtctgaaccagtgaaatctcaagtagaaccttaggatgatgtgtgaaagaggcatgctggttttctccaaggtttttctgttcgaagaatcaacagattcaatatctcgtatggatagaagtgcttattaactagagactttggagatgaagctggtgtcttctggagagaacgggggtggacaacacggtaaatttggtgcagatggactgctgtgttcgaattgcttgggagttctctggagtctggatggatacctatcgagtagtattttccccttcgactcactgtccagatagttagtgctatctgtgattgttgggtgatcagtttatcgagattttgctgctggagctgtttggtgttgctttcaccttttgtgatgcccggccttcggcagtacatggcattccagatccgtgcacagtggtttcattgaatttaggacctccgactgcattctgtattgagaacaatcttgctaaagacatgatacttgcaggtatttgtgttgtgtttgcaacgtgatagctttcagcggttaaaaaacagtaaaaaaatggtcgctttagacctgcaccttgagtctgctgctgcccaacatggacaagccaagttcaatgtggaggaatatgccaagggctcttgtctgtctggaggaaattacaaagaagagaaggtcgatggtccagatgctgatgattatgagaaatttgaaaaagggataatgcagtatgggtgtccacactacagaaggagatgccgcatacgagctccttgctgcaatgagatttttgattgccggcactgccacaacgaagttaagaattccattaaagttgatacaatgaagaggcatgaacttccacgtcatgaagtgcagcaggttatatgctcattatgtgatacagaacaagaggtacggcaagtatgcatcaattgtggtgtatgcatgggaaagtacttctgtggatcgtgcaagctcttcgatgatgatgtttctaaacagcagtaccactgccatggatgtggaatatgtagaattggaggcagggagaatttcttccactgctcaaaatgtggatgttgttattcagttgtgctgaagaatagtcatgcatgtgttgaaggagcaatgcatcatgactgtccaatctgctttgagtacttgttcgagtcgacgaatgatgtttctgtcctgccttgtggtcataccattcatgtaaagtgcttgaaagaaatggaggagcattgccagtttgcatgcccactttgctcgaagtcagtttgtgacatgtccaaggcgtgggagagacttgacatggagctagcaactctgtccgattcttgtgacgacaaaatggtccgcatattatgcaacgactgcagagcaatatcggaggtgcagttccatctgattgcgcacaagtgccagaattgcaagtcatacaacacccgccagatatgaagaaaatgattatttgattcttatgcggtttctgcattcttcaagaagcgcaatggccaatggctcctctcagcgcgccccgctgagcccacggacatctaccgggactcctacattgggtgcttctgcagaggcaaatctcactcgagattatctgtgtgctgtttgctgccctcattgattatgcctcttcagcatgtcgccgtaaagctgttgggtgcttcagcctagttgcttctgcagctctggttacagtgggtcaatgttgtatttcccgtcgcttcaagattgtatcgcctgaggttcagttcaggtcctggatgagatagctgctcaagcttgtagttggaagtcggtttatgcatgtgtctgtgttgggcaaggatcagagtctgtggtttggcaccaatttttctagattttccatgttattatagtgctgttcttggtgttccaaggtggtctttgtaatttgaaggaactactttgctgctggttattcagcttgcagcttcatcggtcgaaaaatcctcgataggtccatttttacctttttaaaa

SEQ ID NO: 1550 - DNA, 3066 bp, Panicum virgatum
cagctacgaaaccttcccaccccaaccccatcgtcctcgtctccgagttccccaaatccacatcccgcaggcgctgcaggatccggcctcctctcggtcggcgcccgccgccgcggcgtcccgccccgctcgattgggtcgcgtgtgcgataggaagttcgtcatacgcctcgcggtttttctagtttctgttttgatttctgtgcgcgcttaaatttgtgttccgattgatcgatctgcttaggtacgtgagattgttttgattgcttccgggtgcgcgtaggtgatgacgagctgataatgtctaattgctctgatttgatttgcggtgactaattgctcacttgaatgcgtattgtgatgacttattgtttgatttacttttcgtgtgcacggtggaacatcagtacccttggcgattgattggtcgtgcgatctgtataaaatgtccatcccctttatcgttttgaaacaactgcatgtgcctgattcgtttggtttgtaccgacagcgttgggtgcctacttgagatgatattgaagattctgggggttgtgttctaggtttgtggtaatgttatgtgcatggttgatggttagccagtagttctcagataatgggctagaatttaacattgccaaggactccgtgcctttagaagttcagaacttatgtactgtcctaagcagcgcattctgcgacttccataaccaatatttactgcatatgattttcgtcaaaaatgtttgatccatatgcataccacacttctgtttgctctatcatctcttgtggcacaacactacgccattttacatccttgatttggctgtcctttgcaaataccgttgagcacaagtcgattgcaattctttcgctaaattaaagagaagtatacgttttagcaacgtaatgggggaaactatcatcttctggacgaattcctttatgtgccccagttgacgagaatttgagaagcagtttgtggactgctcacaggctattcatttctgtactccttgtgagagaattaggcagacatttctcttatgccggtcatgtaaaactgggtcactggtgatgatctctgttcagttgaaagtagagataggttaaatttcaggtctgaattgatgaaatctcaagtagaaccttaggatgatgcacgaaagagcatgctggttttctccaaggtacttctgatcgaagaatcaatggattgaaaatctcttatgggtagcagtgcatgttaagtaaagatttcgaagatgaagcagatgtctgctggagagaatgggggtggacaacgcggtaaatttcgtgcagatggatgttcgattgcttgggaattctctggagtctggatggataccaatcgagtagtattattcccctctcagctcactgtgcagatagatagtgctatctgtgactgttgggtgatcagtttatcgagattttgctggttgaagatgttcggcgttgctttcatcttttgtgatgcctggtcttcagcagtatatggcattccagaactgtgcggagtggtttccttgaatttaggatctcccactgcattctgtatcgggactcgggagcaatcctgctaaatacatgatatttgcaggtatttgtgttgtgtttgcaacgtgatagctttcagcgataaaaaaacagtcaagatgggcgcattggacctacaccttgagtctgcttctgctcaacatggacaagccaagctaaatgtggaggaatatgccaagggctctttggagtctggtggaaattacaaaaaagagaagatcaatggttcagatcctgatgattttgagaaatttgagaaaggaataatgcagtatgggtgtccacactacagaaggagatgccgcatacgagctccttgctgcaatgagatctttgattgccggcactgccacaatgaagttaagaattccattaaagttgatacaatgaggaggcatgaacttccacgccaggaagtacagcaagttatatgctcattatgtggcaccgaacaagaggtacgacaaatatgcatcaattgtggagtatgcatggggaagtacttctgtggattgtgcaagctctttgatgatgatgtttctaaacaacagtatcactgcaatggatgtggaatatgtagaattggagggagggaaaatttcttccactgctcaaaatgtggatgttgttattcaattgtgctgaagaatagtcatgcatgtgttgaaggagcaatgcatcatgactgtccaatctgctttgagtacttgtttgagtcgacaaatgatgtttctgtcctgccttgtggtcataccattcatgtgaagtgcttgaaagaaatggaggagcactgccagtttgcatgcccactttgctccaagtcagtttgtgacatgtccaaggcgtgggagagactcgacatggagctggcgactctgtccgattcttatgatgacaagatggtccgcatattatgcaacgactgcggggcaatatcagaggtgcacttccatttgatcgcgcacaagtgccagaattgcaagtcatacaacacccgccagatatgaagaaagggattcttatgcggtttctgcattcttcaagaagcgtgttcttcaagaagcgtgacggcgcctcttgcgtgagctgctgagctctcgggacggggatcccatatcatcgggtgcagtttcaggctttcagcgaaggcgaatcacttgagaattgagattatctatctgtgctattagctgttgtccttgattgcgcctctttagcctgttagctgttactctaggtgcttccgcctgtttacttctgttgtctgtggttccggtgtattggttataattcctcgcttgaagattgtgtcctcggaggtcctagctgagataaatgcccaagcttgtagctggaagtcgattcatgtaggggtctctgttggcaggatgagagaggtttgtggttgcacggcaaatatgtggctctcctacattttccgtatatttaattctttatattaccagattttgctcttcgttt

SEQ ID NO: 1551 - DNA, 3092 bp, Panicum virgatum
gccgcgtcgtccggccccgctcgattgggtcgcgtgtgcgataggaagttcgtcatacgcctcgcggtttttctagttttctgttctgattcctgtgcgcgcgcttaaatttgctctgttctgattggtcgatctgcttaggtacgtgcgattgttttgattgcttgcgggtgcgcctagatgctgatgagctgataaatgtctacttgctctgattttggtttgcggtgactaattgctcggcttgattgcggattgtgatgactgattgttcgatttacttttggtgtgcacggtggagcatcagtacatttggcgcttgattggtcgtgcgatctgtataaaatgtccatcccctttatcgttttgcaacaactgcatgtgcctgattcttttggtttgtaccgacagcgttgggtgcctacagcctacttgagatgatattgacgattctggggttgtgttctaggttcgtggtaatgttgtgtgcatggtccgatacctgggataatggttccccgatgcctatcagcgattgattatgtacctagatattgggctagaatttaacagtgccaaggactctgcgcctttagaagttcagaacttatatactgtcctaagcaatgcattctgcgacttccataaccaatatttactgcatatggtttctcgtcagaaatgtttgctccatatgcataccacacttttgtttgctctatcatctcttgcggcacaacactatgccattttacatccttgatttggctgtcctttgcaaataccggtgagcacaagttgattgcagttccttcgctaaattaaagagaagtatacgttttggcaacgtaatgggggaacctatcatcttctggacgacttcctttatgtgcctacagagtcgagaatttgaaggagcagtttgtggactgctcacaggctattcgtttctgtactccttgtacaagaattagggagagcatttctcttatgccagtcatgtaaaactgggtcactggtgttctgagatgatctctattcagttggaagtagatataggttaaatttcaggtctgaatcggtgaaatctcaagtagaaccttaggatgatgcacgaaagagcttgctggttttctccaaggtacttctcatcgaagaatcaatggattgaaaatctgttatgggtagcagtgcttgttaagtaaagatttcgaagatgaagctgatgtctgctggagaatgggggtggacaacgcggtaaatttcatgcagatggatgttcgattgcttgggagttctctggagtctggatggatacctatcgagtagtattattcccctctcagctcactgtccagatagatagtgctatctgtgactgctgggtgatcagtttatcgagattttgctggttggagatgttcggcgttgctttcatcttttgtgatgcctggccttcggcagtatatggcattccagaactgcgcgcagtggtttcctcgaatttaggacctccgactgcattctgtaccgggagcaatcctgctaaatacatgatatttgcaggtatttgtgttgtgtttccaacgtgatagctttcagcggtataaaaaaaaacagtcaagatgggcgcattggatctacaccttgagtctgcttctgctcaacatggacaagccaagctaaatgtggaggaatacaccaagggctctttggagtctggtggaaattacaaaaaagagaagatcaacggttcagatcctgatgattttgagaaatttgagaaaggaataatgcagtatgggtgtcgacactacagaaggagatgccgcatacgagctccttgctgcaatgagatttttgattgccggcactgccacaatgaagttaagaattccattaaagtcgatacactgaggagacatgaacttccacgccaggaagtgcagcaggttatatgctcattatgtggcactgaacaagaggtacgacaagtatgcatcaattgtggagtatgcatggggaagtacttctgtggattgtgcaagctcttcgatgatgatgtttctaaacaacagtatcactgcaatggatgtggaatatgtagaattggagggagggaaaatttcttccactgctcaaaatgcggatgttgttattcaattgtgctgaagaacagtcatgcatgtattgaaggagcaatgcatcatgactgtccaatctgctttgagtacttgtttgagtcgacaaatgatgtttctgtcctgccttgcggtcataccattcatgtgaagtgcttgaaagaaatggaggagcactgccagtttgcatgcccactttgctccaagtcagtttgtgacatgtccaaggcatgggagagactcgacatggagctggcgactctgtccgattcttatgatgacaagatggtccgcatattatgcaacgactgcggggcaatatcagaggtgcagttccatttgatcgcgcacaagtgccagaattgcaagtcatacaacacccgccagatctgaagaaagtgattgttatgcggattctgcattcttcaagaagcgtgacgacgcctcttgcgtgagctgctgagctctcgggacgggggtcccatcattgggtgcagcttcaggtcttcagcgaaggcgtaccacttgagattatctatctgtgctgttagctgctgtccttgattgcgcctctttagcctgttagctgttattctaggtgcttccgcctgtttacttcagtcgtctgtggttccggtgtattggttatattcctcgcttcaagattgtgtcctcggaggtcctagctgagataaatgcccaagcttgtagctggaagtcgattcataatgtaggggtctcttttggcaaggatgagagaggtttgtggttgcacggcaaatctatggctctcctagtatttccgtaactttaattctttataagtactagattttgcccttcgtttggattcttggacgaccgtgatgctactaaagtggttgtccgaggtttattttagactgtcacatcaaatgttttgatgtgagttagattaaataagttaattat

SEQ ID NO: 1552 - DNA, 3287 bp, Zea mays
ctccccgaagcagtttagatatcttcctcccaaccttccctgccaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagttcgtcatacgcctcgcggtttttctagtttccgttttgatttctatgcgcccaatgttttgtccgattgattgatctgcttaggtacgtgagactgtctctattgttcgtgagtgcgtagatggtgggtgagtctggttgtttagatttgtgactggttgctcgacttgattgtgctgactgattgtttcatctatcgtgtaagctgtattaatgtctaatcccttaattgctttgaaaccactgcatgtgcttgattagtttggtttgtaccgacagcttttggtgcctatttgtgatgagattgaacatcctgctgcttgtgtttaatcttctaggttcgtgttcttgctgtatgcgtggttaatggttgactagtacttctctgatgctgaggatgattgctattgattgactagaatttaacatttccctgtggggaagtaatctcctatgttctgtcgaaagcagcacactctggcaactgtattgctgcatatattttccgtcaaaaaaatatttgctaaacatgaaaaccacacttattttgccttttcatctctccttgtggcacaatactatggcccagttttgaacctatggcccaacactcttagctaataactcaactaattgttaactaactcgcagctaacaattagttcattagctgcctcaatccagctaacaatttgttagctggctaactattagatttaggggttccaaacatgactgtatcaattgacttcctctgttggccgacctttgcatatatcatcaatgagcagaaaaaaacaggttttgtttttgctaaattaaggagaagtatcgctcaaatttagcatcgtaatgggggaacacatcatcttctcgatgaattccgctatatgccccagctatacccagatgagaacaggaagggacagtttgtggactacttgcaggctattgatttatgtattctttggtaaagaatcgggaagggcatttttcttatgcaggttgcataaccactggtgatatgagatgatctctattcgcttggaaagtagagataggttaaatttcggtctgaacggtgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggagagaatggtgtggacaacgcggtaaatttggtgcagatggatggtgtgttcaaattgatcggagttctctggatggatacctatcgagtagtataattcctctctcagctcactgtccagacaattagtgctatctgtgactgttgggcaatcaggttatcgagattttgctggttggagctgtccggcattgctttcatcttttatcaatatgccggtctttggcagcatatggcgattcagaactgtgcgcagtggtttcctcgaatttaggaccccccaactgcattctgtattgagaacattcctgctaaatacatgatacttgcaggtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgcagcagcttgtagctggacttgatttatgaaggtgccggaagagttcttggttgcgggtagctattaaggccatctcgagtagatgtcctattacatcccttatttcatcctctatttcaaactttatataaatagtattaaatatctcatct

SEQ ID NO: 1553 - DNA, 2974 bp, Brachypodium distachyon
accacaaaaaagacctctcgcagctttcgtcccgtccgaagtccctccgcccattcccaattcccaaatccacagccgcattcaaggattcagcctcgattcgatcggcgaacggctcgccaaggcgaccgcgccgcgccgcgccgctcgtgctgctcactcgattcggtcgtgtgtgcgctaggaagttcgtcatacgcctcgtgatttttcgttcatgttctgttttcctgtgccccgtttaccactctaaatcttagttagctcgctcgatctgtgtaggtatgtgggttcttctggttggttacgcgtgtacgcatatgatgattattactaaccgctttgattttggttatgttgattgattgccttgtttggttgtgtcgaccaattgcttgatttggttgtggtgacgtaattttttggttcagtttggcttgctcgtcaattggtagactggtggttactgtttgataggggaaactagaggatttcaatatccacaattcgattcaagtgctgcatgtatttgattcaagccctgttttaggggttagagttgcatctccctttctagttgtgatgtttcctcggttccagttactgaagcatggggatcatcatttcaacaaaccatatcagtggtctatatacatccggacgatgaggaagcattcactgtgcaatgggctcatgttatttctggatttccctgttcatacgtcatctgtttctcgcaacttatgcccctcttcatcacattctgtgctttcctgactaatcaaaactgctctggacactgaatacactgcatttgcttcgtctccttgtgccagaaacggtgcccccgttttgattcaactcttattgtgccaaaggcagagaaggaattttcttccgaattaaagaaaacaatggatatattgtgacagcgtactgtaggaaaatcatcactcgtcctgacaagtacctttaggcatcctagctacagaggggagattggagaagacagaaatttattggttgcgctcgttggttactaatcttctttactccttagcatagagttgtggaagtgtttctcttatgcaggttctgtcaagggtctcacgtcactagttcgagactgagacgatccttgttcataaggaaagtgtaggtaggtttggctacatttcaggtacaaaccagtgaagtcttaagtagaacactggctttctccagatgttcctgattggggaattaaaggaagtttagtttatttatggatttatttatggatattgttttaaccaaagtctggacaagtttcttctactgaagatgaagccagttgccgctggagaatgggggccggcaccactgtagagttgatgcagatggatcactgtgtacaaattgcttggaaactcttctctggatggatatcagttgtgtactttcttttttcacagctcactgtccagctagtttgtgctacctgttattgtttggtgatcaaactatggggattttgctgattggagctgttcggcgttgctatggtcttgtgttgatacacctgatcttcagcagtatacagcaactcagaactgcatgcagtggtttcctccttttataggagctgtggctgcattctgtattgagaaccatcctgctaaatgcatactgcttgcaggtatttctgttgtgtccgcgacgtgatatatttagcagtacaaaacattgtgcatgggtgccatggacgtgcagcttgagtctgttgctaagctaaatgtggaggtacttgcccaaggctctttgttattcgacgggaatcatacagcacagaagatcaatggttttaacactgatgatcgtgagaggtttgagaaaggatcaatgaagtatgggtgtgcgcattaccgaaggagatgccgtatacgggcaccatgctgtaatgagatttttgattgccgtcactgccacaatgaagcgaagaattcgattggaattgatacaatgaggcgacatgaaattccacgccatgaagtgcagcaggtcatatgctccctgtgtggcactgaacaagaggtacggcaaatatgcatcaattgtggtgtatgcatggggaagtatttctgcgaagtttgcaaactctttgatgatgatgtctcaaaacagcagtaccactgccatggttgtggaatatgtagaattggtggcagggagaatttttttcactgctcaaaatgtggatgctgttattctacagtgttaaagaatagtcattcatgtgttgaaggagcgatgcatcatgactgtccaatctgctttgagtacttatttgagtcgacaaatgatgtatctgtcttgccgtgcggtcacacgattcatgaaaactgcttgaaagaaatggaggaacattgccagttttcatgcccgctctgctccaagtcagtgtgtgacatgtcaaaggcatgggagagactagacatggaactagcgagcctgtcagactcctgtgacaataaaatggtccgtatattatgcaatgattgtggggcagtatcagaagtgcagttccacttgattgcgcataagtgccagaattgcaagtcatacaacacccggcaaatttgaagtagtgaagcctcgagaggattgacgttctgcagctggcacctatgttacctttcttgaggttgctgagggctctccggcagtaggaattcactgggattgtgtgccacggatccctagatttttcgtctgtgctctctattattagctgttgttcttggttgtgtctccggggtctttttgccccgtttcttctattgttcaaagtgtaaccctctcctgagtcgattcaagccctgcgtattctcatggtaatttggtatgatcgtgttacagctcgtttgccaaccatccttacatcgaagtctgatttttgataagatttcaattggtcaaatttgaattaagggct

SEQ ID NO: 1554 - DNA, 1782 bp, Triticum aestivum
  misc_feature (20)..(20): n is a, c, g, or t
ccggtggctgctggtagagnaacggggggccagcaccacagtaatactgatgcagatggatcactgtgtacgaattgcttgggaattctcctctggatggatatcagttgtgtaatttgttttctcacagctcacaatccagctagtttattctactgtgattgtttggcggtcaaatatgaggtttttgctgattggagctgtccggcgttgctttggtcttgtgttgatatgcctggccttcagcagtattgagcaaccagaactacatgcagtggcttcctccatattttggacatgtgactgcattctgtattgagagccatcctgctaaatgcataatacttgcaggtatttgtgttgtgtttgcaacgcgatagcttttgcgctaccaaacagccgacatgggtgccgtgcagctcgagtctgttgctgctcaacatgcacaagctaagctaaatgtggaatcacttcctcaaggcccttcgttgtttgatggaaatgacactgccaggatcaatggttccgagtctgatgagtatgaaaaatttgacaagggattaatgcagtatggatgtgcacattaccgaaggagatgccgcatacgagcaccatgctgcaatgagatttttgattgccggcactgccacaatgaatcaaagaattcgatcaaaattgatactcctacgcgacatgaacttccacgccatgaactgcagcaggtcatatgcacattgtgtggcactgaacaagaggtacgacaagtatgcatcaactgtggtgtatgcatgggaaagtatttctgtgaagtgtgcaagctctttgatgatgatgtctcaaaacagcagtatcactgccatgcgtgtggaatatgtagaattggtggcagggagaatttctttcactgctcaaaatgcggatgttgttattccaaagtgttgaagaacagtcatgcatgtgttgaaggagccatgcatcatgactgtccaatctgcttcgagtacttgtttgagtcaagaaacgatgtctctgttttgccatgtggtcatacaattcatgaaaaatgcttgagagagatgaaggagcattgccaatttgcatgcccgctctgctccaagtcagtatgtgacatgtcgaaggcatgggaaagactggacgcggaactagcgactctgtcaaactccttcgatgataaaatggttcgcatattgtgcaatgattgtggggcagtatcagaggtgcagttccacttaattgcacataagtgccataattgcaagtcgtacaacacccggcagatttgaagtagtgaagccctggagggattctacattcttcctggaagttggtgagagtgctccggcagtggagattagttcgtctacgtgatgtttgccgtgaaggcacatcactagacaatttatcagcgtcctctgcagttagctgccctgcatcgtttctgctagttcaaaaaagtgtgtaacagtttccgcgcgtccgttcaagccttgcatatttcagcactgggcagactggtagaattgtgctctactcgattggtatcatttcctcaccattggccaggcctgcaacggataggatctcctctccagggagagtgttgtgtgcatgcagcaggctgtgtggcatagggtttaatggttgcaaaatgtcttgatcaacaatttccatttcagcgatcaccaagttgggctgtcatttccgggtctacattgttgctgccttttcgttcagtttattgcatgcttcgtctgttaatgt

SEQ ID NO: 1555 - DNA, 3002 bp, Brachypodium distachyon
aaagacctctcgcagctttcgtcccgtccgaagtccctccgcccattcccaattcccaaatccacagccgcattcaaggattcagcctcgattcgatcggcgaacggctcgccaaggcgaccgcgccgcgccgcgccgctcgtgctgctcactcgattcggtcgtgtgtgcgctaggaagttcgtcatacgcctcgtgatttttcgttcatgttctgttttcctgtgccccgtttaccactctaaatcttagttagctcgctcgatctgtgtaggtatgtgggttcttctggttggttacgcgtgtacgcatatgatgattattactaaccgctttgattttggttatgttgattgattgccttgtttggttgtgtcgaccaattgcttgatttggttgtggtgacgtaattttttggttcagtttggcttgctcgtcaattggtagactggtggttactgtttgataggggaaactagaggatttcaatatccacaattcgattcaagtgctgcatgtatttgattcaagccctgttttaggggttagagttgcatctccctttctagttgtgatgtttcctcggttccagttactgaagcatggggatcatcatttcaacaaaccatatcagtggtctatatacatccggacgatgaggaagcattcactgtgcaatgggctcatgttatttctggatttccctgttcatacgtcatctgtttctcgcaacttatgcccctcttcatcacattctgtgctttcctgactaatcaaaactgctctggacactgaatacactgcatttgcttcgtctccttgtgccagaaacggtgcccccgttttgattcaactcttattgtgccaaaggcagagaaggaattttcttccgaattaaagaaaacaatggatatattgtgacagcgtactgtaggaaaatcatcactcgtcctgacaagtacctttaggcatcctagctacagaggggagattggagaagacagaaatttattggttgcgctcgttggttactaatcttctttactccttagcatagagttgtggaagtgtttctcttatgcaggttctgtcaagggtctcacgtcactagttcgagactgagacgatccttgttcataaggaaagtgtaggtaggtttggctacatttcaggtacaaaccagtgaagtcttaagtagaacactggctttctccagatgttcctgattggggaattaaaggaagtttagtttatttatggatttatttatggatattgttttaaccaaagtctggacaagtttcttctactgaagatgaagccagttgccgctggaggtaggcttccttgtaatctaacgtcttaaggaacctttcagttttataaaacatacacggacggtactagctaacacgtcaaaaccttatcacgaaaccatcccacccctttcacctttgtttcctggcatttgatcctattacgtgttcctcttgccacagaatgggggccggcaccactgtagagttgatgcagatggatcactgtgtacaaattgcttggaaactcttctctggatggatatcagttgtgtactttcttttttcacagctcactgtccagctagtttgtgctacctgttattgtttggtgatcaaactatggggattttgctgattggagctgttcggcgttgctatggtcttgtgttgatacacctgatcttcagcagtatacagcaactcagaactgcatgcagtggtttcctccttttataggagctgtggctgcattctgtattgagaaccatcctgctaaatgcatactgcttgcaggtatttctgttgtgtccgcgacgtgatatatttagcagtacaaaacattgtgcatgggtgccatggacgtgcagcttgagtctgttgctaagctaaatgtggaggtacttgcccaaggctctttgtgttttggcgggaatcatacagcacagaagatcaatggttttaacactgatgatcgtgagaggtttgagaaaggatcaatgaagtatgggtgtgcgcattaccgaaggagatgccgtatacgggcacatgctgtaatgagatttttgattgccgtcactgccacaatgaagcgaagaattcgattggaattgatacaatgaggcgacatgaaattccacgccatgaagtgcagcaggtcatatgctccctgtgtggcactgaacaagaggtacggcaaatatgcatcaattgtggtgtatgcatggggaagtatttctgcgaagtttgcaaactctttgatgatgatgtctcaaaacagcagtaccactgccatggttgtggaatatgtagaattggtggcagggagaatttttttcactgctcaaaatgtggatgctgttattctacagtgttaaagaatagtcattcatgtgttgaaggagcgatgcatcatgactgtccaatctgctttgagtacttatttgagtcgacaaatgatgtatctgtcttgccgtgcggtcacacgattcatgaaaactgcttgaaagaaatggaggaacattgccagttttcatgcccgctctgctccaagtcagtgtgtgacatgtcaaaggcatgggagagactagacatggaactagcgagcctgtcagactcctgtgacaataaaatggtccgtatattatgcaatgattgtggggcagtatcagaagtgcagttccacttgattgcgcataagtgccagaattgcaagtcatacaacacccggcaaatttgaagtagtgaagcctcgagaggattgacgttctgcagctggcacctatgttacctttcttgaggttgctgagggctctccggcagtaggaattcactgggattgtgtgccacggatccctagatttttcgtctgtgctctctattattagctgttgttcttggttgtgtctccggggtctttttgccccgtttcttctattgttcaaagtgtaaccctctcctgagtcg

SEQ ID NO: 1556 - DNA, 2803 bp, Triticum aestivum
  misc_feature (537)..(537): n is a, c, g, or t
  misc_feature (557)..(558): n is a, c, g, or t
  misc_feature (669)..(669): n is a, c, g, or t
taccatgtatttatacatacggccgatgaagcggcatgagctgtgcaaatggactcctgttatttcagaaattttgaacttcgtagatcctatcatacgtcctatatttttggattgaactggcaacttatatccttcttgatcacactcgtgctgttctggctaatccaaaagtaccatggacactgggccactgcattttgcttcctctcctgtgcctgaacggtgcccctgttttggttcctcattcaactctcatttgtgcttttgttttcgttcaccaattaaaaaaaaacagtggatatgcttgtaaaaacgtgttgagggctcattctcgaaaagaaaaagaaaaacaaggttgaggggaaactatcactcttctagacaagttaccttcaggcatcctagttaaagagagcatgtccagaaggcagcaacttgccgactacttacttgctgcgtgcagcattggttactaattttttttactgctttggcacagagttggggtgaattcacttatgcaggttctttcantgatgctgcttcactagttnntgagacgatccctattcagtaagaaattgtagataggttacatttcaggtacaaaccactgaagtcttaattaggacgctggctttctcaagatgttcttgatgggagaantagaggaagtttagtttatttgcggatattgcacgactttaaaccaatgtttggacaagtttcttccgttgaagatgaagccggtggctgctggagagaacggggggccagcaccacggtaaaactgatgcagatggatcactgtgtacgaattgcttggaaattcttctctggatggatatcagttgtgtaatttgttttctcacagctcacaatccagctagtttattctagctgtgattgtttggtgatcaaactatgaggtttttgctgattggagctgtccggcgttgctttggtcttgtgtcaatatgcctggtcttcagcagtattcagcaaccagaactacatgcagtggtttcctctgtgactgcattctgtattgagagtcatcctgctaaatgcataatacttgcaggtatttgtgttgcgtttgcaacgcgatagtttttgcgctaccaaacagccgacatgggtgccgtgcagcttgagtctgttgctgctcaacatgcacacgctaaactaaatgtggattcacttcctcaaggcccttcgttgtttgatggaaatgacacagccaggattgatggttctaagtctgatgagtacgaaagatttgagaagggattaatgcagtatggatgtgcgcattaccgaaggagatgccgcatacgagctccgtgctgcaatgagatttttgattgccggcactgccacaatgaatcaaagaattcgattaaaattgatactgctaggagacatgaacttccacgccatgaactgcagcaggtcatatgctcattgtgtggcactgaacaagaggtacaacaaacatgcataagttgtggtgtatgcatgggaaagtatttctgtgaagtgtgcaagctctttgatgatgatgtctcaaaagagcagtatcactgccatgtgtgtggaatatgtagaattggtggcagggagaatttctttcactgctcaaaatgcggatgttgttattccaaagtgttgaagaacagtcatgcatgcgttgaaggagccatgcatcatgactgtccaatctgcttcgagtacttgtttgagtcgagaaatgatgtctctgttttgccatgtggtcataccattcatgaaaaatgcttgaaagagatgaaggagcattgccaatttgcatgcccgctctgctccaagtcagtatgtgacatgtcgaaggcatgggaaagactggatgcagaactagcgactctgtcaaactccttcgatgataaaatggttcgcatattgtgcaatgattgcggggcagtatcagaggtgcagttccacttaattgcacacaagtgccataattgcaagtcgtacaacacccggcagatttgaagtagtgaagccctggatggattctacattcttcctggaagttggtgagagtgctccggcagtggagattcgttcgtctacgtgatgtttgccgcgaaggcacatcactagacaatttatctgcgtcctcggctgttagctgccctgcatcgtttctgttagttcaaaaaagtgtgttaacagtttccgcgcgtccgttcaagccttgcatatttcagcacttggcagacaggtagtactcgattggtatcaccattggccaggcctgcaacggataggatctcctctccagggagagtgttgtgtgcatgcagcaggttgtgtggcatagggtttaatggttgcaaactgtcttgatcgacaatttccttttcagtgatcaccaagttgggctgtcatttccgggtctacattgttgctgccttttcattcagtttattgcatgcttcgccggttaaatgttcctggcacctctttgggaggattgttatctgagcaatgccgttgatgcaaaagcttggcagaggcaactcctcgctaggtgtggatagtcatttttttttaggggtgcgtggatagtcatgtaggttcctcaaatggcggcactgccagtgctaagttagggttcttgggctttacaaagatgccactttagggcctcttcgattcaaacttattttttttcgtatgcaactctttcgtaaggatacattctgtataagtatttcagctgagttaaaattatgagaaaggttttccctgc

SEQ ID NO: 1557 - DNA, 1508 bp, Hordeum vulgare
tacgaattgcttgggaattcttctctggatggatatcagttgtgtaatttgttttctcacagctcacaatccagctagtgtattctagctgtgattgtttggtgatcaaactatgaggtttttgctgattggagctgtccggagttgctttggtcttgtgttgatatgcctggtcttcagcagtatacagcaaccagaaccacatgcagtggtttcctccatatttaggacctgtgactgcattctgtattgagagccatcctgctaaatgcataatacttgcaggtatttgtgttgtgcttgcaaggcgatagcttttgcactaccaaacagccgacatgggtgccgtgcagcttgagtctgttgctgctcagcatgcacacgctaagctaaatatggattcacttcctcaaggcccttcgttgtttgatggaaatgacacagccagggtcaatggttctaactctgatgagtatgaaagatttgagaagggattaatggagtatggatgtgcacattaccgaagaagatgccgcatacgagcaccttgctgcaatgacatttttgattgccggcactgccacaatgaatcaaagaattcgattagaattgatactcctaggcgacatgaacttccacgccatgaactgcagcaggtcatatgctcattgtgtggcactgaacaagaggtacgacaaatatgcatcagctgtggtgtatgcatggggaagtatttctgtgaagtgtgcaagctctttgatgatgatgtctcaaaacagcagtatcactgccatggttgtggaatatgcagaattggtggcagggagaatttctttcactgctcaaaatgtggatgttgttattctactgttttgaagaacagtcatgcatgtgttgaaggagccatgcatcatgactgtccaatctgcttcgagtacttgtttgagtcgagaaatgatgtctctgttctgccgtgtggtcatacaattcatgaaaaatgcttgaaagaaatgaaggagcattgccaattcgcatgcccgctctgctccaagtcggtgtgtgacatgtcaaaggcatgggaaagactggatgcagaactagcgactctgtcaaactccttcgacgataagatggttcgcatattgtgcaatgattgcggggcggtatcagaggtgcagtttcacttaattgcacataagtgccatagttgcaagtcatacaacacccggcaaatttgaagtagtgagccatggagggactctacgttcttcctagaagttggcgagcgcgctccagcagtggaaatcgattcatctacgtgatgttttccacgaaggcagatcactggacagtttatctgcatcctccgcagttagctgctgccttttggttgtccttcatttgtttctgcatggtctccttttgttcagtgtgtaacagcttccgcgtgaccgatcaagccttgcatattttagcacaacgcggcatctggtagaattgtgttctac

SEQ ID NO: 1558 - DNA, 3362 bp, Hordeum vulgare
gtctcagcttacgccactcctaatcctaaaaaactctcgcagtattcctcccgtcccgacccactgtccgttcccccccaaatccactggaacgcgctacaggattcagccgcgatccgatcgccgaagcgaccgcgcagcgccgtcccgcccgctcgattcggtcgcgtgtgcgctaggaagttcgtccgccacgcgcctcgcggttttgtgttcgttttctcgttcggttaccgctttcaatcttaggctactagctcgatcgatctctgtaggtatgtatgtgtgttcttctgattgcttgcgcctgcgcgtggatgatgcatgactaactgcgtggttttggttatgctgattgattgcttgattttgttgtgctggctacttttcctgattcggtttaaccctgctcgtcaatcggttcgttgactgctgcttgatgttattgttcattcaaattaggtgatgtgcgtccccacaattcgtttcaagttcgctttaaagttcgaaaccgtgaacatatgcgctggaatgcctgtatgcggggtttgggttgcgtttcatcttcctaggtacgatgtgtttcggtctatttgctggccacagctatttgggcgtgtggggtcatgtccttcttcatcaaatcttgcgctcttctggctaatctaaactgtcatggacgctgggacactgcattttgcttcctctccatatgcctgaaacgctgtcctgttttggttcctcattcaactctcgttgtgccaaaggcagaaacagaattttgttttcgttcaccaatcaaagaaaactatggacattcttgtaacaacttgttgagggcacactctcgaaagaaaagaaaaaaaaaacaaggctgagggcaaactatcacttttctagacaagttaagttaaaagagagtgtgttcggaagggcagcaactcgcagactacttgttgcatgcagaattggttactaattttctttactgcttttggcacagagttgggggaagtgacttcacttatgcaggttctttcaatgatgctgcttcactagttatccagacgatccctattcagtaggaaattgtagataggttacatttcaggtacaacccactgaagtcttaattaggacgctggctttctcaagatgttcttgattggagaattagagcaagtttagtttatttgtggatatcacgcgaccttaaaccagtgtttggacaagtttcttccgttgaagatgaagccggtgtctgctggagacaacggggagagccagcaccacggtaaaactgatgcagacggattactgtgtacgaattgcttgggaattcttctctggatggatatcagttgtgtaatttgttttctcacagctcacaatccagctagtgtattctagctgtgattgtttggtgatcaaactatgaggtttttgctgattggagctgtccggagttgctttggtcttgtgttgatatgcctggtcttcagcagtatacagcaaccagaaccacatgcagtggtttcctccatatttaggacctgtgactgcattctgtattgagagccatcctgctaaatgcataatacttgcaggtatttgtgttgtgcttgcaaggcgatagcttttgcactaccaaacagccgacatgggtgccgtgcagcttgagtctgttgctgctcagcatgcacacgctaagctaaatatggattcacttcctcaaggcccttcgttgtttgatggaaatgacacagccagggtcaatggttctaactctgatgagtatgaaagatttgagaagggattaatggagtatggatgtgcacattaccgaagaagatgccgcatacgagcaccttgctgcaatgacatttttgattgccggcactgccacaatgaatcaaagaattcgattagaattgatactcctaggcgacatgaacttccacgccatgaactgcagcaggtcatatgctcattgtgtggcactgaacaagaggtacgacaaatatgcatcagctgtggtgtatgcatggggaagtatttctgtgaagtgtgcaagctctttgatgatgatgtctcaaaacagcagtatcactgccatggttgtggaatatgcagaattggtggcagggagaatttctttcactgctcaaaatgtggatgttgttattctactgttttgaagaacagtcatgcatgtgttgaaggagccatgcatcatgactgtccaatctgcttcgagtacttgtttgagtcgagaaatgatgtctctgttctgccgtgtggtcatacaattcatgaaaaatgcttgaaagaaatgaaggagcattgccaattcgcatgcccgctctgctccaagtcggtgtgtgacatgtcaaaggcatgggaaagactggatgcagaactagcgactctgtcaaactccttcgacgataagatggttcgcatattgtgcaatgattgcggggcggtatcagaggtgcagttccacttaattgcacataagtgccatagttgcaagtcatacaacacccggcaaatttgaagtagtgagccatggagggactctacgttcttcctagaagttggcgagcgcgctccagcagtggaaatcgattcatctacgtgatgttttccacgaaggcagatcactggacagtttatctgcatcctccgcagttagctgctgccttttggttgtccttcatttgtttctgcatggtctccttttgttcagtgtgtaacagcttccgcgtgaccgatcaagccttgcatattttagcacaacgcggcatctggtagaattgtgttctactccctccatctcaaagtaagtgactcaaaaatgactcttctcttgagtcatttttgagtcacttattttgggacggaggaagtactcgattggtatcatttccagcattggtcaggactgcaacctataggatcaccactctggcgagtcttgctgcgtgcatgcagcaggctgtgtggcatagggtttatggttgcaaaatttcttgattctcaatttaaatgtcaggattaccaagttgggctgcaatttctgggtctacattgtcactgctttttcattcagtttattgcacgctttgccggtcaatgctcctgaggcctctttggggaagagtgttaatgtgagcgataatgttgatgtgaaagctttgcctaggcaactgcttgtaggcgtagagagtcgagtaggttcctttttttttctgaataagtggagtaggttccaacggcggcactgccaaagcgtggttcttgggctaacaagatgtgactctagggcctctttcattccaacatcttttatcgtatgc

SEQ ID NO: 1559 - DNA, 2109 bp, Brachypodium distachyon
cccggccgccgccatgaatccctacgcggacaaccgctacgccgacccttcctcctaccgcgacaggcgcagcgacctggctgcggcccctatactcgccccgccggtccccgtggccgcgaacccctacgccgcctacacgcccatgcccatgcccgctcctgctggcggcgacttctcgcgttttgggcaaggcggcggcagagggtatggtggaggcatgtcctatgggggtagaggcagaggcggctttggcggtggacccggtggcttccgaggcggtggcagaggaggcagcaacgggagggatggcctggactcgctctccctgcccaagccggacttcagggatcttataccgtttgagaagagcttctacgttgagtgcccggccgtgcaggctatgtcggacatggaagtggcgcagtaccgtcaactccgggatatcacagtcgagggcagggaggtccctaagcctatccgctacttccaggaagccaactttccagattactgcatgcaagcaatactgaagtccggatttgtggagcccactcctattcagtctcagggttggccaatggctttgaagggcagggacgtgataggaattgcggaaacaggctcagggaaaacactatcttacatactccctgggttggttcatgttggtgcacagcctcgcctagaacaaggtgatggcccaattgtcttgatccttgctcccacaagagaacttgctgttcaaatccaggaagagtctacaaagttcggatcatactcaagaactagaagcacatgtatctatggtggagcacctaagggaccacagatacgtgaccttaggagaggagttgaaattgtcattgcaacaccgggtcggttgatcgatatgctggaagctggtcacactaacttacgtagggttacataccttgtcttggatgaggcagaccgaatgctagatatgggttttgagcctcagattcggaagatagtggcacaaatccgtccagacaggcaaaccttgtactggagtgccacgtggccgagagaagttgaatccttggctagacaatttctgcaaaacccgtacaaggtaatgattggaacagctgaacttaaagctaaccattccatacaacaaattgtcgaagttatctcagatcatgaaaagtatcccaggctaagtaagcttttatctgatctaatggatgggagccgaatcttgatattttttcaaacaaaaaaggaatgtgataaggtcactcggcaacttagaatggatggatggccagcattatctatacatggtgataaagctcagtctgaaagggactatgttctgtcagagtttaagagtgggaagagtcctataatggctgccactgacgtagcggcacgtggtcttgatgtgaaggatataaaatgtgtgattaattttgatttcccaacaactatcgaggattatattcacaggataggtcgtactggccgtgctggtgctactgggatggcatttactttcttcacacactccaattcaaaatattcaaggaatcttgtgaagatcttgcgtgaagctggccaggttgtgaacccagcgcttgaagctatgtccaagtctgctaattctatgggaggaggaagcaatttccggtcaagggggcgaggtgggtttggtaaccgttctggatcaaattctatcccagtgcggagaagattctgatgcaaaggagaatgacaccatcctgatggtgcaaaagacgagacaaagttttatctgtatacaattaggcattaaatgcatttttggtgggagttcctttgaaatccccactactgctagattgaaaccaagtctgttcttaataccttgtaccagagctatgaagccatgtcatatgaatgacaaacatttatcagcaactcatcatatgtatttgagtaagtttacctttggaaaaatggtttgcctgccttaacgtttacagctatgatgtaatccggccaattccttttttatgtcacattaatcattcttgtagcaaaacatcatagatttgtgagtgttctgcaaggttaaaatatgtagatcggtctgtagat

SEQ ID NO: 1560 - DNA, 1923 bp, Sorghum bicolor
cctccctcgcctttaccctcgagcacggcggcgccctcgccctgctctcccgtccggccaagctcctcctacccggcgccatgaacccctacgacctccgcttcgccgacccctcatcctaccacgacaggcgcagcgacctggccgtggctcctacgttcgctccgccggctcccgtggctgcggtgaacccgaacccttacgccgccgcctacccgcccgtgccagtgcccgtgcccgcggcccccgcgggcggcgactaccagcgctacgggcagggcggcagaggccgtggtggaggcggcagaggaggcggcggtgggtatggaggtggcggcaggggaggtggtcgcgggagggacgggcttgactcgcttgccctccctaagccggacttccggagcctgataccgttcgagaagaacttctacgtggagtgtccctccgtccaggctatgtcggaggcggatgtggcgcagtaccgccgcctccgggatatcaccgtagagggccgggatgtgcccaagccggtccgatacttccaggaagccaacttcccagattactgcatgcaagcgattgccaaatctggatttgtggagccaactcctattcaatctcaaggttggcctatggctttgaagggtagggacctgattggtatcgctcaaacaggctcagggaaaacattatcttatctgctacctgggttggttcatgttggtgcccagcctcggctagaacaaggcgatggcccaattgtattaatcctcgcccccacaagagaactggctgttcaaatacaggaagaatctacaaaatttggatcatattcaagaactagaagcacatgtgtctatggtggtgcacctaagggtccacaaatacgtgaccttagaagaggagttgaaattgtcattgcaactcctggtcggttgattgatatgctggaagccggccacacgaacctacgtagagtgacataccttgtgctggatgaggcagaccggatgctagatatgggttttgagccccaaattcgaaaaatagttgcacagatccgcccagacaggcaaacattgtactggagtgccacatggcctagagaagttgaagccttagcaaggcagtttctgcaaaatccttataaggtaaccataggatcacctgaacttaaagctaatcattccatacaacaaattgtagaagttatttcagaccatgagaagtatccaagactcagtaagctcttgtctgatctaatggacggaagccgtatcttgatattcttccaaacaaaaaaggactgcgataagatcacacggcaacttagaatggatgggtggccggcattatctatacatggtgataaagctcaagctgaacgggactatgttcttgcagagtttaagagcggcaagagtcccataatggctgctacagatgtggcagcacgtggtcttgacgtgaaggacataaagtgtgtgataaattatgattttccaacaactcttgaagattatattcacaggataggtcgaactggccgtgctggtgctagcggaactgcatttacttttttcacacatgcaaatgctaagttctcaaggaatctagtgaagattctgcgggaagctggacaagctgtgaatcctgcactagaatccatgtccaagtcttcaaactcagggggaggaggcaatttccggtcgagaggcagaggtgggtttggtaaccggggtcatatgtctggatcaaatacctttcctttaggaggagggagaaggccatattgatgggtgcaaaagaagtttgggacttctatttgtaaactactaggcattaagtgcattctttgggaaatttctgagaaattccccttactaggattgacaacaaagtcaattttcgctacaatacctg

SEQ ID NO: 1561 - DNA, 2320 bp, Zea mays
ggtcacgcgaaccgaccctgtccgttcccgcacgccactagcaaaagccacacccaacaaaaggtaaaccaccgcgtctccgcccgccgccgcccgcagatccatcccctcccggcctccctagcctttcccctcgagcacgtcagcgccctcgccctgctctgtcggccggccaagctcctcaccggcgccatgaacccgtatgatctccgcttcgctgacccctcatcctaccacgacaggcgcagcgacttgaccgtggctcctacgttcgctccgccggctcccgtggctgcggcgaacctgaacccttacgccgccgcctacccgctgcctgtgcccgttcccgtgcccgcggcccccgcgggcggcgactaccagcgctacgggcagggaggcagaggccgtggtggcggtggcagaggcggtggaggagggtacggaggtggcggcagaggaggaggtcgcgggagggacgggcttgactcgctcgccctccctaagccggactttcggagcctgataccgttcgagaaaaacttctacgtggagtgtccctccgtccaggcaatgtcggaggcggatgtggcgcagtaccgccgcctccgggatatcaccatcgagggccgggatgtgcccaagccggttagatacttccaggaagccaacttcccagattactgcatgcaagctattgccaaatctggatttgtggagccaacacctattcaatctcaaggttggcctatggctttgaagggtagggacctgattggtatcgctcaaacaggctcagggaaaacattatcttatctgttacctgggttggttcatgttggtgcccagcctcggctagaacaaggcgatggcccaattgtattaattctcgctcccacaagagaactggctgttcaaatacaggaagaatctacaaaatttggatcatattcaagaactagaagcacatgtgtctatggtggtgcacctaagggtccacaaatacgggaccttagaagaggagttgaaattgtcattgcaactcctggccggttgattgatatgctggaagctggtcacacaaacctacgtagagtgacataccttgtgttggatgaggcggaccggatgctagatatggggtttgagccccaaattcggaaaatagtagcacagatccgcccagacaggcaaaccttgtactggagtgccacatggcctagagaagttgaagccttagcaagacagtttctacaaaatccttacaaggtaatcataggctcacctgaacttaaagctaatcattccatacaacaaattgttgaagttatttcagatcatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcaagagccccataatggctgccacagatgtggcagcacgtggtcttgatgtgaaggacataaagtgtgtgataaattatgattttccaacaactcttgaagattatattcacaggataggtcgaactggccgtgctggtgctagcggaactgcatttacttttttcacacacgcaaatgcaaagttctcaaggaatctagtgaagattctgcgagaagctggccaagtcgtgaatcctgccttagaatccatgtccaggtcttcgaactcaacgggaggaggcaatttccggtcgagaggcagaggtgggtttggtaaccggggccatatgtctggatcaaatacctttcctttaggaggaagaaggccatattgatgtgtgcaaaagaactgtgggagtatgggactatttgtatactactcggcattaagtgcattctttgggaaatttctgagaaatttcccctactaccaggattgataacaccatcgattttcgctacagtacctggagcttcttatatgaaagaacaacacatcaactatctagcaacagcatatgcattccattcagatatttcttttggaaggaccctgtcttgttttagtggagtccctgtgatcgtttaaagtcgtctgtatacttgtactgaacttcttgtggtgttactgttaggatttatggttgctctctattggtgtgcggtgttactgaacaaatttagttaagaagttaggcatttccatatttaatctgattctgaaataaactagcaaatttatgatgt

SEQ ID NO: 1562 - DNA, 2127 bp, Panicum virgatum
gcagatccatcccctcccctcatctttaccctcgagctcggcggcgacctcgacctgctcgctcgtcccgccaagctccttgcccctccggccaagcccccgtgccccgcgccatgaacccatacgacatccgcttcgccgacccctcgtcgtaccacgacaggcgcagcgacctggccgtggctcctattgtcgctccgccggtcctcatgccggcggtgaacaattacgccgccgcgtatccgcccgtgcctgcggcatccgctggcgtcgattacccgcgctacgggcagggcggcagaggccgtggaggaggaggcagaggcggaggcggctttggaggtggcggtggaggcggctatggtggcggcagaggggcgcgcggcagggacgggcttgacacgctcgccctgcccaagcctgacttccggagcctgataccgttcgagaagaacttctacgtggagtctccctccgtgcaggctatgtcggatgcggaggtggcgcagtaccgccgcctacgggatatcaccgtcgagggccgggaggtgcccaagccggtccgatacttccaggaagccaacttcccagattactgcatgcaagcaattgccaaatctgggtttgtggagccgacacctattcaatctcaaggttggcctatggctctgaatggtagggacctgattggtatcgctcaaacaggctcagggaaaacattatcttatctgctacctgggttggttcatgttggcgcccagcctcggctagagcaaggtgatggcccaattgtattaatcctcgccccgacaagagaacttgctgttcaaatacaagaagaatccacaaaatttggatcatattcaagaactagaagcacatgtgtctatggtggtgcacctaagggtccacaaatacgtgaccttagaagaggagtggaaattgtcatcgcaactcctgggaggttgattgatttgctggaagctggtcacacaaacctacgtagagtgacataccttgtgctggacgaggcagaccggatgttagatatggggtttgagcctcaaattcgaaaaattgttgcacagatccggccagacaggcaaaccttatattggagtgccacttggcctagagaagttgaagccttagctagacagtttctgcaaaatccttcaaggtaaccataggatcacctgaccttaaagctaatcattccatacaacaaattgttgaagttatttcagatcatgagaagtacccgagactcagtaagctctgtctgatttaatggatgggagccgtatcttgatatttttccaaacgaaaaaggactgtgataagatcaccaggcaacttagaatggatgggtggccagcattatctatacatggtgataaagctcaagctgaaagggactatgttcttgcagagtttaagagtggcaagagttcaataatggctgccacagatgtagcagcacgtggtcttgatgtgaaggacataaaatgtgtgataaattatgatttcccaacaactcttgaagattatattcacaggataggccgaactggccgtgctggtgccagcggaacagcatttacttttttcacacatgcaaatgcgaagttctcaaggaatcttgtcaagattttgcgggaagctggccaagtcgtgaatcctgcactagaatccatgtccaaatctgcaagtttgatgggaggaggcaatttccgatcgaggggaagaggtgggtttggtaaccggggtcatatgtctggatcaaattcctttccgttaggaggaaggaggccatactaattggtgcgaaggaactatgagacttctatttgtatactactaggcattaaatgcactctttgggagtgggaaatttctgagaaattccctcaactactaggacatcaaagtcatttgcttccgttactgaagctatgaagcttctgatcatatgaaacatcaacttttatcaacttcttaccatttgcatttaagtcaaatttctcttttggaggactgttttaccggagtccctttggtcaaagtctggtcgtatactgtacttcaccctgtgttgctgaaggaaaggatgcttctttgtcgagt

SEQ ID NO: 1563 - DNA, 2145 bp, Hordeum vulgare
cagcagatccactcctccaaatccaccctccgcgagcgctcgtcctcggcgtcgatctccggccagcccaatcccccgcgcggccgccatgaatccctacgccgacaaccgctacgccgacccctcctcctaccgcgacaggcgcagcgacctggccgcggctcccatactcgccccgccggtccccgtggtcgccgcgcagaacccctatgccgccccgtacacgcccatggccgcccccgtcggtggctacggccagggcggcggaggctatggtggaggcatgggatacggcggtaggggcagaggcggcggtggcggtggaccaggcggcttccgtggcggcggtgggagaggtggcagcaacgggagggacgggctcgactcgctctccctgcccaagccggactttcggggccttataccgttcgagaagagcttctacgtggaatgccccgccgtgcaggccatgtcggagacggaggtggcgcagtaccgtcagctccgggatatcaccgtggagggccgggaggtgcccaagcctatccgcttcttccatgaagccaactttccagattactgcatgcaagcgatcgccaagtccggatttgtggaaccaacgcctatccaagctcagggttggccgatggctttgaagggcagggacgtgattggtattgcagaaactggatctgggaaaacactatcttacattctacctggtttggttcatgttggtgcacaacctcgactcgaacaaggtgatggcccaattgtcttgatccttgctccaacaagagaactggctgttcaaatacaggcagaagctacaaagtttggatcatactcgagaactagaagcacatgtatctacggtggagcacctaagggaccacaaatacgtgacctcaggagaggagttgaaatcgtcattgcaacaccaggtcggttgattgatatgctggaagctggtcacacaaacctacgtcgggttacataccttgtgctggatgaggcagaccgtatgcttgatatgggttttgaacctcagattcggaaaatattagcacaaatccgtccagacaggcaaaccttgtactggagcgctacatggccgagagaagttgaaacgttggctagacaatttctgcagaacccttacaaggtaatgataggaacagctgaacttaaagctaaccattccatacaacaaattgttgaagttatctcggatcatgaaaagtatcccaggctaagtaagcttctatctgatttgatggacgggagccgaatcttaatattttttcaaacaaaaaaggaatgtgacaaggtcactcggcaacttagaatggacggatggccagcattatctatacatggtgataaagctcagtctgaaagggactatgttctggcagagtttaagaatgggaagagtcctataatggctgccacagatgtagcggcacgtggtcttgatgtgaaggatattaagtgcgtgattaattttgatttcccgacaactatcgaagattatattcacaggataggtcgaactggccgtgctggtgctactggaatggccttcacgttcttcacccattccaattcaaaatattcaaggaatctcgttaagatcttgcgtgaagctggacaggttgtgaatccagcgctagaagctatgtccaagtcagctggttccatgggaggaggaagtaatttccggtcaaggggccgaggtgggtttggtggtggtgggtatggtggtaaccgttctggatcgaattccattccagtacgtagaagatactaagaaagaagatccattctcatgctggagaagacagaaagatgaagttttatctgcatacatttaggcattaaattaaatacattttttgggggaatttctttgaaatcctgcaactggtagaagatcgaaacaaagttcttaatatttttgtactggggctcatatgaaaaggaactcatgtatcagcgactatagattacgatagtccaatcgaaacagtgaactaagcatgtattttgtgtctaattgtcggagatgccctttgtgttgcttctacattagtcgtccctgtgtttgcttctgtatctctctgtatctgaagggctctccca

SEQ ID NO: 1564 - DNA, 2171 bp, Avena sativa
ctgcacctccatcatcaaaagcaaacccaccgcccccccacgccttcacccgccgcctcgccccgacagatctactctcgaaatctatccttgcgcgcggcagcggcgtccaatcctcctcccggaccccccgattcgatctccgggcaatccccacccgctcggcgccatgaatccctacgccgacaaccgctacgccgacccctcctcctaccgcgacaggcgcagcgacctggcagcggctcctatactcgccccgacggtccccgtggccgccgcgaacccctacgctgctccgtacacgcccatcgctgcctccgtcggtggctacggcggaggaggctacggtggtggctacagcggaggtggctacggtggaggcacgggatacggcgggcggggtagaggaggtggcggcggtggacctggcggcttccgtagcggcgggagaggaggcggcaacgggagggacggcctagattcgatctccctgcagaagccggatttcaggggccttataccgttcgagaagagcttctatgttgagtgccccgaggtgcaggccatgtcgcagatggaggtggcgcagtatcgccagctccgggatatcaccgtagagggccaggacgtgcccaagcctatccgcttcttccacgaagccagctttccagattactgtatgcaagcgatagccaagtctggatttgtggagccaacacctatccaagctcagggttggcccatggctttgaagggcagagacgtgattggcatcgcagaaacaggctcggggaaaacactatcttacatactacctggtttggttcatgttggtgcacagcctcggctagaacaaggggatggcccaattgtcttgatccttgctccaacaagagaactggctgttcagatacaggcagaagctactaaatttggatcatactcaagaactagaagcacttgtatctacggtggagcaccaaagggaccacaaatacgtgaccttaggagaggagttgaaatcgtcattgcgacaccagggcggttgattgatatgctggaagctggccacactaacctacgtagggttacataccttgtcctggatgaggcggaccgcatgctcgacatgggcttcgagcctcagattcggaaaatattggcacaaatccgtccagacaggcaaaccttgtactggagtgctacatggccaagagaagttgaaacgttggctagacaatttctgcaaaacccttacaaggtaatgataggaacggctgaacttaaagctaaccattctatacagcaaaatgttgaagttatttcagatcatgaaaagtatcccaggctaagtaagctcttatctgatctaatggatgggagccgaatcttgatattttttcaaacgaaaaaggaatgtgataaggtcactcgacaacttagaatggatggatggccagcattatctatacatggtgataaggctcaatctgaaagggactatgttctggctgagtttaagagtgggaagagtcctataatggctgccacagatgtagcagcacgtggtcttgacgtgaaggatataaagtgcgtgatcaactttgatttcccaaccacaattgaggattatattcacaggataggtcgaactggtcgtgctggtgcaactggaatggcatttactttcttcacacactctaatgcaaagtattcgaggaatcttgtcaagatcttgcgtgaagctggccagactgtgaatccagcgctggaatctatgtccaagaatgccggttctatgggaggaggaggcaatttccgctcaaggggtagaggtgggtttggtaaccgttctggatcaaatagcatcccagtacgaagaagatattgatgcaaatgaagaatgatgaagaccattctgattttgaagacaatcaatgatgaaatccgttctggttttgaagacgaacaatgaagttttatctgtatactgtttaggtattcttttgggggaatttctttgatatccctactgctagaatgaccaaaatctattctgttttgtataagggctacggataattatacaaatgacagaaaacttgtgagcaattagtcatatgtattcaagttagatttatcttttaaaattttttggccggcttagtgtt

SEQ ID NO: 1565 - DNA, 3717 bp, Sorghum bicolor
agacttgtgcgaacttcccttgcaaaacagaacaaaaattcagtaaaacgacggaaaaaagaaaagaaaaaaaagaaggccctcccgtccgtcgctaatcccgatcccgatctccaagcaaacccatctccccggctgtcccccactcgccgatccagatctcctccacctctccactcccccactccaaccggacgccctccgccgtcgccggcggcggtcgagccacacgcgcgcgccgcagtggaagccggagcgggcgccggcaatggagcagctgcggacgatcgggcgggagctggcgatggggtcacagggcgggtgggggcagtccaaggagttcctcgacctcgtcaagtccattggcgaggcgcgctccaaggcggaggaggaccgcatcatcgcgcgcgagctcgagcacctcaagcgccgccttgcggaccccgacgtgccacgccgcaagatgaaggagctcctcctccgcctcgtctacgccgagatgctcggccacgatgcctccttcggccacatccatgccgtcaagatgacccacgacgaatcgctcccgctcaaacgaaccggctacctcgccgtcgcgcttttcctcgatgagcgccacgaccttgtcatcctcgtggtcaacaccatccagaaggacctcaggtcggacaactacctcgtcgtctgcgcagcgctcaccgccgcgtgccgcctcatcggtgaggaggccatccctgccgtgctgccccaggtcgtagagctgctcgcgcaccccaaggaggctgtgaggaagaaggccgtcatggcactacaccggttctaccagcgatcaccctcctccgtctcccaccttgtctccaacttccggaagaggctctgtgataatgatcccggggtgatgggtgcaactctatgccccctctatgacctgattttggaggaaccaaattcgtacaaggatttagttgttagttttgttaacatcctaaaacaagttgcggagaggaggcttccgacttcctatgattatcaccaaatgcccgcaccgtttattcagataaaactattgaagatacttgctgtgcttggtagtggtgataaacaagcaagtgggcatatgtacaccgtattgggtgacatattcaggaagggtgacactgcgagcaacattggcaatgctatactgtatgaatgcatatgctgtatttcatccattttcccaaaccctaagatgctagaggctgcagcagaaacaacatcaaagtttctgaagagtgatagtcataatcttaagtacatgggcattgatgctcttggccggctaataaaaataaatccagatattgcagaagagcaccagctggctgtcattgattgcttagaggacccagatgatactttgaagcgcaagacctttgagcttctttataagatgacaaagtcaacaaatgttgaagtgattgttgataggatgattgagtacatgatcaatataactgatcatcattacaagacagaaattgcatcacgttgtgttgaacttgcagagcaatttgcgcctagcaatcagtggttcatccagaccatgaacaaagtctttgagcatgctggagatcttgtcaacatcagagtggcacacaatttgatgcggctaattgctgaaggctttggagaggaggatgaaggtgctgacagtcagctaagatcatcggctgtagattcctatctccgcattgtcggagagccaaagcttccttcttcgttcctgcagataatatgctgggttttgggggaatatggaacagcagatggaaaatattctgcatcttatattatcgggaagttgtgtgatgtggcagaggcccacctcactgatgacactgtcaaggcgtatgcgatctcagcaattctgaagatatttgcgtttgaaatcgcacttggaaggaagattgatttgctgcctgagtgtcaaacactggtagatgaattgtcagcttcacattcaacagacttgcagcaacgtgcatatgagctacaggctttactaggcttggacaaaaatgctgttgaaagtgttatgcctgcagatgcaagttgtgaagatattgaggtcgacagaaacctctcatttctaaacagttatgtgcagcaagccttggaaaatggtgcgtccccttacattccagagagtgaacgctctggtgttataagtgttggcagctacagaagccaagaacaacaggaaacatctgcccatactcttagatttgaggcctatgagatgcctaaaccttcgttgccactagcaacttcacaaacaagcatttccacaccaactactgacctggttccagttccagagacaggctactataaggaagaccatcaaacatcaaggtctcaaccaccaggtgatgcagtttctggtgagtttggtgtcaaacttcgccttgatggggttcaaaagaaatggggaaggccaacatattcctcttctacaccctcaagctcgacgtctagtcaacaaactaccaatgggacctctcattccgatgggggagggtcaagttcgcagccacgggagtcctcgtatggttctaagagacagcagggcacagaagtttcagcagaaaagcaacggctggctgcttcactttttggttcggcagcagctaaagctgataggaaagcacaagcttctagaaagacagcaaaggacagtccctcaactgagaaagtagctaccactaatgtgactgcccagcctgttaaggagcaagtaatccctgctgcaccaccgcctgatctgctggatctgggtgatgagccagtttcatcaaatcctccattggctgatcctttctcacagttagaggggcttcttggaccagcatcggctgctccggtgctttctggaactccggctaccggcgcttccaaagcaccagatctgatgtcaatcttctcagatgatgtaccaactggagtggctagtggatccaccgatcccactctaggtgatgttaattcgacgagctcccacaaaggagcaactgcagtggcttcaaagaagggtccaagccttcaagatgccttgcaaaaggatgctactgcacggcaagtaggcgtgacaccaacagggaacaatcccaatctcttcaaggacttgctaggctaaagaggacagtaggacacaccatatgctccgtgtgtctttgggtaaatggagttcatctccaacatggttccatcaatgaaacagtgatgatctcgctgtttgatcagcataggaaaaaaagggttacaagggctatatttgtttgagagtcagaatacacgacctatctcctttccaattgggagggggttgcactgttgagatttgtggatggttgcgggtatttttcctttaacctcttgtaattttgtgctgagactagtgtacatgtgtttacattacatgatgtgtaatttgtacatgagaccgtggtccagaagcgtgtgctggcgcttttttgttcagctgggaggggcctgctcatctgtgcttttatagtttaccatatttgatgattgatatacactacagtagctgggcattggaaagtataataataattggtgtcattatctgtaactgggtggaataaaatgttaaatgtgtaaggttgttggtcgccttgttttagctgataaaaaccgttgccggatttttac

SEQ ID NO: 1566 - DNA, 3592 bp, Sorghum bicolor
cgatctccaagcaaacccatctccccggctgtcccccactcgccgatccagatctcctccactccaaccggacgccctccgccgtcgccggcggcggtcgagccacacgcgcgcgccgcagtggaagccggagcgggcgccggcaatggagcagctgcggacgatcgggcgggagctggcgatggggtcacagggcgggtgggggcagtccaaggagttcctcgacctcgtcaagtccattggcgaggcgcgctccaaggcggaggaggaccgcatcatcgcgcgcgagctcgagcacctcaagcgccgccttgcggaccccgacgtgccacgccgcaagatgaaggagctcctcctccgcctcgtctacgccgagatgctcggccacgatgcctccttcggccacatccatgccgtcaagatgacccacgacgaatcgctcccgctcaaacgaaccggctacctcgccgtcgcgcttttcctcgatgagcgccacgaccttgtcatcctcgtggtcaacaccatccagaaggacctcaggtcggacaactacctcgtcgtctgcgcagcgctcaccgccgcgtgccgcctcatcggtgaggaggccatccctgccgtgctgccccaggtcgtagagctgctcgcgcaccccaaggaggctgtgaggaagaaggccgtcatggcactacaccggttctaccagcgatcaccctcctccgtctcccaccttgtctccaacttccggaagaggctctgtgataatgatcccggggtgatgggtgcaactctatgccccctctatgacctgattttggaggaaccaaattcgtacaaggatttagttgttagttttgttaacatcctaaaacaagttgcggagaggaggcttccgacttcctatgattatcaccaaatgcccgcaccgtttattcagataaaactattgaagatacttgctgtgcttggtagtggtgataaacaagcaagtgggcatatgtacaccgtattgggtgacatattcaggaagggtgacactgcgagcaacattggcaatgctatactgtatgaatgcatatgctgtatttcatccattttcccaaaccctaagatgctagaggctgcagcagaaacaacatcaaagtttctgaagagtgatagtcataatcttaagtacatgggcattgatgctcttggccggctaataaaaataaatccagatattgcagaagagcaccagctggctgtcattgattgcttagaggacccagatgatactttgaagcgcaagacctttgagcttctttataagatgacaaagtcaacaaatgttgaagtgattgttgataggatgattgagtacatgatcaatataactgatcatcattacaagacagaaattgcatcacgttgtgttgaacttgcagagcaatttgcgcctagcaatcagtggttcatccagaccatgaacaaagtctttgagcatgctggagatcttgtcaacatcagagtggcacacaatttgatgcggctaattgctgaaggctttggagaggaggatgaaggtgctgacagtcagctaagatcatcggctgtagattcctatctccgcattgtcggagagccaaagcttccttcttcgttcctgcagataatatgctgggttttgggggaatatggaacagcagatggaaaatattctgcatcttatattatcgggaagttgtgtgatgtggcagaggcccacctcactgatgacactgtcaaggcgtatgcgatctcagcaattctgaagatatttgcgtttgaaatcgcacttggaaggaagattgatttgctgcctgagtgtcaaacactggtagatgaattgtcagcttcacattcaacagacttgcagcaacgtgcatatgagctacaggctttactaggcttggacaaaaatgctgttgaaagtgttatgcctgcagatgcaagttgtgaagatattgaggtcgacagaaacctctcatttctaaacagttatgtgcagcaagccttggaaaatggtgcgtccccttacattccagagagtgaacgctctggtgttataagtgttggcagctacagaagccaagaacaacaggaaacatctgcccatactcttagatttgaggcctatgagatgcctaaaccttcgttgccactagcaacttcacaaacaagcatttccacaccaactactgacctggttccagttccagagacaggctactataaggaagaccatcaaacatcaaggtctcaaccaccaggtgatgcagtttctggtgagtttggtgtcaaacttcgccttgatggggttcaaaagaaatggggaaggccaacatattcctcttctacaccctcaagctcgacgtctagtcaacaaactaccaatgggacctctcattccgatgggggagggtcaagttcgcagccacgggagtcctcgtatggttctaagagacagcagggcacagaagtttcagcagaaaagcaacggctggctgcttcactttttggttcggcagcagctaaagctgataggaaagcacaagcttctagaaagacagcaaaggacagtccctcaactgagaaagtagctaccactaatgtgactgcccagcctgttaaggagcaagtaatccctgctgcaccaccgcctgatctgctggatctgggtgatgagccagtttcatcaaatcctccattggctgatcctttctcacagttagaggggcttcttggaccagcatcggctgctccggtgctttctggaactccggctaccggcgcttccaaagcaccagatctgatgtcaatcttctcagatgatgtaccaactggagtggctagtggatccaccgatcccactctaggtgatgttaattcgacgagctcccacaaaggagcaactgcagtggcttcaaagaagggtccaagccttcaagatgccttgcaaaaggatgctactgcacggcaagtaggcgtgacaccaacagggaacaatcccaatctcttcaaggacttgctaggctaaagaggacagtaggacacaccatatgctccgtgtgtctttgggtaaatggagttcatctccaacatggttccatcaatgaaacagtgatgatctcgctgtttgatcagcataggaaaaaaagggttacaagggctatatttgtttgagagtcagaatacacgacctatctcctttccaattgggagggggttgcactgttgagatttgtggatggttgcgggtatttttcctttaacctcttgtaattttgtgctgagactagtgtacatgtgtttacattacatgatgtgtaatttgtacatgagaccgtggtccagaagcgtgtgctggcgcttttttgttcagctgggaggggcctgctcatctgtgcttttatagtttaccatatttgatgattgatatacactacagtagctgggcattggaaagtataataataattggtgtcattatctgtaactgggtggaataaaatgttaaatgtgtaaggttgttggtcgccttgttttagctgataaaaaccgttgccggattttt

SEQ ID NO: 1567 - DNA, 3395 bp, Brachypodium distachyon
ccgaacgccaatggagcagctccggacgatcgggcgggagctggcgatggggtcgcagggcgggtgggggcagtcgaaggagttcctggacctcgtcaagtccatcggcgaggcgcgctccaaggcggaggaggaccgcatcatctcccgcgagctcgagcacctcaagcgccgcctcgccgacccggacgtgccccgccgcaagatgaaggagctcctcctccgcctcgtctacgccgagatgctcggccacgacgcctccttcggccacatccacgccgtcaagatgacccacgacgagtccctcccgctcaagcgcacggggtacctcgccgtcgcgctcttcatcgacgagcgccacgacctcgtcatcctcgtcgtaaacaccatccagaaggacctcaggtccgacaactacctcgtcgtctgcgccgcgctcaccgccgcgagccggcttatcggcgaggaggccatccctgccgtgctgccccaggtcgtcgatcttctcgcgcaccccaaggaggccgtgcggaagaaggctgtcatggcgctccaccgattctaccagcgatccccctcatccgtctcccacctcgtctccaacttccgcaagagactctgtgataatgatcctggggtaatgggtgcaactctgtgcccactctatgacctgattttggaagatccaagttcctacaaggatttagtcgttagttttgttaacatcctcaaacaagttgcggagaggaggcttccgacttcctacgattaccaccaaatgcccgcaccatttattcagataaaactattgaaaatacttgctgtgctgggtagtggtgacaagcaagcaagtggccatatgtacactgtcttgggcgacatattcaggaagggtgacactgccagcaatattggcaatgcaatattgtatgaatgcatatgttgtatctcatccatttatcccaactctaagatcatggatgctgcagctgaaacaacatcgaagtttttgaagagtgatagccataatcttaagtacatgggtattgatgctcttggaagactaataaaaataaatcctgatattgcagaagagcaccaattgtctgttatcgactgcttagaggaccccgatgacactttgaagcgtaagacctttgagcttctttataagatgacaaaatcaactaacgttgaagtgattgttgatcggatgattgagtatatgatcagcataaccgatcaccattacaaggcagaaattgcatcccgttgtgttgagctagcagaacaatttgcacccagcaatcagtggttcatccagaccatgaacaaagtctttgagcatgctggtgacctggtcaacattagagtggcacacaatttaatgaggctcattgccgaaggatttggagaggaggatgaaggtgctgatagccaattgagatcatcagctgtagattcctacctccggattctgggggagccaaagcttccctcctcatttttgcagatcatatgctgggttttgggggaatatggaactgcagatgggaagcatcctgcttcttatattattgggaagttgtgtgatgtggcagaggcccacccaactgatgacaccgtccggggttatgcagtatcagcaattttgaagatatttgcatttgaaattgctgttggaaggaagactgatatgttgccggagtttcagtcattggtagatgaactatcagcttcacattcaacagatttgcagcagcgtgcatatgaggtgcaggctttactaggcttgcacaaacaggctgttgaaagtgtaatgccctcagatgcaagctgtgaagatatcgaggtcgaccgaaacctgtcatttcttaacagttatgtgcagcaagccttggacaagggtgcggcaccctacattcctgaaagtgaacgctcaggtgttgcgagtgttggtaactacagaacccatgatcaacatgagacatctgcgcacactcttagattcgaggcctatgagctacctaaaccttcactaccaacagcaacctcacaaaccagcatttccctaccaacaacagaccttgttccagttccagaacaaagctactataaggacgatcatcaaatgtcaaggccccagccgtctggcaatgcactttctggtgaatttggtaccaagcttcgtcttgatggggttcagaagaaatggggaagggaatcctattcctcctcttctaccccttcaagctcaacctctagccaacaagcagccaatgggagcactaactctgatgggggagggttggtggtaagttcacaggcacgagaatcctcttatggttctaagagacagcagggaacagaagtttcagcagaaaaacaacggttggctgcttcactttttggttcctcggctgctaaagccgatcggaagggacatgctggtcggaaggcagcaaaagagagtcactcaactgacaaggtaaatgttgctcatgcagcacctcagcccgccaaggaccaagtaatccctgctgtcccaccgcccgatctgttggatcttggtgagccggtttcatcaagtgccccatcagctgaccccttctcgcagttagatggactccttggtccagcatcagcctctcccgtgctttctggaacctctgctcccagcgcttccagtacaccagatcttatgtcaatcttctcggatgatgtacaaactggatccaccagtggatccacagatgccacagtaggtgatgttcatttgaaaaactcccagaaaggagcaacttcggttgctgcaaaaaagggccatagccttcaagatgccttgcagaaggacgccactgcacgccaagttggtgtgactccgacagggaacaatcctaatcttttcaaggacttgctaggctagaatatacatcagatgttgagtgcacacaagttgggtaagagaagtttgcccccaagacattccgatcggtgaaccggtgatgatcacgctgtttgatcagcacaggaacaagaggtatatttggttttgagtcacaaggcacgacctttccccctcttgactgggaggggtttgtgtggttgagagatggacgtttgcgggtaaatttcctcgcatttttcgcatgacaatttcttgttgagactagtgtacatgtgtttgttacatgatgtgtaatttgtacatgcatgatgaggctgggtccagaaggcgtgtgcctgtgctcttttgttcagttggatgggggcctgtcacgtcgatgttcaagatttacccatattggatatacagtagctggacatttggaactaaaatactgtgtcatcgattcctttttgaactggatgaaataaaaatgcaagtctgtcaa

SEQ ID NO: 1568 - DNA, 3782 bp, Zea mays
tataaacaaacactcctaaatgaagtgattaaaataggtcttccaaataaaatttttaggaactaaagtttctccttaaaatataagaggatgactgaagaaaccaaacacctacttacattattttgaaacatattagtacacggtttaaattttcgtacaaccgaggagtgaaaaacagacttgttctaacatccttgcaaaacagaacaaaatcagtaaaacgacggaaaagaaaagaaaaaaaacaggaaaaggccctcacctccgtcgctaatcccaatcccgatctccaagcaaacccacctccccggctgtcccccactcgccgatccagatctcctccactccaaccggacgcctccgccgccgctggcatcggtcgagccacacgcgcacgccgctgaggaacccggagcgggcgccggcaatggagcagctgcggacgatcgggcgggagctggcgatggggtcgcagggcgggtgggggcagtccaaggagttcctcgacctcgtcaagtccatcggcgaggcgcgctccaaggcggaggaggaccgcatcatcgcgcgcgagcttgagcacctcaagcgccgcctcgccgaccccgacgtgccacgccgcaagatgaaggagctcctcctccgcctcgtctacgccgagatgctcggccacgacgcctccttcggccacatccacgccgttaagatgacccacgacgagtcgctcccgctcaagcggaccggttacctcgctgtcgcgctctttctcgacgaacgccacgacctcgtcatcctcgtggtcaacaccatccagaaggacctcaggtcggacaattacctcgtcgtctgcgcagcgctcaccgccgcgtgccgccttatcggtgaggaggccatccctgccgtgctgccccaggttgtagagctgctcgcgcaccccaaggaggctgtgaggaagaaggccgtcatggcactacaccggttctaccagcgatccccctcctccgtctcccacctcgtctccaacttccgcaagaggctctgtgataatgatccaggggtgatgggtgcaactctttgccccctctatgacctgattttggaggaaccaaattcgtacaaggatttggttgttagttttgttaacatcctcaaacaagttgcagagaggagactaccgacttcctatgattaccaccaaatgcccgcaccattttgtgtctgtcatctgcagataaaactattgaagatacttgctgtacttggtagtggcgataaacaagcaagtgggcatatgtacactgtattgggtgacatattcaggaaaggtgacactgcaagcaacattggcaatgctatactgtatgaatgcatatgctgtatttcattcattttcccaaaccctaagatgctagaggctgcagctgaaacaacatcaaagtttctgaagagtgatagtcataatcttaagtacatgggtattgatgctcttggccggctaataaaaataaacccagatattgcagaagagcaccagctagctgtcattgattgcctagaggatccagatgacactttgaagcgcaagacctttgagcttctttataagatgacaaaatcaacaaatgttgaagtgattgttgataggatgattgaatacatgatcaacataactgatcatcattataagacagaaattgcatcacgttgtgttgaacttgcagagcaatttgcgcctagcaatcagtggttcatccagaccatgaacaaagtctttgagcatgccggagatcttgtcaacatcagagtggcgcacaatctgatgcggctaattgctgaaggctttggagaggaggatgaaggtgctgacagtcagctaagatcatcggctgtggattcatatctccgcattgtcggagagccaaagcttccttcttcgtttctgcagataatatgctgggttttgggggaatatggaacagcagatggaaaatattcagcttcttatattattgggaagttgtgtgatgtggcagaggcccacctcactgatgacactgtcaaggcatatgcgatctcagcaattctgaagacatttgcgtttgaaatcactcttggaagaaagatcgatttgctgcctgagtgtcaaacattggtagatgaattgtcagcttcacattcgacggacttgcagcaacgggcatacgagctacaggctttactaggcttggacaaaactgctgttgaaagtgttatgcccgcagatgcaagctgtgaagacattgaggtcgacagaagcctctcatttctaaacagttatgtgcagcaagccttggaaaatggtgcgtccccttacattccagagagtgaacgctctggtgttataagtgtcggcagctacagaagccaagaacaacaggaaacatctgcccatactcttagatttgaggcctatgagatgcctaaaccttcgttgccactagcaacttcacaaaccagcatgtccacaccacctactgatctggttccagttccagaggcaggctactacaaggaagacaatcaaacatcaatgtctcaaccaccaagtgatgcaatttctggtgagtttggtgtcaaacttcgccttgatggtgttcaaaagaaatggggaaggccaacatattcttcttctacaccctcaagctcgatctctagtcaaccaacacccaatggggcctctcattctgatgggggagggtcaagttcgcaaccacgggagtcatcatacggttctaagagacagcagggcacggaagtttcagcagaaaagcaacggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccagcatcggctgccccggtgctttctggaactccggctaccagcacttccaaagcaccaggccttctgtcaatcttctcagatgatgtaccaaccggagtgactagtgtgtccaccgatcccactctaggtgatgttaattcgatgggctcccgcaaaggagcagctgcagtggcttcaatgaagggcccgagcctccaagatgccttgcaaaaggatgcggctgcacgacaagtaggagtgacaccaacagtgaacaaccccaatcttttcaaggacttgctaggctgaaggggacagtagggcacaccatatgctctgtgtggcctctttgggtacgtggagttcgtctccgacatggttcgatcaccgaaacgacgccgaactcgctgtttgatcagcgtaggctggggttttagggttacaagggctaatatttgtttgagagtcacaagacacgacctatctccttccaattgtggtttgtggagatttgtggattgttgcgggtattttttttcctttacgctcttgtaattttgtcctgagactggtgtacatgtgtctacatgatgtgtaatttgtacatgaagaccatggtccgtccagaagcgtatgccgtcgtctttttgttcattcatgtaggaggggcatgctcatctgtgctttcagagtttcccatatatgttgattaatataacaattgatgtcattctctgga

SEQ ID NO: 1569 - DNA, 3449 bp, Hordeum vulgare
gagatctccactccctcacacctcccccgccccccctcaccggagactcccgtcgccggcggccaccgaccggcctccgccccctccgcatctcccggcgggcggacgcacgcaatggagcagctccggacgatcgggcgggagctggcgatggggtcgcagggcgggtgggggcagtcgaaggagttcctggacctggtcaagtccatcggcgaggcgcgctccaaggcggaggaggaccgcatcatctcccgcgagctcgagcacctcaagcgccgcctcgccgaccccgacgtcccgcgccgcaagatgaaggagctcctcctccgcctcgtctacgccgagatgctcggccacgacgcctccttcggccacatccacgccgtcaagatgacccacgacgagtccctcccgctcaagcgcaccggctacctcgccgtcgcgctcttcatcgacgagcgccacgacctcgtcatcctcgtcgtcaacaccatccagaaggacctcaggtccgacaactacctcgtcgtctgcgccgcgctcaccgccgccagccgcctcatcggcgaggaggccatccccgccgtcctgccccaggtcgtcgatctcctcgcgcaccccaaggagtccgtcaggaagaaggccgtcatggcgctccaccgattctaccagcgatccccttcctccgtttcccacctcgtctccaacttccgcaagagactctgtgataatgatcctggggtgatgggtgcaactctgtgcccactctatgacctgattttggaagatccaaatgcctacaaggatttagttgttagttttgttaacatcctcaaacaagttgcggagaggaggcttccgacttcctacgattaccatcaaatgcccgcaccattcattcagataaaactactgaaaatacttgctgtgctgggtagcggcgacaagtcagcgagtggtcatatgtacactgtcttgggcgacatattcaggaagggtgacacagcaagcaacattggcaatgcaatattgtatgaatgcatatgctgtgtctcatgcattttcccaaactctaagatgctagatgccgctgctgaaacaacatcgaaatttttgaagagtgatagccataatcttaagtacatgggaattgatgctcttggacgactaataaagataaatgctgatattgcagaacagcaccaattggctgttatcgattgcttagaggatcccgatgacactttgaagcgcaagacctttgagcttctttataagatgactaaatcaactaatgttgaagtgattgttgatcggatgatcgagtacatgatcagcataactgatcaccattataaggcagaaattgcatcgcggtgtgttgagctagcagaacaatttgcgcccagcaatcagtggttcattcagaccatgaacaaagtctttgagcatgctggggaccttgtcaacattagagtggcgcacaatttaatgcggcttattgctgaaggatttggagaggaggatgaaggtgccgatagtcaattgagatcatcagctgtcaattcctacctccggattctgggggagccaaagcttccatcctcatttttgcagatcatatgctgggttttgggggaatatggaacagcagatgggaagcatcctgcttcttatattatcgggaagttatgtgatgtggcagaggcccacccaactgatgacactgtcaggggttatgcagtctcagcaattttgaagatatttgcatttgaaattgctgttggaaggaaatctgatatgttgcctgagtttcagtcattggtagatgaattgtcatcttcacattcgacagacttgcagcagcgtgcatatgaggtacaagccttgctaggcttggacaaacaggctgttgaaagtgtaatgcccatagatgcaagctgtgaagatattgaggtcgatagaaacctctcatttctgaacagctatgtgcagcaagccttggaaaatggtgcgacaccttacattcctggaagtgaacgctcaggtgttgtaagtgtcggtaactacagagcccaagaccaacatgagacatctgctcatgctcttagatttgaagcctatgagctacctaaaccttcactacctacagcaacctcacaaagtagtgtttccctgccaactactgaccttgttccagttccagaaccaagtcactatagggaagaccatcatcagacaaggtcccagccatcaggcaatgcagtttctggtgaatttggtgccaaacttcgtcttgatggggttcaaaagaaatggggaagggaatcctatgcctcctcttctacaccttcaagctcggcatctagccaacaaccagccaatgggggctctaactctgacgggggaggcttggtaacttcacaggcacgggagtcctcgtatggttccaagacccagccgggaacagaagtttcagcagaaaagcaacggctggctgcttcactttttggttcctcagctgctaaacctaatcggaagggacatgctggtcggaaggcaacaaaagagagttcctcgactgagaaagcagcacctcagcctgctaaggagcaagtaacccctgctgctccaccaccagatctgttggaccttggtgaagagcctgtttcatcaagtgctccatctgctgaccccttctcgcagttggacgggctccttgggccagcatcagcctctcccgcgcttgccggaacctcagctcccagcgcttcaaacacaccagaccttatgtccatcttctcggatgatgtgcaaactggagccacaagtgcatccacagaacccgcacaaaaaggagcaacgacgaaaaagggccatagccttcaagacgcattgcagaaggacgccaccgcgaggcaggttggcgtgaccccaacagggaacaacccaaatcttttcaaggaccttctaggctagaatataccgcagaatttcagtgtgcacaagttgggcaaaatgaggctgcccccaagagggtcttgtcggtgaacggctgcttgatcagcacaggagcaagcggtgtatttggtttttgagtcgcaaggcacgaccttccttgtccaagttgggaatggggttgatgggcggacgtgtctgcggggtaattttcctgtcgcgtttttttcgcatggcaaaaattcgtgtcaagacttagtgtgtacatgtgtttattacatgatgtgtaatctgtacatgatgatgagtcccagggtccagaagcgtttcttttgttgagctcgagggagggggggagggcctgtggtgtcgagtcgatgtttgttattttacccatattggacatacacagtagactggacactggaaaactagaaataccttgtgttgtcaattccttttagaactgggcggaataaaatgtaagttta

SEQ ID NO: 1570 - DNA, 3001 bp, Brachypodium distachyon
acgccaatggagcagctccggacgatcgggcgggagctgggcgatggggtcgcagggcgggtgggggcagtcgaaggagttcctggacctcgtcaagtccatcggcgaggcgcgctccaaggcggaggaggaccgcatcatctcccgcgagctcgagcacctcaagcgccgcctcgccgacccggacgtgccccgccgcaagatgaaggagctcctcctccgcctcgtctacgccgagatgctcggccacgacgcctccttcggccacatccacgccgtcaagatgacccacgacgagtccctcccgctcaagcgcacggggtacctcgccgtcgcgctcttcatcgacgagcgccacgacctcgtcatcctcgtcgtaaacaccatccagaaggacctcaggtccgacaactacctcgtcgtctgcgccgcgctcaccgccgcgagccggcttatcggcgaggaggccatccctgccgtgctgccccaggtcgtcgatcttctcgcgcaccccaaggaggccgtgcggaagaaggctgtcatggcgctccaccgattctaccagcgatccccctcatccgtctcccacctcgtctccaacttccgcaagagactctgtgataatgatcctggggtaatgggtgcaactctgtgcccactctatgacctgattttggaagatccaagttcctacaaggatttagtcgttagttttgttaacatcctcaaacaagttgcggagaggaggcttccgacttcctacgattaccaccaaatgcccgcaccatttattcagataaaactattgaaaatacttgctgtgctgggtagtggtgacaagcaagcaagtggccatatgtacactgtcttgggcgacatattcaggaagggtgacactgccagcaatattggcaatgcaatattgtatgaatgcatatgttgtatctcatccatttatcccaactctaagatcatggatgctgcagctgaaacaacatcgaagtttttgaagagtgatagccataatcttaagtacatgggtattgatgctcttggaagactaataaaaataaatcctgatattgcagaagagcaccaattgtctgttatcgactgcttagaggaccccgatgacccgtcgaagcgtaagagctttgatggcttctgaataagatgacaaaatcgactaacgttgaagtgattgttgatcggatgattgagtatatgatcagtataatcgatcaccattacaaggcagaaattgcttcccgtcgtgtggagctagcagaacaatttgcacccagcaatcagtggtacatccagaccatgaacaaagtctttgagcatgctggtgacctggtcaacattagagtggcacacaatttaatgaggctcattgccgaaggatttggagaggaggatgaaggtgctgatagccaattgagatcatcagctgtagattcctacctccggattctgggggagccaaagcttccctcctcatttttgcagatcatatgctgggttttgggggaatatggaactgcagatgggaagcatcctgcttcttatattattgggaagttgtgtgatgtggcagaggcccacccaactgatgacaccgtccggggttatgcagtatcagcaattttgaagatatttgcatttgaaattgctgttggaaggaagactgatatgttgccggagtttcagtcattggtagatgaactatcagcttcacattcaacagatttgcagcagcgtgcatatgaggtgcaggctttactaggcttgcacaaacaggctgttgaaagtgtaatgccctcagatgcaagctgtgaagatatcgaggtcgaccgaaacctgtcatttcttaacagttatgtgcagcaagccttggacaagggtgcggcaccctacattcctgaaagtgaacgctcaggtgttgcgagtgttggtaactacagaacccatgatcaacatgagacatctgcgcacactcttagattcgaggcctatgagctacctaaaccttcactaccaacagcaacctcacaaaccagcatttccctaccaacaacagaccttgttccagttccagaacaaagctactataaggacgatcatcaaatgtcaaggccccagccgtctggcaatgcactttctggtgaatttggtaccaagcttcgtcttgatggggttcagaagaaatggggaagggaatcctattcctcctcttctaccccttcaagctcaacctctagccaacaagcagccaatgggagcactaactctgatgggggagggttggtggtaagttcacaggcacgagaatcctcttatggttctaagagacagcagggaacagaagtttcagcagaaaaacaacggttggctgcttcactttttggttcctcggctgctaaagccgatcggaagggacatgctggtcggaaggcagcaaaagagagtcactcaactgacaaggtaaatgttgctcatgcagcacctcagcccgccaaggaccaagtaatccctgctgtcccaccgcccgatctgttggatcttggtgagccggtttcatcaagtgccccatcagctgaccccttctcgcagttagatggactccttggtccagcatcagcctctcccgtgctttctggaacctctgctcccagcgcttccagtacaccagatcttatgtcaatcttctcggatgatgtacaaactggatccaccagtggatccacagatgccacagtaggtgatgttcatttgaaaaactcccagaaaggagcaacttcggttgctgcaaaaaagggccatagccttcaagatgccttgcagaaggacgccactgcacgccaagttggtgtgactccgacagggaacaatcctaatcttttcaaggacttgctaggctagaatatacatcagatgttgagtgcacacaagttgggtaagagaagtttgcccccaagacattccgatcggtgaaccg

SEQ ID NO: 1571 - DNA, 3556 bp, Zea mays
attcgtcgctaatcacaatcccgatctccaagcaaacccacctcccgtcagttccctactcgccgatccagatctcctacagctttccactccgccactccaaccggacgcctccgccgtcgccggcggcggtcgagccacgcgcgcacgccgctgaggaacccggagagggcggcggcaatggagcagctgcggacgttcgggcgggagctggcgatggggtcgcagggcgggtgggggcagtccaaggatttcctcgacctcgtcaagtctatcggcgaggcgcgctccaaggcggaggaggaccgcatcatcgcgcgcgagcttgagcacctcaagcgccgcctggccgaccccgacgtgccacgccgcaagatgaaggagcttctcctccgcctagtctacgccgagatgctcggccacgacgcttccttcggccacatccacgccgtcaagatgacccacgacgagtcgctaccgctcaagcgtaccggctacctcgccgtcgcactcttcctcgacgagcgccacgacctcgtcatcctcgtggtcaacaccatccagaaggacctcaggtcggacaactacctcgtcgtctgcgcagcactcaccgccgcgtgccgccttattggtgaggaggccatccccgccgtgctgccccaggtcgtagatctgctcgtgcaccccaaggaggctgtgaggaagaaggccgtcatggcattacaccggttctaccagcgatcctcctcctccgtttcccacctcgtctccaacttccgcaagaggctatgtgataatgatccaggggtaatgggtgcaactctatgccccctctatgacctgatttcggaggaaccaaattcgtacaaggatttggttgttagtttcgttaacatcctcaaacaagttgctgagaggaggcttccgacttcctacgattatcaccaaatgcctgcaccatttattcagataaaactattgaagatacttgctgtgcttggcagtggtgataaacaagcaagtggacatatgtacactgtattgggcgacatattcaagaagggtgacactgcgagcaacattggcaatgctatactgtatgaatgcatatgctgcatttcatccattttcccaaaccctaagatgctagtggctgcagctgaaacaacatcaaagtttctgaagagtgatagtcataatcttaagtacatgggcattgatgctcttggcaggttaataaaaataaatccagatattgcagaagagcaccagctggctgtcattgattgcttagaggacccagatgacactttgaagcgcaagacatttgagcttctttataagatgacaaagtcaacaaatgttgaggtgattgttgataggatgattgagtacatgatcaacataactgatcatcattacaagacagaaattgcatcacgttgtgtcgaactcgcagagcaatttgcgcctagcaatcagtggttcatccagaccatgaacagagtttttgagcatgctggagatcttgtcaacatcagagtggcacacaatttgatgcggctaattgctgaaggctttggagatgaggacgaaggtgctgacagtcagctaagatcatcggctgtagattcttatgtccgcattgtcggagagccaaagcttccttcttctttccttcagataatatgctgggtgttgggggaatatggaacagcagatggaaaacattcggcttcttatattattgggaaattgtgtgatgtggcagaggcccacctcactgatgacactgtcaaggcgtatgcaatctcagcaattctgaagatatttgcgtttgaaatcgctcttggaaggaggattgatttgctgcctgagtgtcaaacattggtagatgaattgttagcttcacattcaacagacctgcagcaacgggcatacgagctacatgctttactaggcttgggcaaaaatgatgttgaaagtgttatgcctgcagatgcaagctgtgaagatattgaggtcgacagaaacctctcatttctagacagttatgtgcagcaagccttggaaaacggtgcatcaccttacattccagagagtgaacgctctggtcttacaagtgttggcagctacagaagccaagaacaacaggaaacatctgcccgtactcttagattcgaggcctatgagatgcctaaaccttctttgccactagcaacttcacaaaccagcatgtccacaccaaatactgaccttgttccagtttcagagccaggctactataaggaagaccatcaaacatcaaggcctcaaccaccaagcgatgcggtttctggtgagtttggtgtcaaactccgccttgatggggttcacaagaaatggggaaggccaacatattcctcttccacaccctcaagctcgatgtccagtcaacaaacaacaaatggggcctctcattctgatgggggagggccaagttcacagccacgggagtcctcatacggttcgaagagacagcagggcacagaagtctcagcagaaaagcaacggctggctgcttcgctttttggttcggcagcagctagagctgacaggaaagcacaagcttctcgaaagacagcgaaggacagtccctcaactgagaaagtagctaccactaatgtggctgcccagtctgttaaggagcaagtaatcccagctgctgcaccaccgcctgatctgctggatctgggtgacgagacagttccatcgagccgtccatcggctgaccctttctcacagttggtgggtcttcttggaccagcatctgctgctccggcgctttctgggactccggctaccactaccagtacttccaaagcaccagatcttatgtcaatcttctcagatgatgtaccaactggagtgactagtagtgggtccaccgatcccactccaggtgatgctatttcggtgagttcccacaaaggagcgactgcagtggcaccaaagaagggctcgagccttcaagatgccttgcaaaaggactcgactgcacggcaagtaggtgtgacaccgacagggaacaaccccaatcttttcaaggacttgctaggctaaaggggacagtaaggcacaccgtatgctccgcgtggcctctttgggtagatggagttcatctccgacatgtctcgatcactgaaacagcgatgatctcgctgtttgatcagcgtaggaaaagggttgcaaggggctatatttgttctcgagtcacaagacacgacctgttctccttccagttgggaggggggttgcgctgttgagatctgtgaatggttgcgggtatttttcctttaacctcttgtgattttgtgctgagactattgtacatgtgtttacatgacgtgtaatctgtacatgagaccgtggtacagaagcgtgtgccggcgcatttttgttcagctgggctagatacactacaattgctgggcactggaaagtaaaacaatgaaagaattggtgtcattctctggctggaataaaaatataaaacggtaaatgtgtagtgttgttt

SEQ ID NO: 1572 - DNA, 5897 bp, Brachypodium distachyon
atgtcgccccctctccaggcgcccgactacaagcacgtcacggaggagtgcctccgcgagtggaagggccagcccgccgccgccgccgccttccgcgtccccgatccggtccccatggcgcgcttcctctacgagctctgctgggcggtggtgcggggggacctgccgccgcagaagtgccgggtggctctggactcggtggagtttgtggaggaggcgcagcgaggggaggtcggctcagtactcgccgacatcatcgcccacctagggcaggatgttacaatctctggtgaatatcgcagccgtcttgtcaaaatgaccaaatcatttgtggagtcgtcattgattgcgcctaggctccttcaagagcgatgcgaggaagagttcctctgggaggttgaactgagtaagtcaaaggggcaggatttgaaggctaaggaggtcagggtcaacacacgtctcctttatcagcaaactaaattcaaccttttaagagaggaaagtgagggctacgccaaattggtaaccctcctttgtcaaattggttcagatttggcttgtcaaaattcttcttcagttactatgagcattataaagtcattgattgggcattttgacctggacccaaatcgtgtgtttgatattgttctggaatgttttgagctctatccggataataccatcttttgtcagcttatacctcttttccctaagtcccatgctgctcaaatattggggttcaagttccaatattaccaacgattggatgtcaatagcactgttccacctgggcttttccggatagcagctttgttggtcaaatctggttttattgaccttgatagcctctatgctcatttacttccaaatgatgatgaggcatttgagcattttgactccttcgtcacgaggaaaatcgatgaggctagtaatataggcaaaataaatcttgctgccactgggaaggaccttatggatgacgagaagcaagaaataactattgatttgtacacagcattggagatggaaaatgatataattgatgagcgagcccctgagattgaaaagaaccagaaacttggacttcttcttggtttcctgtcagttcatgattgggatcatgcacaactcctctttgagcgtcttgcacgcctaaatcctgttgagcatgttgaaatttgtgatagtttatttagacttattgaaaggagtatttcttcagtctatgatataattttccaaacacattataagatgcctcgtaaccctgtttatatgatggacacatcaccttcctcttcacaaagtttttcggttgatccgccgaaagagtttttccaaatgctttctgcttgtggaccataccttcatcgtaacacacaattatttcagaaggtttgcagagtacttaaagcgtaccatctgtcagcaaaagagtcaatccgtacagcaggtgtaatgtctccagactcgcgaattgaagaagcacttggatcgtgcttgctaccatcattgcagcttatacctgcaaatcctgctgttgatatggagatatggggagttctttctcttcttccttatgagacccgttatcgcttatatggtgaatgggagaaggataccgaacaaaacccaattgtccttgctgcaaggcaaactgcaaagttggataccagaaggctcttaaagcggcttgctaaggaaaatctgaagcaacttggccgcatggtggctaaacttgcccatgcaaatccaatgacagtacttcggacaattatccaacaggttgaagcatatagggacatgataactccagtcgtcgatgcttttaaatacttgactcagctggagtttgacatcttgcaatatattgtaattgaacgcttggctcaaggtggccgtgagaaacttaaagatgatggtcttaatctatctgattggcttcagtgtcttgcatcattctgggggcacctctgcaagaagcatctttgcatggagctaaaatgccttttccaatacattgttaatcaactgaagaaaggattgggcactgagcttgttgtactggaggaactgattcagcaaatggcaaatgtacagtatactgagaacatgacagatgaacaggttgatgctatggcagggagtgaaacattgcggcttcaagcttcatcactatttggatcaacaagaaattctaaggttctgaccaagtctacaaacaaattgagggattctttgcttccaaaagaagaacctaaacttgccattccccttttactgcttattgctcagcatcgatccaagattataattaatgctgatgccacatatatcaaaatggtcagtgagcagtttgatcggtgccatggaatactacttcagtatgttgagtttctttcaactgcagtaactccaacaacttatgttcaactaatacctccgctggaagatctgattaataagtatcatatcgagcctgacgttgcttttcttatataccgacctgtgatgagacttttcaaaagcactaatggaggtgacacctattggcctttggatgacaatgaagaaggggagtctgtatcatgtgatgatctgatattgcatcctgacacatctcataagtcaatcataagcgtagacataataagaatgaaaaaggttaaagcgagacaatggatgaccttggggtccctggaaggttggtggtctgatcttcttagcacagtccggaacactttcccagcaaaaacctggaatggtttatcacctgatttatatgctactttctgggggttaacactatatgatcttcatttccccaaagatcgttatgatgcagaaataaagaagctgcatgaaaatcttaaacaactggaagataattcggataactctagtattgcaatctcacgacgcaagaaggacaaggagagaatccaagatttgcttgacaaattgaacaatgaatcacataagcaccaacaacacattgcatcagtgctccaaaggctaggtcgtgaaaaggttaagtggttaaattccagtccagatgctctgaagatcaacatggaatttttccagcgctgcatattccctcgctgtgtttttagcatgcaagatgctgtgtattgtgctatgtttgtccaaacactgcactcactcgagactccatttttcaacacggtgaatcatatcgatgttttcatctgcaaaactctacagccaatgatttgttgctgcacagagtatgaggctggcaggctgggaaggtttcttcatgagacactgaagatggcctaccgttggaagagcgatgaatctttatatgagcgtgaatgtggaaataagccaggtttcgctgtgtacatcagatatccaaatagccagcgtgtatcttatagccagtttgttcgagttcattggaagtggagtggacgaataactaaggtgctgaaccagtgcatggaatcaaaagaatacatggaaatcagaaacgcccttattgtgctcacaaagatatctagcatttttcctgtgatacgcaaaagtggagtcaatcttgagaaacgtgttgctaagctgaagggggatgaaagggaagatctgaaagttctggcaactggtgtagctgctgctttggcagcccgcaagagctcatggctatctgaagaagagttcggcatgggtctccttgatcttaagcaagggccagcaaaaattgtgcctggaaatcaatcagcagatcctttgacagcaaaagatcagagtgttcgtgcaaaatccattgagggtaggcatgaacggtcagaagctgccatgaagcctgatgctcaacaaaagaaaaatgccttggctgcaaatggatctgataaccaaatgccatcttcttctgcacaaggaaaagtttcagggattatacgaggttctgatgaacctcccaaacttctatctgatgagggagttaaggtttcaaagcctactgcagaatctgagacaagggtgccccaaaagcgtgtggcacacaatgctggcaaggtatctaagcatgatatggtaaaggaagatacaaaatctgggaaatctacaaacagaggtgttactcaacaaggctcctctgttcctgttgataaagaagtattgtctcaggcagctgatggtgtgcaagataccaccagtaattctttggctgctagcaatggtaacttacatacggctccacggaaggtatcagcatcctcccaaaaatcaacactgttggctacacatactggtggagcagctaattcctctggtgaatctactgacttgattgactctaatatgaaacagcaaaagaggtttgttcctactgaagaacaagatagaggaactaaatggaggaaaggagagagtgaaggccgggatggtgacttcacagaacacactgacaaggacagaaatttggactcgcgattggtagataaatttcgtcccatggatcatgacaagagtgctagcgaggaacaaatcctaagtaggccagagaaatcaaaagaaaaggctgatgacaaatatgaccgggatcctagagaaaaagcagatcgaactgagaggcgtcgaggggaagacatcgagagaccaacagacaaatcattggaaaggagagagcgttctattgaaagaatgcaagaaagagggacagatagagctcctgataaaggaagagaagacaggaataaggaggagagaaataaagttaagcatgctgaaccatccatagatcgtgcacatccttctgatgaacggttccgaggacaaagcttgccaccacctccaccccttccagcaagttttgtaccccaatcagttggtaacaggagagatgaagataccgatcgaaggggtggtagtactaggcataaccaacgatcatctcctaggcgtgatgataaagaaaagtggcacttggaggacaatgctgcgtcgttgcaggatgatggaaagcaccggagagaggaagatattcgggacagaaagcgtgaagatagggatgtttcgtcaagcaaggtagatgaccgggatagggacaaaagtagtattgtgaaggatgaaagtgatcctaatagtgcttccaaacggcgaaagatcaagagagatcagtctggtttagaagctggggaatacgcaccttctgctccacagcttcccagtcatggaaccagtagctcacaagtgtttgaaacacgagagcgagaacgaaagggggcaatttcacagcatcggatatcccatgctgatgaccttcctagaatacatggaaaggactcgagcaagacaagtcgtagagaggctgaccaagtacatgagagagaatgggaagaggaaaagcgatcaagaacggaaactaaaaggaagcaccggaagtaggataattgttggaattttgttagatgcaaaacaagtcatgaattctcctgagctttacaaagaagcacatgatcagcaatgtacaacatcacatatttcatcgtattaacaggccattcagaggtacatgctgcaccagaatttttagaaataccttgattgaaggtgcagtttggtcctatcgcgtaacacgaacagaagttgtggatacatgacatttgtttaactcttatgtattctgttgtttgaacaatttggaatgcagagtacagacttaatggcctaacctttgatcttgtgatgtaaacttggatgagctgttcgccgtccagctattttgtaactctactaaccgcagatatgttcgttgtaggaagaattttgattgcaatttttgcactgtgtaggaataatgctaggggacaacaggcttgcacggttgtacatactacagttaacaatgtgtgcatgatcctatttttgta

SEQ ID NO: 1573 - DNA, 5345 bp, Brachypodium distachyon
caacacccgcgtccgctgccatgtcgcctcctctccaggcgccggactacaagtacgtcaccgaggagtgcctccgcgaatggaagagccagtccgccgccggcttccgcctccccgatccggtccccatggcgcggttcctctacgagctgtgctgggcgattgtgcggggcgaccttccgccgcagaagtgccgggtggcgctggattcggtggtgttcgtggaggaggcatggcacgaggagtccggctctgtgctcgcggacatcgtcgcccacctagggcaggatattacaatttctggcgagtatcgcaaccgccttgtcaaaatgactaagtcatttgtggagtcttcgttgattgtgcctaggcttcttcaagagcgatgtgaagaagagttcctatgggaggttgagcagagtaagtccaagggccaggatttaaaagccaaagaggtcagagtcaacacgcgacttctttatcagcaaactaaattcaaccttttaagagaggaaagcgagggctacgccaagttggtcaccctactttgtcaagttggttcagatttggcttgccaaaatgcttcttcagctactatcagcattataaagtcattaattgggcactttgacctggacccgaatcgcgtatttgacatagtgttggaatgttttgaactctatccagataacagtaccttttaccagcttatacctctttttccaaagtcccatgctgctcaaattttagggttcaaattccaatactatcaacaattggatgtcaacagccctgttccatctggtcttttccgaatagcagccttgttggtgaaatctggtcttattgatcttgataatctctacgcccatttacttccaaatgatgatgaggcattcgagcattttgggtcctttgtttcaaggagaattgatgaggctactaaaatcggcaaaataaatcttgctgctactgggaaagaccttatggatgatgagaagcaagaaataacaattgatttgtacacagcattggagatggagaatgatataattgaggagcgagcccctgagatagaaaagaaccagaagcttggacttcttcttggtttcctctcagttcatgattgggatcacgcccagctactctttgagcgtctcgcacagctaaatcctgtcgagcacattgaaatttgtgatggattatttagagttattgaaaagactatttcatcagcctacactatatattgtcaagcacatcataaaatccccggtaacatcgacactcacatggtagaagcatcatctgtctcttcaccaagttatttggttgatctgccgaaagagtttttccaaatgcttgctgcttgtggaccgtaccttcatcgtgacacacaattatttcagaaggtttgcagagtgctaaaagtgtatcacgtccgatcaaaagactcagcacgtacagctggtgtaatgtcttcagaatctcgtgtcgaggaagcacttgggtcatgcttgcttccttcattgcagcttatacctgctaatcctgctgttgatatggagatatggggagttctttcccttcttccttacgaggtacgctatcggttgtatggtgagtgggagaaggacactgaacaaaatccaattgtccttgctgcaaggcagacagcaaagctcgacaccagaaggctcttaaaaaggctggccaaggaaaatcttaagcagcttggccgcatggtggctaaacttgctcatgcaaatccaatgaccgtacttcggacaattgtcacacaggttgaagcatacagggacatgataaatcctgttgtggatgcttttaaatacttgacccagctggagtatgatatcttgcaatatattgtaattgaacggttggctcaaggtggtcgtgagaaagtaaaagatgatggtcttaatctgtcagactggcttcagtgtcttgcatcattttggggacacctctgcaagaagcatctttccatggagctaaaatgccttttccaatacattgttaatcaactgaagaaaggattgggcaccgagcttgttgtactggaggaactgattcagcaaatggcaaatgtacagtatactgagaacatgacagatgaacaggttgatgctatggcagggagtgaaacattgcggcttcaatcttcactatttggatccacaaggaattataaggtcctgaataagtctatgaataagttgcgggattctttgcttccgaaagatgaaccaacacttgctattcctctattactgcttattgctcagcatcgatctaagattataataaatgcagatgctacatatatcaaaatggtcagcgagcagtttgatagatgtcatggtatactgcttcagtatgctgagtttctttcaagtgctgtaactccagcgatctatattcaactaatacctccactggaagatttggtttataaatatcatattgagccagacgttgctttccttatataccgcccggtgatgaggcttttcaaaagcgcaaatggcggtgacacctgttggcctctggatgacaatgaagaaggggagtctgtgtcttgtgatgatatgatcttgcatggtgattcatctcagaagttaatcatgtggtctgatcttcttaacacaatccggacaattttgccaacaaaagcctggatcgctctttcacctgagttatacgctactttctggggtttaacactatatgatcttcattttccaaaagatcgttatgatgcagaaatcaagaagctgcatgacaatctgaaacaacttgaagataactcagataattctagcattgcaatatcacgacgtaagaaggataaggagagaatccaagatttacttgacaaattgaacaatgaatctgagaagcaccaacaacatgtcgtatcagtgttccaaaggctaacccgtgaaaaggacaagtggctgagttctagtccagacgcactgaagattaacatggaatttctccagcgttgcgtatacccacgctgtgttcttagcatgcaggatgctgtgtattgcgctacatttgtccagacgatgcattcacttgggactccatttttcaacacggtcaatcatattgatgttttcatctgcaagacactgcagccaatgatctgttgttgtacagaatatgaggcaggcaggcttggaaggtttcttcacgagacactgaagatggcctaccattggaagagtgatgaatcagtatatgagcgtgaatgtggaaataagccgggatttgctgtgtacttcagatttccaaatagtcaacgtgtgtcttatactcagtttattaaagttcattggaaatggagtggaagaattacaaaggtgcttaaccaatgtatggaatcaaaagaatacatggaaatcagaaatgcccttattgtgctcacaaagattactagtatttttcccgtgattcgaaaaagcggtgtcaatatcgagaaaagggttgcaaagctaaagggggatgagagggaagatctgaaagtactggccactggtgtagctgctgctttggcagctcgcaagagttcatggctatctgaagaagagtttggcatgggtcaccttgatacaaagccagtgcctgcgaaacctattcctggaaatcactcgtcagatccctcgacagcaaaagatcagattgttcgtgcgaaatctacagagggtaggcatgagagaacagaaaatgccatgaagcctgatgctcaacataagaacaatcccttgcctgcaaatggatctgatagtcaaataccatcttccgttgcacaaggaaaagtttcaggggttgcacgtggttcagatgaacctccaaaacttctctctgacgagggagttaaggttttgaagcctactacagaatctgagacaagagtatcacaaaagcgtgccacacacaatgctgcaaaggtatctaagcatgatgcagtgaaggaacatgcaaaatctgggaaatctaccagcaggggtcttaatcaacaagcctcttctcttcctatcgatagacaagtattgtctcaggcagctgatggtgtgctggatactaatcctactagttcgttcgttggcaccaatggtaacgtacatctggtgccgcgaaaggtatcagcatcttctcaaagatcaacagtgttggctgcacatagtggcggaacagctaatcccaccggtgaaggtgaatctactgacttgattgactctaccgtgaaacagcaaaaaagatctgttccagctgaagaacaagagagaataagtaaacggaggaaaggggacattcaaggccgtgatggtgagttgacagaacaacacacagacaaagaaagaaaattggacacacgatcagcagatagatttcgctccgcggatcatgagaggggtgctagtgaggaacagaacataattaggacagacaaattaaaagaaaagtttgatgataaacatgacagagatcccagagaaaaagcagaccaacttgagaggcgccgtggggaagacgtgattgagagaccactggacagagcatcggataggagagagcgttctattgacaggatgcaagacatggctcccgaaaaaggaagagaagacaggaataaggaggatagaaacaaagctaagcatgctgaaccctccgtagatcgagcacatagttctgatgaacggttcccagggcaaagcttaccaccgcctccacctcttccagcaagttttgtaccccaatcagttggttctaaccgaagagatgaagatagtggccgaagaggtggcagcacaaggcatactcaacgattgtctcccaggcgcgatgagaaagaaaggtggcatttggaggagaatgcttcgttgttgcaggatgatgggaaacacagaagagaggaagatctccgggatagaaagcgtgaagatagggatgtttcatcaagcaaggtagatgacagggatagggacaaagttagtactatgaaggaggacagcgaccctaacagtgcttccaaacggcgaaagattaagagagagcagtctgctttagaagctggggaatatgcaccttctgctccacagcctcccagccttggagctggtggcttgcaacttgaaatccgagagagagaaagaaagggtgttatctcacagcatcggccatcacatgctgatgaccttcctaggataacaagcaagacaagccgtagagaggttgaccaaacgctcgagagagaatgggaagaggaaaagaggcctagaactgaagcaaaaagaaagcattggaagtag

SEQ ID NO: 1574 - DNA, 6200 bp, Brachypodium distachyon
gtctctcttccccatctagcaccgccaccgtctcctccctcctcctcaggcctcgctctacctcccatgaaaccctaaatcccccccaaaccctgactccaacacccgcgtccgctgccatgtcgcctcctctccaggcgccggactacaagtacgtcacggaggagtgcctccgcgaatggaagagccagtccgccgccggcttccgcctccccgatccgctccccatggcgcgcttcctctacgagctgtgctgggcgattgtgctgggcgacctgccgccgcagaagtgccgggtggcgctggattcggtggtgttcgtggaggaggcatggcacgaggagtccggttctgtgctcgcggacatcgtcgctcacctagggcaggatattacaatttctggcgagtatcgcaaccgtcttgtcaaaatgactaagtcatttgtggagtcttcgttgattgtgcctaggcttcttcaagagcgatgtgaagaagagttcctatgggaggttgagcagagtaagtcaaagggccaggatttaaaagccaaagaggtcagagtcaacacgcggcttctttatcagcaaactaaattcaaccttttaagagaggaaagcgagggctacgccaagttggtcaccctactttgtcaagtcggttcagatttggcttgccaaaatgcttcttcagctactatcagcattataaagtcattaattgggcactttgacctggacccgaatcgcgtatttgacatagtgttggaatgttttgaactctatccagataacagtaccttttatcagcttatacctctttttcctaagtcccatgctgctcaaattttagggttcaaattccaatactatcaacaattggatgtcaacagccctgttccatctggtcttttccgaatagcagccttgttggtgaaatctggtcttattgaccttgataatctctacgcccatttacttccaaatgatgatgaggcatttgagcattttgggtcctttgtttcaaggagaattgatgaggttagtaaacctgttgatttcatctgttctaaaaaaagatttgatgttttttcacagggttttaaaggagaattgtatgcatgctactaaaatcggcaaaataaatcttgctgctactgggaaagaccttatggatgatgagaagcaagaaataactattgatttgtacacagcattggagatggagaatgatataattgaggagcgagcccctgagatagaaaagaaccagaagcttggacttcttcttggtttcctctcagttcatgattgggatcacgcacagatactctttgagcgtctcgcacagctaaatcctgtcgagcacattgaaatttgtgatggattatttagagttattgaaaagactatttcatcagcctacactatatattgtcaaacacatcataaaatccctcgtaacatcgacactcacatgatagaagcatcatccgtctcttcaccaagttatttggttgatctgccgaaagagtttttccaaatgcttgctgcttgtggaccgtaccttcatcgtgacacacaattatttcagaaggtttgcagagtgctaaaagtgtaccacgtctcatcaaaagactcagcacgtacagctggtgtaatgtcaacagaatctcgtgtcgaggaagcacttgggtcatgcttgcttccttcattgcagcttatacctgccaatcctgctgttgatatggagatatggggagttctttcccttcttccttacgaggcacgctatcggttgtatggtgagtgggagaaggacactgaacaaaatccaattgtccttgctgcaaggcaaacagcaaagctcgacaccagaaggctcttaaaaaggctggccaaggaaaatcttaagcagcttggccgcatggtggctaaactcgctcatgcaaatccaatgaccgtgcttcggacaattgtcacacaggttgaagcatacagggacatgataaatcctgttgtggatgcttttaaatacttgacccagctggagtatgatatcttgcaatatattgtaattgaacggttggctcaaggtggtcgtgagaaagtaaaagatgacggtcttaatctgtcagactggcttcagtgtcttgcatcattttggggacacctctgcaagaagcatctttccatggagctaaaatgccttttccaatacattgttaatcaactgaagaaaggattgggcactgagcttgttgtactggaggaactgattcagcaaatggcaaatgtacagtatactgagaacatgacagatgaacaggttgatgctatggcagggagtgaaacattgcggcttcaatcttcactatttggatcaacaaggaattataaggtcttgaataagtctacgaataagttgcgggattctttgcttccgaaagatgaaccaaaacttgctattcctctattactgcttattgctcagcatcgatctaacattataataaatgcagatgccacatatatcaaaatggtcagcgagcagtttgatagatgtcatggaatactgcttcagtatgctgagtttctttcaagtgctgtaactccagtgacctatgttcaactaatacctccgctggaagatttggtttataaatatcatattgagccagatgttgctttccttatataccgcccggtgatgaggcttttcaaaagcgcaaatggtggcgacacctgttggcctctggatgacaatgaagaaggggagtctgtgtcttgtgatgatatgatcttgtatggtgattcatctcagaagttaatcataaatagcacttcttttacatgcccatggtattttaggttctcaattgcaattgtttgcattctgttttgctacaggtggtcagatcttcttaacacaatccggacaattttgccagcaaaagcctggaatgctctttcacctgaattatacgctactttctgggggttaacactatatgaccttcattttccaaaagatcgttatgatgcagaaatcaagaagctgcatgacaatctcaaacaactggaagataactcagataattctagcatagcaatatcacgacgtaagaaagataaggagagaatccaagatttacttgacaaattgaacaatgaatctgagaagcaccaacaacatgtcacatcagtgttccaaaggctagcccgtgaaaaggacaagtggctgagttctagtccagacgcactgaagattaacatggaatttctccagcgttgcatatacccacgctgtgttctcagcatgcaggatgctgtttattgtgctacgtttgtccagatgatgcattcacttgggactccatttttcaacacagtgaatcacattgatgttttcatctgcaagacactgcagccaatgatctgttgttgtacagaatatgaggctggcaggcttggaaggtttcttcacgagacactgaagatggcctaccattggaagagtgatgaatcagtatatgagcgtgaatgtggaaataagccgggatttgctgtgtacttcagatttccaaatagtcaacgtgtgtcttatactcagtttgttaaagttcattggaaatggagtggaagaattacgaaggtgcttaaccaatgtatggaatcaaaagaatacatggaaattcgaaatgcccttattgtgctcacaaagattactagtatttttcccgtgattcgaaaaagcggtgtcaatatcgagaaaagggttgcgaagctaaagggagatgagagggaagatctgaaagtactggccactggtgtagctgctgctttggcagctcggaagagttcatggctatctgaagaagagtttggtatgggtcaccttgatacaaagccagtgcctgcgaaacctattcctggaaatcagtcgtcagatccctcgacagcaaaagatcggagtgttcgtgcaaaatctacagaggtcaggcatgagagaacagaaaatgccatgaagtctgatgctcaacacaagaagaatcccttgcctgcaaatggatctgatagtcaaataccatcttcctctgcacaaggaaaagtttcaggggttgcacgtggtgcagatgaacctccaaaacttctctctgacgagggagttaaggttttgaagcctactacagaatttgagacgagagtaccacaaaaacgtgccacacacaatgctgcaaaggtatctaagcatgatgcggtgaaggaagatgcaaaatctgggaaatctactagcaggggtcttaatcaacaagcctctgctgttcctatcgatagagaagtatcgtctcaggcagctgatggtgtgctggatactaatcctactaattcgttggttggcaccaatggtaacgtacatccggcgccgcgaaaggtatcggcaccttctcaaagatcaacggtgttggctgcacatagtggtggaacagctaatcccaccggtgaaggtgaatctactgacttgattgactctaccgtgaaacagcaaaaaagatctgttccagctgaagaacaagagagaataagtaaacggaggaaaggagagattgaaagccgtgatggtgagttgacagaacaccacacagacaaagaaaaaaaattggattcacgatcagcagatagatttcgctccgcggatcatgagaagggtgctagtgaggaacagaacataattaggacagacaaattaaaagaaaagtttgatgataaacatgacagagatcccagagaaaaagcagagcgaattgagaggcgccgtggggaagacgtggttgagagatcaatggacagagcatcggataggagagagcgttctattgacaggatgcaagacagagtgacagacagggctcctgaaaaaggaagagaagacaggaataaggaggatagaaacaaagctaagcatgctgaaccctccgtagatcgagcacatagttctgatgaacgattccgagggcaaagcttaccaccgcctccacctcttccagcaagttttgtaccccaatcagtcggttctaaccgaagagatgaagatagtgaccgaagaggtggcagcaccaggcatactcaacggttgtctcccagacgcgatgagaaagaaaggtggcatttggaggagaatgcttcgtcgttgcaggatgatgggaaacacaggagagaggaagatctccgagatagaaagcgtgaagatagggatgtttcatcaagcaaggtagatgacagggatagggacaaagttagtactatgaaggaagacagtgaccctaacggtgcttccaaacggcgaaagattaagagagagcagtctgctttagaagctggggaatatgcaccttctgctccacagcctcccagccttggagctggtggctcgcaacttgaaatccgagagagagaaagaaagggtgttatctcacagcatcggccatcacatgctgatgaccttcctaggacacacgcaaaggattcaacaagcaagacaagtcgtagagaggctgaccaaatccacgagagagaatgggaagaggaaaagaggcctagaactgaaccaaaaagaaagcatcggaagtaggttttcgcaagaacgttggtccttccccataacatgatctcacttgagaacgtgcatgaccaacagcgaacgagatgatgttttcttgtatcggaatgatcaatttgggcattctggaatcattcagggtgtatgtctcagggcatggttttgaaaggtgtgctggggcttaaaggggacacaggttcagtccttcacccatacttcatcgatgctgtgtcagtccagatgcaaaattgttataaacaatgtggggtgcaagaaacaaacatctgggacatgtgtccgtaatacaaactgctatgaatcctgtggagtgcgagaaacaaagctgtgggcggtgcattaactttgagaaattttgtactgtaaacaatggtgagcagatagtctttcagatgttgtgtaatttggttcgatactaactgcagatatgttcgttgtagggagcatttgggtttcccttttttgcactgtctaggaataatggttgtacaaatcatagttacagtagttgcattaacccgtgtattctagtttgcacggagatcgttgcaattcatgcattgcca

SEQ ID NO: 1575 - DNA, 5904 bp, Sorghum bicolor
tgctcctctttctctgacctcggcagctcccatgaaaccctaatccccaaaaccctcactcaaaccaacactgccgccgccgccatgtcgccccctcttcaggcgcccaactacaagcacatcacggaggagtgccttcgcgaatggaagggccagtccgccggcgcctcccgcctccctgatccggtgcccatggcgcgcttcctctacgagctctgctgggcgatcgtgctgggcgacttgccgccgcagaagagccgggtggcggtggagtcggtggtgttcatggaggaggcacggcgggaggaggagctcggctccgtgctagctgatatcattgctcacctaggacaggatattacaatctctggtgaatatcgcagccgtcttgttaaaatgactaagtcatttctggagtcctcgattactgtgcctaggcttctgcaagagcgatgtgaagaagatttcctttgggaggttgaacagagtaagctgaaaggacaggatttaaaatccaaggaggttagggtcaacacacggcttctttaccagcaaactaaattcaacctcttacgggaggaaagtgagggctatgccaagttggtgacactcctttgtcaagttggttcagatctggcttgccagaattcttcttcggttacgatcagcattataaagtcattgattggccattttgatctggacccaaatcgtgtatttgatattgtgttggaatgctttgaactttatcaagatagtaacatctttcatcagctcatacctctttttccaaagtcccatgctgctcaaattttggggttcaaattccagtactatcaacgattggatgtgaacagccctgttccatctgggcttttcagaacagcagctttattgatcaaatctggattcattgaccttgataatgtctattctcacttgcttccaaatgatgatgaggcgtttgagcattttgattctttcatttcaagaagaattgatgaggctaataaaattggcaaaatcaaccttgctgctactggaaaggaccttatggatgacgagaaacaagaaatcactatcgatatgtatacagcattggagatggaaaatgatatagttggggagcgagcccctgagatggagaagaaccagaaacttgggcttcttcttggttttctctctgtgcatgactggtatcatgcacatctactctttgagcgtcttgcgcacctaaatcctgttgagcacattgaaatctgtgatggattatttagaatgattgaaaagacaatgtcttcagcctatcatataggttgtcacctgtattattacttgcctcctagaaatgatgctgaccagacaggcacatctgctctgtctttaagttcatttgatctgccaaaggagtttttccaaatgctcacggcttgtggaccatatcttcatcgtgacactcaattacttcaaaaggtttgcagagtattaaaagcgtactaccactcatcaaaagagtcaacccgtgcagcaaatgtagtttcaccagaatctcgaatggaggaagcacttggttcgtgcttgtttccttcgttgcagcttatccctgctaatcctgctgttgatatagagatatggggggttctttcccttcttccatatgaggcccgctatcgtctgtatggtgaatgggagaaggagaccgaacaaaacccaattgtccttgctgcaaggcaaactgcgaagctggacaccagaaggctcctaaaacgattggctaaggaaaacctgaagccacttggccgcatggtggctaaacttgcccatgcgaatcccatgactgtgcttcggacaattgtccaacaggttgaagcatacagggatatgattacaccagttgtggatgcatttaagtacttgactcagctggagtatgacatcttgcaatatattgtcattgaacgcttggcacaaggtggtcgtgcgaaacttaaagatgatggacttaatctctcagattggcttcaatgtcttgcatccttttgggggcacctgtgcaagaagcataatgctgtggaactgaaaaaccttttgcagtatcttgttaatcaactgaagaagggtgtgggcattgaacttgttgtcctggaggagctcattcagcaaatggcgaatgtgcagtacaccgagaacatgacagaggaacaggttgatgctatggcaggaagtgagactttgcggcaacaagcttcactgttcggagcaacaagaaactataaggtgttgagtaagtccacaaataggctaagggattcgcttcttccaaaagaagggcccaaacttgctgttcctatgttactgcttattgctcagcatcggtccaagatcataataaatgcagatgccacatatatcaaaatggtcagtgagcagtttgatagatgccatggaatacttcttcagtatgttgagtttctttcaagcgccgtaactccaaccgcctatgctcaactaataccccctttgcaagatctggtccataaataccacattgagccagaggttgctttccttatataccgcccagtgatgcggctttttaagagtagtaatggaggtgacacttgttggcctcttgatgacaacgaggaaggagaatctgtatcatctgatgatcttatcttacatcttgactcatctcaggaaccaatcatgtggtcagatcttcttaacacagtccagtcaattttgccagcaaaagcttggaacagtctttcaccagatttatatgctactttctggggcttaacactctatgatcttcacttcccaaaagaccgttacgatacagaaatcaagaagctgcatgataatctcaaacaattggaggacaactcagataactctagcattgcaatttcaagacgtaagaaggacaaggagagaatccaagatttactcgacaaactgaacagtgaatctcagaagcaccagcagcacattgcatctgtggtccaaaggttagcccgtgaaaaggataagtggttgagctccagtccggatgcaatgaaaatcaacatggagttcctacagcgctgcatattcccacgatgtgtttttagtatgcaagatgcagtatattgtgctacatttgtccaaacactacactcccttgggactcctttctttaacacagtcaatcatatcgatgttctcgtctgtaaaaccctacagccaatgatatgctgttgcacggaatttgaagctggcaggcttggaaggttttttcatgatacgttgaagatggcctactattggaagagtgatgagtctgtttatgagcgtgaatgtgcaaacaaaccaggttttgcagtgtacttcagatacccaaacagccagcgtgtatcctatagtcagtttgttcgggttcattggaagtggagttcaagaatcaccaaagcgcttaaccaatgcatggaatcaaaagaatacatggaaatccgaaatgcccttattgtgctcacaaagatttctagtgtctttccggtgattcgtaaaagtggtgtcaatcttgagaaacgggtggctaaactaaaaggggatgagagagaagatcttaaagttctagccactggtgtagctgctgctttagctgctcgcaagagttcttggctatctgaagaagagttcggcatgggacacattgatctgaagccagcaacagcaagatctgtgcttggaaaccagtcagcagatccgtcgatgccaaaagatcaaaatgcccgtgcaaagtctatagagaataggcatgaaaggtcagagggtgctatgaagcctgacgttcagcaaaagaagagctctgtggctgcaaatggatctgatattcaaatatcatcttcctccatacaagggaaatcttcagtggttgtacgtgcagtcgatgaacctccaaaacctgtgtctgatgagggggttaaagtttccacaaaacctacttcagaatctgagacaagagcaacacaaaagcgtgcacacaatgctgggaaggtaatgaagaatgatgttgcaaaggaagatgcaaaagctgggaaatctactagctggaatgtaaatcaacaagtatcaactgttgatagagaagcaatgcctcatggagctgatgctgcccaagaaaccaataccactattagcaatggtaacttgcatccagtgcagcggaaggtttcgtcatcttctcaaagaaatgcagtgttggttacacataatggagcagctaatccctctggtgagtctattgatctgattgactctactgtgagacagcaaaaaagatctgctctgattgaggagcaagatagatcaggtaaacggaggaaaggagaaaatgaacccgatttgagtgaacaccatgtagacaaggaaaagagtttggactcacgtggcggagataagtttcgttcagtggatcatgagaagagtgctaatgaggaacataacttaagtagggcagacagaatgaaagagaaatctgatgataaatatgacagagatcctagggaaaaattagatcgagctgaaaggcgtcgtggggaagatgccattgaaagatcaacagatagattatcggagaggagagaacgctctattgaaaggatgcaagagagggttacagataaagcctctgaaaaaggtagagaggatagaaataaggatgagaggaataaagttaaatatgctgaaccttcggtggaccggacacattcttctgatgaacgattccgagggcaaagtttgccaccgcccccacctcttcccgcaagttttgtaccccaatcagttggtgccaaccgacgtgaagaagatggtgaccgaaggggtgggagctccaggcatgttcaaaggtcatctcccaggcgcgatgagaaagaaaggaagcagtcagaggagaatacttcttcatttcaggatgatgggaagcacagaagagaggaagatattcgtgatagaaagcgtgaggatcgggatatattatcaaacaaggtagatgacagggatagggaaaaggggacttctttgaaagaagacagtgaccctagtaatgcttctaaacggagaaagatcaagcgagaccagacttctttagaagccggggaatatgcaccttctgctccacagcctccctcccatggatccggcagctcacaattgtctgacgtacgagaaagagaaaggaaagggttaatttcacaacatcgtacctcacacgctgatgaccttcctaggacgcatggcaaggacacagcaagcaagtcaagtcgtcgagagtctgaccaaatgcacgagagggaatgggaagaggaaaagcgaccaagaactgaaacaaaaaggaagcatcggaaatagccgatcaatattgacatggattcagttgagcctcattaattttctccgagcacagtagtgaatgcatttgaatttcatgttttcctgtagtgagaaaacatgtttcagcatagctaagcagattgtttcatagtgtactgcgccagttaggggatgtggagcttaagatgatgctaaagcctttcctgtcgagctcaccaatgcgaatttcacatatggagatgagccatgtttagcttcatacattttgtgctgtaaacaatgtggaatgtggcatagtgatttgtactgtgaacatagatgagtggctcaccatccaggtattttgtattttagtactaactgctaacatgtttggagtaggaagcatcaccaatttttgcattgtgtaggaataatgttagagatgcagcataattgaaatgtacatattgcggccagaaattttgctagccatatttaccttttcgggttcattaaagtttcctcatcagagtttgttgt

SEQ ID NO: 1576 - DNA, 1855 bp, Avena sativa
agcgagagaaagggagaggaaataaataccaggggcaggggcaggcagggcgccctctctctccgctccacaccgcaccgatcactcgccggagctcctaatggccgcccccgccgccgccgccgcgatcgcgtgatggctgaagcagccgctcgcctcccatggacgaagccggaagggcctccgctcccgcggtggtgacggtcacggcctccgccgccgcgccctcgcctcctcctccccctccccctccgccagcccccatcgccaccgccgacaccgacacgccctcgccggaccccgatgcactgtatcaagaggggatgtggcaccagatgacgatgagcagcggcgccactatgcagccggggccatatcctgagcggtcgggggaacccgactgcacatactacctcaggactggattgtgtaggttcggcatgagctgcaggttcaatcaccctccagacaggaatatggctattgcctctgccagaatgaaaggagaatatcctgagagggtgggacaaccagaatgtcagtactatctgaagaccggaacatgcaagtttgggcctacgtgtaagttccatcatcccagagaaaaggctgggatccagggaatggcgcagttaaacacgatgggatatccacttcgaccgaatgaaagggagtgtgcatactacttaaaaacgggacagtgtaaatatgggaatacatgtaaatttaaccatccagaactattcaatgcggtggcttcctcacgtggttcccctatttatccttctgtacatacctctccaagcactggtccacattcctatactggaactactatggcaagctggacttatccaagaggttctttcgttccaagccctagatggcaaaatccttcaaattatgcaccgatgattgtaccgcaaggtcttgttcaagtaccaggctggaattcatatcatggccaaatgctacctgtttcatcttccgagagtcgactgcagtctccaggagctcaacaatactatggaacttctcgacaaggtgaaggcagtgctggcaatcagggaatggtatcaccctacagatccagttcgtttcctgttgctcagtacgcgctgcagagagagaatgtatttcctgagagacctgatcagccagaatgcatatactacataaagaccggagattgtaagtttggtgcagtttgcaagttccatcatccccgggtgcgatcacagcctcccccagactgcgtgttgagcccaatgggtcttccactacgcccaggggaagagctgtgcaaattctactctcgctacggcatctgcaagttcggcgtaaactgcaagtttgaccatccgatggccgctccggtgggcgtgtacgcgtacggctactccgcctcagcttcacctaatggcgcgcccatgggtcggcgcctcctggagtccccctctggatccgcgtacgcatcctagggtaggggggccccctccccctcccattcgcatttgacctgtgcctgccttgatgtataaaatcatcgcacgcccccgccgccgtctgagtaggcgctggcgcgctgcgaatgtttccccccctaactccccggaatcaagttctgtaaattgagttgctgccagagatgtacagttatcctttttttgccaatgcagatcttggagaggccatctgcaacccaacaaaataataatgtttgaatgcagataacccagttttcaggctttagctgttggcgttgctgggtgcgtcagaggttcctgacagaggtggtaatttctgtcgaggaactgggtgattttctctcgcctgcaaaccctggttgcatctt

SEQ ID NO: 1577 - DNA, 1706 bp, Triticum aestivum
  misc_feature (24)..(24): n is a, c, g, or t
  misc_feature (503)..(503): n is a, c, g, or t
gcctcctctctctccctctgtatnctgcacacaccgccaccgatcactcgccggagcccctcccccaatggccgccgccgccgccgcgatcgcgtgatggccgacccagccgctcgccgaagatggacgaagccggaagggcctccgctcccgcggtggtgacggtcacggcctccgccgccgccccctcgcctcctcctccgccgccccccgccacggccaccgccgcggccgccgacccgccatcgcccgaccctgacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactanctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcactggtccacattcctatactggaacaatggcaagctggacttatccaagaggttctttcattccaagccctagatggcaaagtccttcaaactatacaccgatgattgtaccacagggtcttgttcaagtaccaagctggaactcatatcctggccaaatggtacctgtttcatctcctgagagtcgactacagtctccaggggctcaacaatactatggaacttctcgacaaggtgaagccagtgcaggaaatcagggaatgcaatcatcctacagatccagttcgtttcctgcacctcagtatgcactgcagagagagaatgtatttcctgagagacctgatcagccagaatgcatatactacataaagactggagattgtaaatttggtgcagtttgcaaattccatcatccccgggtgcgctcacagcctcccccagactgtatcttgagcccaatgggtcttccattacgcccaggggaagagctctgcaagttctactctcgctatggcatctgcaagtttggcgtaaactgcaagttcgaccatccgatggcggctccgatgggggtgtacgcgtacggctactctgcctccgcgtcgcccaatgctcccatggctcggcgtctcctggagtccccctccgggtctgcgtacgcctcctaaggcaaggctccctggcatttgaccctaccttgattgatctcgatgatgtataaaagccatcgcgcgccgtccttcccagggcttgcgccgcgaatgtcctcccccctaactccccggaatcaagttctgtaaaaatcgagtttgctaccagagatgtacagttgttatttttgttaatgcgggtcagtcagtctttggatggatggatggagaagccatttgctaccgaatgaaataatgcttgaatgcagtgtgaaaaatgttggcattgcttca

SEQ ID NO: 1578 - DNA, 1650 bp, Hordeum vulgare
ctccctctgtatcctgcacacaccgccaccgatcactcgccggagcccctcccccaatggccgccgccgccgccgcgatcgcgtgatggccgacccagccgctcgccgaagatggacgaagccggaagggcctccgctcccgcagtggtgacggtcacggcctccgccgccgccccctcgcctcctcctcccccgccccccgccacggccgccgccgccgccgccgacccgccatcgcccgacccggacgccctctatgaagagggaatgtggcagcagatgaccatgaacagcggtgtcactatgcaatctgggccatatcctgtgcggccaggggagccggactgcacctactacctcaggactggattgtgcaggttcggcatgagctgcaggttcaatcaccctcaggacaggaatacggctattgcctctgccagaatgaaaggagaatatcctgagagggtgggacagcctgaatgtcagtactatctgaagactggaacatgcaagtttgggcctacgtgcaaattccatcaccctagagaaaaggctggaatcgcaggaatggtgcagctaaatgcattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacatacctctggaagcactggtccacattcctatactggaacaatggcaagttggacttatccaagaggttctttcattccaagccctagatggcaaagtccttcaaactatacaccgatgattgtaccgcagggtcttgttcaagtaccaagctggaactcatatcctgggcaaatggtacctgtttcatctcctgagagtcgactacagtctccaggagctcaacaatactatggaacttctcgacaaggtgaaggcagtgcaggaaatcagggaatgcaatcaccctacagatccagttcatttcctgtacctcagtatgcactgcagagagagaatgtatttcctgagagacctgatcaaccggaatgcatatactacataaagactggagactgtaaatttggtgcagtttgcaaattccatcatccccgtgtgcgttcacagcctcccccagactgtatcttgagcccaatgggtcttccattacgcccaggggaggagctctgcaagttctactctcgctatggcatctgcaagtttggcgtaaactgcaagttcgaccatccgatggcggccccgatgggggtctacgcgtacggctactccgcgtcggcgtcgcccaacgcgcccatggctcgccgtctcctggagtcgccctccgggtctgcgtacgcgtcctaaggctccccggcaatttgaccttgattgatctcgatgatgatgtataaaaagccatcgcgcgccgtccgtcctcggtcgcgccccgcgaatgttctctccccctaactcccccggaatcaagttctgtaaaaatcgagtttgctaccagagatgtacagttatttttgttaatgcgggtccttggatggatggatggatggagaagccatttgctaccgaatgaaataatgg

SEQ ID NO: 1579 - DNA, 1678 bp, Hordeum vulgare
cggcacgaggcctctgtatcctgcacacaccgccaccgatcactcgccggagcccctcccccaatggccgccgccgccgccgcgatcgcgtgatggccgacccagccgctcgccgaagatggacgaagccggaagggcctccgctcccgcagtggtgacggtcacggcctccgccgccgccccctcgcctcctcctcccccgccccccgccacggccgccgccgccgccgccgacccgccatcgcccgacccggacgccctctatgaagagggaatgtggcagcagatgaccatgaacagcggtgtcactatgcaatctgggccatatcctgtgcggccaggggagccggactgcacctactacctcaggactggattgtgcaggttcggcatgagctgcaggttcaatcaccctcaggacaggaatacggctattgcctctgccagaatgaaaggagaatatcctgagagggtgggacagcctgaatgtcagtactatctgaagactggaacatgcaagtttgggcctacgtgcaaattccatcaccctagagaaaaggctggaatcgcaggaatggtgcagctaaatgcattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacatacctctggaagcactggtccacattcctatactggaacaatggcaagttggacttatccaagaggttctttcattccaagccctagatggcaaagtccttcaaactatacaccgatgattgtaccgcagggtcttgttcaagtaccaagctggaactcatatcctgggcaaatggtacctgtttcatctcctgagagtcgactacagtctccaggagctcaacaatactatggaacttctcgacaaggtgaaggcagtgcaggaaatcagggaatgcaatcaccctacagatccagttcatttcctgtacctcagtatgcactgcagagagagaatgtatttcctgagagacctgatcaaccggaatgcatatactacataaagactggagactgtaaatttggtgcagtttgcaaattccatcatccccgtgtgcgttcacagcctcccccagactgtatcttgagcccaatgggtcttccattacgcccaggggaggagctctgcaagttctactctcgctatggcatctgcaagtttggcgtaaactgcaagttcgaccatccgatggcggccccgatgggggtctacgcgtacggctactccgcgtcggcgtcgcccaacgcgcccatggctcgccgtctcctggagtcgccctccgggtctgcgtacgcgtcctaaggctccccggcaatttgaccttgattgatctcgatgatgatgtataaaaagccatcgcgcgccgtccgtcctcggtcgcgccccgcgaatgttctctccccctaactcccccggaatcaagttctgtaaaaatcgagtttgctaccagagatgtacagttatttttgttaatgcgggtccttggatggatggatggatggagaagccatttgctaccgaatgaaataatggttgaatgcagtcgttggaaat

SEQ ID NO: 1580 - DNA, 1829 bp, Panicum virgatum
cgccggagcccagctgcccagggatggcggcagcagctcctcccaccgccgcgatcgcgtgatggaagccgacgccgctgctctccgccgatggacgacgctggaagggcatccgctcccgcggcggtgacagtctccgccaccgccgcacccgtgcatcccccgccctccgccaccgccgccgacacgccctcccccgacccctccgcgctctatggagaggggatgtgggaacagatggccatgaacagcggtgccacaatgcaacctgggccatatcctgagcggcagggtgaaccggactgcacctactatctcaggactggattgtgtagatttggcatgagctgcaggttcaatcatcctccggataggaatctggctattgcctctgccagaatgaagggagaatatcctgagagattgggacaaccagaatgccagtattatctgaagacaggaacatgcaagtttggccctacatgcaaatttcaccatcccagggaaaaggctggaattgcaggaagggtgcagctaaacacattaggatatccactccgcccgaacgaaaaggagtgtgcatattatttaaaaacaggacagtgtaaatatgcgaatacttgtaaattccaccatccagaacttttcaatgtggtgccttcctcacgtggttctcctatttatccttctgtacattcatctgcgagcactggtcctcagtcctatactggaactatggcaagctgggcttttccacgcgcttcttttatcccaagccctagatggcaaagtccttcaaattatgcaccaatgattgtacctcagggtcttgttcaagtgccaagctggaattcatatcctggtcaaatgcagtcaccaggggctcaacaaacctatggaacctctcaacaaggcgaagctagtacaggaaaccagggaatgttatcaccctacagatccagttcatttcctgtgcctcaatatgctttgcagagagagaatgtatttcctgagaaacctgaccaaccagaatgccaatattacatgaagacaggagattgtaaattcggtgcagtgtgcaagttccatcatccacgggtcagatcactaccgcctccagattgtgtcttaagtccaatgggtcttccaatacgtcctggtgaagaactgtgcaaattctattcgcgttatggcatctgtaagttcggagccaactgtaagtttgatcatccaatggctactccaatgggagtctatgcttatggtttctcagcctcagcttctgcatctgcatcaactaatgtacctatggcccgacgccttctgggatccccacctggttctggatacacatcctagatgacgcttgttttcagttgacctactttgatgtataaaatccaccacgctgtctcaggcgctgtgaatgtttctcctaactccctgccggaatcaagtcctgtaaattgagttgctactggagatgtacagcctctctttttttgtgttaatccagatcttttgggaggaacgcaatctgaataatctttaaaggaagactggaacagtttcagttttcaggtgcctgcactatttgattctagtgcactatctaccagtttgcgagggtaggaaatgctccgaattaaaggagctgaagcctggaggcgatcattcttctgcagtactgtacaaattatatcatcgcgtggatttaggccctgtttgcttacaagcaagattatataatctagcttataggtgatgggttatattatctggattattgtaaatttgagagataaatctgagctgttttgcaacatcaa

SEQ ID NO: 1581 - DNA, 1532 bp, Brachypodium distachyon
ggcgctgccgctcgccgccgatggacgaagccggaagggcccccgctcccgccgcggctgtgacggtgacggcctcatcctccgccgccaacgctagtgacccctcgcctcctcctcccccagctcccgccaccgccaacgccgccgccgacaccgacgcaccctcgccggacccggacgctctctatgacgaggggatgtggcaggagatgaccatgagcagcggtgctcctatgcaacctgggccgtatcctgagcgcccgggcgagccggactgcacctactacctcaggactggactgtgtaggttcggcataagctgcaggttcaatcatcccccggataggaatttggctattgcctctgccagaatgaaaggagaatatcctgagagggtgggacaaccagaatgtcagtactatctgaagaccgggacatgcaaatttgggcctacttgcaaattccatcatcccagagaaaaggctggaatcgcagggatggtgcagctaaacacattaggataccccctccgactgaatgaaaaggagtgtgcatattacttaaaaacgggacagtgtaaatatgggaatacatgtaaatttaaccatccagaacttttcaatgcggtggcttcttcgcgtggttcccctatttatccttctcttcatacctctgcaagcgctggtccacattcttatgctggaactatatcaaactggacttatccgagaggttcttttattccaagccctagatggcaaagtccttcaaattatgcaccgatgattgtacaacagggtcttgttcaagtaccaagctggaactcatatcctggccaaatgctacctgtatcatcttctgagagtcgactgcagtcaccaggggctcagcaaaactacggaacttatcgacaaggcgaagccagttcaggcaatcaaggaatgctatcaccctacaggcctagttcgtttcctgtgcctcagtacgcgttgcagagagagaatgtgtttcctgagagacctgatcaaccagaatgcatatactacataaagaccggagattgtaaatttggcgcagtttgcaaattccatcacccccgggtgcgatcactgcctcctccagactgtgtcttgagcccaatgggtcttccactacgcccaggggaagaactctgcaaattctattctcgttatggcatctgcaagttcggcatcaattgcaaatttgaccatccaatggcttctccaatgggagtgtacgcatacggcttctctgcctctgcttcaactaatgcacctatggctcggtgtctcctggaatcgccctctggatctgcatacacaccctaggggtttccttcgcatttgacctaccttgatgtataaatccatcgcagccctctgaggtgttgtgaatgtttcccctaactccccgggatcaagttctgtaaattgagttgctaccagagatgtacagttacttttttttgttaattaatgcagatctttcgagaccccatttgcaaccaaaat

SEQ ID NO: 1582 - DNA, 1888 bp, Sorghum bicolor
gcaggcgcagcgacgcgcgagtgcacgtagcatagcaaaccgcgtcgtctgaaaggaggagagagaaataaatatacgaggggcagggccctcctcttcccttctttgcattcctccacaccgatcactcgctgctcccctctctcgccggagccccgggccggatggcggcggcagcagcagctcctcccgcctccgcgatcgcgtgatggacgcacacgccgccgcgctccgccgatggacgacgccggaagggcaccaccacccgctcccgcggcggtgaccgtatccgccaccgccgcacccgcgcctcccccgccctccgccacggccgctgccgacaagtcctcgcccgaccccgaagcgctctatgaagaggggatgtggcaacagatggccatgaacagcggtgccactatgcaacctgggtcatatcctgagcgaccaggtgaacctgactgcacttactacctcaggactggattgtgtcgatttggcatgagctgcaggttcaatcatcctccggataggaatctggctattgcctctgccagaatgaaaggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgaatgaaaaggagtgcgcatattatttaaaaacaggacaatgtaaatatgcaaatacttgtaaatttcaccatccggagcttttcaatgtggtgccttcgtcacgtggttctcctatttatacttccgtacattcctctgcaagcgctggtccacagtcctatactggaactatgccaagctgggcttttccacgagcttcttttataccaagccctaggtggcaaagtccttcaaattatgcaccaatgattgtacctcagggccttgttcaagtgccgagctggaattcatatcctggtcagctgcagtcacctggggctcaacaaacttatggaagttcacaacaaggtgagtctagtgcaggaaatcagggaatgctatcaccctacagatccagttcgtttcctgtgcctcaatatgcgttgcagagagataatgtatttcctgagagacctgatgaaccagaatgccaatattacatgaagacaggagattgtaaatttggtgcagtgtgcaagttccatcatccccgggtgagatcactgccccctccggattgtgtcttaagtccaatgggtcttccaatacgtccaggtgaagaattgtgcaaattctattctcgttatggcatctgcaagttcggcgccaactgtaaatttgaccatccaacaatggctgctccaatgggagtctatgcatatggtttctctgcgtctggttctcctgcatctgcttcaactaatgtacctatggcgcgacgccttctgggatccccatccgcttctggatatacgtcctaggcatctttttcacttgacctattttgatgtataaaatccacggcattgcctcaggcgctgtgaatgtttctcctaacttcccgccgggatcaaagttctgtaaattgagttgctaccggagatgtacagcccccccccttttttttgttaatccagatctttgggaataactcttggaaccgaataaactttagatgcagaaataccattttcacgcctgcacctatggttcctaacagttgatgaggtaggaaatcccctgaaggacctgaggcctgcaggtgtgcagttgaaattatatcattgcgtcagtttgtttggaacctgtattcagctcgtgttgaggcagatattgggatttcttttt

SEQ ID NO: 1583 - DNA, 1856 bp, Sorghum bicolor
tagcaaaccgcgtcgtctgaaaggaggagagagaaataaatatacgaggggcagggccctcctcttcccttctttgcattcctccacaccgatcactcgctgctcccctctctcgccggagccccgggccggatggcggcggcagcagcagctcctcccgcctccgcgatcgcgtgatggacgcacacgccgccgcgctccgccgatggacgacgccggaagggcaccaccacccgctcccgcggcggtgaccgtatccgccaccgccgcacccgcgcctcccccgccctccgccacggccgctgccgacaagtcctcgcccgaccccgaagcgctctatgaagaggggatgtggcaacagatggccatgaacagcggtgccactatgcaacctgggtcatatcctgagcgaccaggtgaacctgactgcacttactacctcaggactggattgtgtcgatttggcatgagctgcaggttcaatcatcctccggataggaatctggctattgcctctgccagaatgaaaggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgaatgaaaaggagtgcgcatattatttaaaaacaggacaatgtaaatatgcaaatacttgtaaatttcaccatccggagcttttcaatgtggtgccttcgtcacgtggttctcctatttatacttccgtacattcctctgcaagcgctggtccacagtcctatactggaactatgccaagctgggcttttccacgagcttcttttataccaagccctaggtggcaaagtccttcaaattatgcaccaatgattgtacctcagggccttgttcaagtgccgagctggaattcatatcctggtcagctgcagtcacctggggctcaacaaacttatggaagttcacaacaaggtgagtctagtgcaggaaatcagggaatgctatcaccctacagatccagttcgtttcctgtgcctcaatatgcgttgcagagagataatgtatttcctgagagacctgatgaaccagaatgccaatattacatgaagacaggagattgtaaatttggtgcagtgtgcaagttccatcatccccgggtgagatcactgccccctccggattgtgtcttaagtccaatgggtcttccaatacgtccaggtgaagaattgtgcaaattctattctcgttatggcatctgcaagttcggcgccaactgtaaatttgaccatccaacaatggctgctccaatgggagtctatgcatatggtttctctgcgtctggttctcctgcatctgcttcaactaatgtacctatggcgcgacgccttctgggatccccatccgcttctggatatacgtcctaggcatctttttcacttgacctattttgatgtataaaatccacggcattgcctcaggcgctgtgaatgtttctcctaacttcccgccgggatcaaagttctgtaaattgagttgctaccggagatgtacagcccccccccttttttttgttaatccagatctttgggaataactcttggaaccgaataaactttagatgcagaaataccattttcacgcctgcacctatggttcctaacagttgatgaggtaggaaatcccctgaaggacctgaggcctgcaggtgtgcagttgaaattatatcattgcgtcagtttgtttggaacctgtattcagctcgtgttgaggcagatattgggatttcttttt

SEQ ID NO: 1584 - DNA, 1653 bp, Saccharum officinarum
aaataaatatacgaggggcagggccctcctcttccttctttctattcctccacaccgatcactagctgctcccttctctcgccggagcaccggcccggatggcggcggcagcagcagctcctcccgcctccgcgatcgcgtgatggacacacacgccgctgcgctccgccgatggacgacgccggaagggcaccaccacccgctcctgcggcggtgaccgtatccgccaccgccgcacccgcgcctcccccgccctccgccacggccgccgccgacaagtcctccaccgaccccgacgcgctctatgaagaggggatgtggcaacagatggccatgaacagcggcgccgctatgcaacctgggtcatatcctgagcgaccaggtgaacctgactgcacttactacctcaggactggattgtgtcgatttggcatgagctgcaggttcaatcatcctccggataggaatctggctattgcctctgccagaatgaagggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgagtgaaaaggagtgtggatattatttaaaaacaggacaatgtaaatatgcaaatacttgtaaattccaccatccggaacttttcaatgtggtgccttcgtcacgtggttctcctatttatacttctgtacattcctctgcaagcgctggtccgcagtcctatactggaactatgccaagctgggcttttccacgagcttcttttataccaagccctaggtggcaaagtccttcaaattatgcaccaatgattgtacctcagggccttgttcaagtgccgagctggaattcatatcctggtcagctgcagtcacctggggctcaacaaacttatggaagttcacaacaaggcgaatctagtgcaggaaaccagggaatgctatcaccctacagatccagttcgcttcctgtgcctcaatatgcgttgcagagagataatgtatttcccgagagacctgatgaaccagaatgccaatattacatgaagacaggagattgtaaatttggtgcagtgtgcaagttccatcatccccgggtgagagcactgccccctccagattgtgtcttaagtccaatgggtcttccaatacgtccaggtgaagaattgtgcaaattctattctcgttatggcatctgcaagtttggcgccaactgtaaatttgaccatcctacaatggctgctccaatgggagtctatgcatatggtttctctgcgtctggttctcctgcatctgcttcaactaatctacctatggcgcgacggcttctgggatccccatccggttctggatatgcatcctaggcgtctttttttcacttgacctactttgatgtataaaatccacggcattgcctcaggcgcagagaatgtttctcctaacttcccgccgggatcaaagttctgtaaattgagttgctaccggagatgtacagcccccttttttttgttaatccagatctttgggaataactcttggaaccgaataaactttagatgcag

SEQ ID NO: 1585 - DNA, 1653 bp, Saccharum officinarum
  misc_feature (94)..(94): n is a, c, g, or t
  misc_feature (1057)..(1057): n is a, c, g, or t
aaataaatatacgaggggcagggccctcctcttccttctttctattcctccacaccgatcactagctgctcccttctctcgccggagcaccggnccggatggcggcggcagcagcagctcctcccgcctccgcgatcgcgtgatggacacacacgccgctgcgctccgccgatggacgacgccggaagggcaccaccacccgctcctgcggcggtgaccgtatccgccaccgccgcacccgcgcctcccccgccctccgccacggccgccgccgacaagtcctccaccgaccccgacgcgctctatgaagaggggatgtggcaacagatggccatgaacagcggcgccgctatgcaacctgggtcatatcctgagcgaccaggtgaacctgactgcacttactacctcaggactggattgtgtcgatttggcatgagctgcaggttcaatcatcctccggataggaatctggctattgcctctgccagaatgaagggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgagtgaaaaggagtgtggatattatttaaaaacaggacaatgtaaatatgcaaatacttgtaaattccaccatccggaacttttcaatgtggtgccttcgtcacgtggttctcctatttatacttctgtacattcctctgcaagcgctggtccgcagtcctatactggaactatgccaagctgggcttttccacgagcttcttttataccaagccctaggtggcaaagtccttcaaattatgcaccaatgattgtacctcagggccttgttcaagtgccgagctggaattcatatcctggtcagctgcagtcacctggggctcaacaaacttatggaagttcacaacaaggcgaatctagtgcaggaaaccagggaatgctatcaccctacagatccagttcgnttcctgtgcctcaatatgcgttgcagagagataatgtatttcccgagagacctgatgaaccagaatgccaatattacatgaagacaggagattgtaaatttggtgcagtgtgcaagttccatcatccccgggtgagagcactgccccctccagattgtgtcttaagtccaatgggtcttccaatacgtccaggtgaagaattgtgcaaattctattctcgttatggcatctgcaagtttggcgccaactgtaaatttgaccatcctacaatggctgctccaatgggagtctatgcatatggtttctctgcgtctggttctcctgcatctgcttcaactaatctacctatggcgcgacggcttctgggatccccatccggttctggatatgcatcctaggcgtctttttttcacttgacctactttgatgtataaaatccacggcattgcctcaggcgcagagaatgtttctcctaacttcccgccgggatcaaagttctgtaaattgagttgctaccggagatgtacagcccccttttttttgttaatccagatctttgggaataactcttggaaccgaataaactttagatgcag

SEQ ID NO: 1586 - DNA, 1747 bp, Zea mays
agagctctagaagagcaggcgcaacgcaacgcgcgagtgagtgcacgtagcaaaccgcctcgtcgaaaggaggagagagaaacaagtatatacgaggggcagggccccccctcctctcccttcgtccattccgatcactcgctgctcccctctctcgccggagcgagccccgggccggatggcggcggcagcagcagctcctcccgcctccgcgatcgcgtgatggacgccgacgccgacgccgccgcgatccgccgatggacgacgccggaagggcaccaccacccgcgccagcggcggtgaccgtctccgccaccgccgcacccgcgcctaccccgccctccgccacggccgccgccgacaagtcctccctcgaccccgacgcgctttatgaagaggggatgtggcaacagatggccatgaacagcggtgccacaatgcaacctgggtcatatcctgagcgaccaggtgaaccggactgcacttactacctcaggactggattgtgtcgatttggcatgagctgcaggttcaatcatcctccggataggaatctggctattgcctctgccagaatgaagggagaatatcctgagagagtgggacagccagagtgtcagtattatctgaagaccggaacatgcaagtttggtcctacatgcaaatttcaccatcccagggaaaaggccggaattgcagggagggtgcagctaaacacattaggatatccacttctcccgaatgaaaaggagtgtgcgtattatttaaaaacaggacaatgtaaatatgcaaatacttgtaaattccaccacccagaacttttcaatgtggtgccttcgtcacgtggttcacctatttatacttctgtacattcctctgcaagcgctggtccacagtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatttcctgtgcctcaatatgcgttgcagagagataatgtatttcctgagagacccgatgaaccagaatgccaatattacatgaagacaggagattgtaaatttggtgcagtgtgcaagtttcatcatccccgtgtgagatcacagccccctccggattgtgtcttaagtccaatgggccttccaatacgtccaggtgaagaactgtgcaaattctattctcgttatggcatctgcaagttcggcgccaactgtaaatttgatcatcctacaatggctgctccaatgggagtttatgcatatggtttctctgggtctgcttctgtcgcacccgcttcaactaatgcacctatgacgcgacatcttcttggatctccatcaggttctggatatatgtcttaggtgtctttttttcagttgacctactttgatgtataaaatccacggcatcgcctcaggcgctgtgaatgtttctcctaacttcccgccgggatgaagttctgtaaattgagttgctgccggagatgtacagcccccctccccccccccccctccccaattaatccagaactttgggaataactgttggaacctaataaacttcagat

SEQ ID NO: 1587 - DNA, 3305 bp, Brachypodium distachyon
catccattcgcttcgctcgccaacactccaagtagatacgatacaccacgcgtagtagacggtagtagtacacgcggcacgatacgtagtggctcgattaacgcccactttttcttcactatactccacgcaccaaattaaagcagagggtgttgttcatttcgttggaagatttggagggagcccgtttctataccagtagaggactacaccacgcaccaaatagaagcgggggtacagatcggtaagtgccgacgatcgatggaggtgtgctgctgctccacctcgtcttccgtcctcgccggggatcgcgtcggcaggaggttcgccccgccggcggcgcggtactggggcgcggtgggcggcggcggcgggagggcggtggtgctggcgcacccgctgcgcccggccgccgccaggccggcgcaggctcagccccacgcgcgtcgggtgcggcgcgggggcgcggtgatcaggtccgtgttcgagcggttcacggagcgggccgtcaaggcggtggtgctgtcgcagagggaggccaaggggctcggcgcgggcgccgtggcgccgcgccacatgctgctgggcctcgtcgcggaggaccgctccgctggggggttcctctcctccgggatcagcatcgagcgcgcgcgcgaggagtgccgcagcatcggcgcccaggacgcgggagcgcctccgccgccgccggcgggctcggggctggagacggacgtgcccttctccggaacctgcaagcgtgtgttcgaggtggccgtggagttctccaagaacatgggctgcagcttcatctccccggagcacctcgccctcgcgctcttcactctcgacgatcccaccaccaacactctactcagaagcctgggagccgatccgagtcagctagcatcagttgcacttgcccgacttcaaggggagcttgcaaaagatggcagagatcccgcaggagcctcttctttcaaagtacctgagaaatctcctgctggagccggaagatccgccttcaccaaatccttgagtaaaaagaaagagaagggtgcactagatcaattttgtttagatttgaccacacaagctagtggaggtttcattgaccctattattggccgtgaggaggagattgaacgagtagttcagataatatgccgacggacaaagaacaatcctattcttctgggtgaggcgggtgttggtaaaactgcaattgctgaagggctggctcttcgaattgcaaatggagatgtccccatttacctcgtggcaaagcgtataatgtcactggacgtcggtctactcattgctggtgccaaagaaaggggcgaattggagtccagggtcactaatttaattcgtgaagtccgtgaagcaggtgatgttattcttttcattgacgaggttcacaatcttattggatccggaactgttggaaagagtaagggtgctggccttgacattagcaatttgctcaagcccccacttgctagaggtgaattgcagtgcattgcagctacaactttagatgaacatagaatgcattttgagaaggataaggctttggcacgcaggttccagccagttttagtagaggagcctagccaggaagatgcggtgaaaattttgcttggtcttcgtgagaactatgaaacttatcataaatgcaagttcactttagaggccatcaatgcagcagtttatttgtcagcaagatatatccctgacagacagcttcccgataaggctattgatcttcttgatgaagctggcagtagagctcgtattgaatcatttcaaaggaagaaagaagggcagtcttctgttcttttaaaggcaccagatgaatactggcaagagataaaagctgttaaggccatgcatgaagtggtgttatctaacaagacaaaatattctccaaatgagaacgctcaagagaatgatagtagtaacaccgaaaaacaatgtcaagagaaggctgggtcaacatctacctcatcaccctcagttgaggagccagttgtagtgggaacagaggaaattgcaagggtggcctcgctatggtcaggtataccagtccagcagctgactgctgatgataaaaagattttagtaggactagatgatgagctcagaaagcgtgtcattggtcaagatgatgctgttgttgcaatatcacgagcggtgaagagatcacgtgttggcctcagtgaccctgacagacctattgctacactccttttctgtggtccaacaggagttggtaaaaccgagcttaccaaagctctagcagcaagttactttggatcggaatctgctatgcttagattagacatgagcgaatatatggagaggcacaccgtgagcaagctgataggctcccctccagggtacattggatatggtgaaactggtactttgacagaagcagtcaggagaaaaccattcaccgtggtactacttgatgagatagagaaagctcaccctgatattttcaacattcttctccaaatcttcgaagatggacatctggcagactcacagggtcgcagagtttcattcaagaatacattgattgtcatgacatcaaatgttggttctacgtcaatttcgagtggacggcggagcataggcttctcaacagatgatactgaatcaagcacgtatattgcaatgaaatccctcgtaatggaagagctcaagggatttttccgcccagaattgctcaatagaattgatgagatggttgtgttccgtcctctggagaagactcagatgctagcaattcttgatatcatcctacaagaactgaagggtaggctgttagcccttgggatagggctagaggtgtccgacgcaatgaaaggcttgatttgccaagaaggctatgacaagagctacggtgcacgaccactgaggagagcagtcacccacctgatggaggatgtcatcagtgaagcaattctgttcggtgagtacaagcctggcgacacgatattggtggatactgacgatgaaggaaagccttgcttgagccatctgaacaagcagatcgttcaattgtctgacccaacacggacattctgaagctctgatgccgtagagtagttgtctaatttttcattctttcaggcaacgagattagtaattctttgataggtagactcggagtatttcattatgtacataacattcagtaaatttgtcacgacatgtcgacatagtcttgtcctaaattatccaactgtatattgtccttcacatcagcaaatatattggagtattttgaaactacc

SEQ ID NO: 1588 - DNA, 3246 bp, Sorghum bicolor
atggaggtgtgctgctgctcgacctcctcgtcgtcgtccgtcctcaccgtgggccacggcggcgccgcgcggatgctggcggcgccggcgggtcggtggggcgcggcggcggggttcgggagggcgatggtgctggcgcaccagctcccgctcccgctcccgctcccgctcccgcgcccggcagccagggccagggccaggccggccccgcggcgccgcaggggaggaggagtcgtcagggcggtgttcgagcggttcacggagcgggccgtcaaggcggtggtgctgtcgcagcgggaggcccgggggctcggggagcccgccgtggcgccgcgccacctcttcctcggcctcgtcgccgaggaccgctcctcgggcgggttcctctcgtccgggatcaacatcgagcgcgcaagggaggagtgccgcggcatcgctgccgccagggacgacgccgactcgacggccgcgccgtcgtccaggcccggatcgggggggctcgacacggacgtgcccttctccgccaccgccaagcaggtcttcgatgtcgccgtcgtgctgtccaagaacatgggcgccagcttcatctcgcctgagcacctcgccatcgcgctcttcaccctcgacgatccaaccaccaacaacctcctaaggagtttgggagcggatcccagtcacctagcatcagttgcggtcgaccgtctccaagcggagcttgcgaaagatggcagagaacctgccgaaccgtcgtctttcaaagtcccaaagaaagcccctgctggagccggaagatctgccttctcccactccttgactaaaaagaaagataagggtgcactggatcaattttgtttggatttgaccacacaagctagtggaggtttcattgatcctattattggccgtgaagacgagattgaaagagtagttcagataatatgccgacggacgaagaacaaccctattcttctgggtgaggcgggtgttggcaaaactgcaattgctgaggggctggctcttcgaattgcaaatggagatgtccccatttaccttgtggcaaagcgtatattgtcactggacgttggtctacttattgctggtgcaaaggagaggggtgaactggagtctagggtcactaatataatccgtgaagtccgggaagcaggcgatgttattctttttatcgatgaggttcacaatcttattggatctggaactgttggaaagggtaagggttctggtcttgacattggcaacttgctgaagcccgcacttgctagaggtgaactgcagtgcattgcggctacaactctagatgaacaccggatgcattttgagaaggataaggctttggcccgccgcttccagccagtattagtagatgagcctagtcaggaagatgctgtgaagatattactgggtcttcgtgagaaatatgaaacttaccataaatgcaaattcacattggaagccatcaatgcagcagtttatttgtcagcaagatacattcctgacagacaacttcctgataaggctattgatctgattgatgaggctggaagtagggctcggatggaatcatttaataagaagaaggaagggcagtcttcaattctcttgaaatcaccagatgagtactggcaagagataagagctgctcaggccatgcatgaagtggtgttatctaacaaggcaaaatattctccaaatgagaatgctcaagaaagtggtagcgctaccgttgaagcaccaagtcgagacaatatcgagtcaacatctggttcctcactctcagctgatgaaccaattgtagttgggacagaggaaattgcaagagttgcctcattatggtctggaataccagtgcagcagttgactgccgacgataaaaaacttctagtaggactagacgacgagctcagaaaacgtgtcattggtcaagatgatgctgttgtggccatatctcgtgcagtgaagagatcacgtgttggccttaatgaccctgacagacctattgccacgctgcttttctgtggtccaacaggagttggtaaaacagagctcaccaaagctctagcagctagttattttggatcggaatctgctatgcttaggttagacatgagcgagtatatggagaggcacactgtgagcaagctcataggttctcctccagggtacattgggtatggtgaaactggtactttgacagaagcagtcaggagaaaaccatttaccgtggtattgatggatgagatagagaaagctcaccctgatattttcaacatccttctccaaatctttgaggatggacatttgacagactcacagggccgtaaggtttccttcaaaaatacgttgattgtcatgacttcgaatgttggttcgacaacaatttcaaagggacgacagagcataggtttcttgaaggaagataccgagtcaagctcgtattttgcaatgaaatccttagtaatggaagagctcaaggcatttttccgtccagagttgctcaataggattgacgagatggttgtgttccgtcctctggagaagactcagatgctggccattcttgatatcatcctaaaggaagtcaagggccgacttttggcccttgggataggtttggaggtgtctgaggcaatgaagcacctgatttgccaagaaggctacgacaagagctatggtgctcggcctctgaggagagctgttgcccacattatcgaggatgtcattagtgaagctattctttttggcgagttcaagcctggtgacacgatactgatggacattgatgcagaggggaagccatgcatgaaccatctggaccgacagatcgtccaggtctctgacccaacacggacgttctgaagttctgtgccggactttctgaagttgtacttccagtgtagtagactagggatctaatcttttattctttcaagcatcgtgattattaattctttcatacatagatatatagagtagtattccatcttgtacatatatcaaccagatggtccagataggggaatctggtcagttattgacgttgtttgaaattttcatccaactgtatgtatatttgttgaattgtttccgattcaattggccacatgtatcattcttataccgtctatgcctccgcttgccagaaggtacagttcatgactattgttctgttaccattcaactgactatatgtatatcattctaataccgtctactccagtcggttgcttc

SEQ ID NO: 1589 - DNA, 3187 bp, Zea mays
actcatccactcgccacgccacgccacgccacgcctccaactccaagcagatagatagactagatagctgttggcgtgcgacgcgtagcgagagcgtgactaaccgctgcctaagcaaccatataagcatttgattcgttcctaggacaggggagggttaaggtagttccttaatttttcttgcttttttttgtgtgtgtcgttgctggcgcggtagctatggaggtgtgctgctgctccacctcgtcgtccgtcctcaccgccgggggccgcggcgccgcggcgcggaggctggccgcgccggcggctcgctggggcgcagcggggttcgggagggcggtgcgggaggcccgggggctcggggagcccgccgtggcgccgcgccacctcctcctcggcctggtcgccgaggaccgatcctcgggcggcttcctctcgtcggggatcaacatcgagcgcgcgcgcgaggagtgccgcggcatcgctgccagtgccagggacgcggactcggccaccgcggcgtctaggcccgggtcgtcggggctcgacacggacgtgcccttcgccgcgcccaccaagcaggtcttcgacgtggccgtcgtgctctccaagaacatgggctccagcttcgtctcgcccgagcacctcgccatcgcactcttctccctcgacgatccaaccaccaacaacctcctaaggagtttgggagcggatcccagtcatctagcatcggttgcagtcgaccgtctccaagcagagcttgcgaaagatggcagagatcctgctgaaccatcatctttcaaagttccaaagaaagcccctgctgcagccggaagatctgccttctcccagtccttgactaaaaagaaagataagggtgcgctggatcaattttgtttggatttgaccacacaagctagtggaggtttcattgatcctattattggccgtgaagaagagattgaaagagtagttcagatagtatgccggcggacgaagaacaaccctattcttttgggtgaggcgggtgttggcaaaactgcaattgccgagggtctggctcttcgaattgcaaatggagatgtccccatttaccttgtggcaaagcgcatattgtcgctagatgttggtctccttattgctggtgcaaaggagaggggtgaactggagtctagggttactaatataatccgcgaggtccgggaagcaggcgatgttattctttttattgatgaggtccacaaccttattggatctggaactgttggaaagagtaagggttctggtcttgacattggcaacttgctgaagcccgcgcttgctagaggtgaattgcagtgcattgctgctacaactctagatgaacaccggatgcattttgagaaggataaggctttggcccgccgcttccagccagtactagtagatgagcctagtcaggaagatgctgtgaagatattactgggtcttcgtgaaaaatatgaaacttaccataaatgcaaattcacattggaagccatcaatgcagcagtttatttgtcagcaagatacattcctgacagacagcttcctgataaggctattgatctgattgatgaggctggaagtagagctcggatggaatcatttaataggaagaaggaagggcagtcttcgattctcttgaagtcaccagatgaatactggcaagagataagagctgctcaggccatgcatgaagtggtgttatctaacaaggaaaaatattctccaaatgagaatgctgaagagagtggtagtgctaacgttgaagcactacacagagacaatattgagtcaacatctacttcatcactctcagctgatgaaccagttgtagttgggacagaggaaattgcaagggttgcctcattatggtctgggataccagtacagcagttgactgccgacgataaaaaacttctagtaggactggacgacgaactcagaaaacgtgtcattggccaagatgatgctgttgtggccatatctcgtgcagtgaagagatcacgtgttggccttaacgatcctgatagacctattgctacgctgcttttctgtggtccaacaggagttggtaaaacagagctcaccaaagctctagcagctagttattttggatcggaatctgctatgcttaggttagacatgagcgagtatatggagaggcacactgtgagcaagctcataggctctcctccagggtacattgggtatggtgaaactggtactttgacagaagcagtcaggagaaaaccatttactgtggtattgttggatgagatagagaaagctcaccctgatattttcaacatccttctccaaatatttgaggatggacatttgacagactcacagggtcgcagggtttccttcaaaaatacgttgattgtcatgacttcgaatgttggttcaacatcaatttcaaaaggaagacagagcataggtttcttgaaggaagataccgagtcaggctcatacttcgcaatgaaatccttagtgatggaagagctcaaggcatttttccgtccagagttgctcaatagaatcgacgagatggttgtgttccgtcctctggagaagactcagatgctggccattcttgatatcatcctaaaggaagtcaagggccgacttttggccctcgggataggtttggaggtgtctgatgcaatgaaggacctgatatgccaagagggctacgacaaaagctatggcgctcggcctctgaggagagctgtcacccacattatcgaggatgtcatcagcgaagcgattctttttggcgagttcaagcccggtgacacgatactgatggacatcgatgcagaggggaagccatgcatgggccatctggaccaacagatcgtccaggtctctgacccaacacgggcaatctgaagctgtgttggaccttttccagtgtagtagattagggatctaaaaatcttttattctttcaagcatcgagattattaattctttgttacgtagatatatagagtagtatttcattatgtatatatatcaaccagatgatccagataggggaatctggtcagtcattggagttatttgaaattttcatccagctgtatgtatattgttgaattgtttctgattcaactggccatatatatcatcattaaactttcttcatcggcttacc

SEQ ID NO: 1590 - DNA, 2976 bp, Sorghum bicolor
atggaggtgtgctgctgctcgacctcctcgtcgtcgtccgtcctcaccgtgggccacggcggcgccgcgcggatgctggcggcgccggcgggtcggtggggcgcggcggcggggttcgggagggcgatgcgggaggcccgggggctcggggagcccgccgtggcgccgcgccacctcttcctcggcctcgtcgccgaggaccgctcctcgggcgggttcctctcgtccgggatcaacatcgagcgcgcaagggaggagtgccgcggcatcgctgccgccagggacgacgccgactcgacggccgcgccgtcgtccaggcccggatcgggggggctcgacacggacgtgcccttctccgccaccgccaagcaggtcttcgatgtcgccgtcgtgctgtccaagaacatgggcgccagcttcatctcgcctgagcacctcgccatcgcgctcttcaccctcgacgatccaaccaccaacaacctcctaaggagtttgggagcggatcccagtcacctagcatcagttgcggtcgaccgtctccaagcggagcttgcgaaagatggcagagaacctgccgaaccgtcgtctttcaaagtcccaaagaaagcccctgctggagccggaagatctgccttctcccactccttgactaaaaagaaagataagggtgcactggatcaattttgtttggatttgaccacacaagctagtggaggtttcattgatcctattattggccgtgaagacgagattgaaagagtagttcagataatatgccgacggacgaagaacaaccctattcttctgggtgaggcgggtgttggcaaaactgcaattgctgaggggctggctcttcgaattgcaaatggagatgtccccatttaccttgtggcaaagcgtatattgtcactggacgttggtctacttattgctggtgcaaaggagaggggtgaactggagtctagggtcactaatataatccgtgaagtccgggaagcaggcgatgttattctttttatcgatgaggttcacaatcttattggatctggaactgttggaaagggtaagggttctggtcttgacattggcaacttgctgaagcccgcacttgctagaggtgaactgcagtgcattgcggctacaactctagatgaacaccggatgcattttgagaaggataaggctttggcccgccgcttccagccagtattagtagatgagcctagtcaggaagatgctgtgaagatattactgggtcttcgtgagaaatatgaaacttaccataaatgcaaattcacattggaagccatcaatgcagcagtttatttgtcagcaagatacattcctgacagacaacttcctgataaggctattgatctgattgatgaggctggaagtagggctcggatggaatcatttaataagaagaaggaagggcagtcttcaattctcttgaaatcaccagatgagtactggcaagagataagagctgctcaggccatgcatgaagtggtgttatctaacaaggcaaaatattctccaaatgagaatgctcaagaaagtggtagcgctaccgttgaagcaccaagtcgagacaatatcgagtcaacatctggttcctcactctcagctgatgaaccaattgtagttgggacagaggaaattgcaagagttgcctcattatggtctggaataccagtgcagcagttgactgccgacgataaaaaacttctagtaggactagacgacgagctcagaaaacgtgtcattggtcaagatgatgctgttgtggccatatctcgtgcagtgaagagatcacgtgttggccttaatgaccctgacagacctattgccacgctgcttttctgtggtccaacaggagttggtaaaacagagctcaccaaagctctagcagctagttattttggatcggaatctgctatgcttaggttagacatgagcgagtatatggagaggcacactgtgagcaagctcataggttctcctccagggtacattgggtatggtgaaactggtactttgacagaagcagtcaggagaaaaccatttaccgtggtattgatggatgagatagagaaagctcaccctgatattttcaacatccttctccaaatctttgaggatggacatttgacagactcacagggccgtaaggtttccttcaaaaatacgttgattgtcatgacttcgaatgttggttcgacaacaatttcaaagggacgacagagcataggtttcttgaaggaagataccgagtcaagctcgtattttgcaatgaaatccttagtaatggaagagctcaaggcatttttccgtccagagttgctcaataggattgacgagatggttgtgttccgtcctctggagaagactcagatgctggccattcttgatatcatcctaaaggaagtcaagggccgacttttggcccttgggataggtttggaggtgtctgaggcaatgaagcacctgatttgccaagaaggctacgacaagagctatggtgctcggcctctgaggagagctgttgcccacattatcgaggatgtcattagtgaagctattctttttggcgagttcaagcctggtgacacgatactgatggacattgatgcagaggggaagccatgcatgaaccatctggaccgacagatcgtccaggtctctgacccaacacggacgttctgaagttctgtgccggactttctgaagttgtacttccagtgtagtagactagggatctaatcttttattctttcaagcatcgtgattattaattctttcatacatagatatatagagtagtattccatcttgtacatatatcaaccagatggtccagataggggaatctggtcagttattgacgttgtttgaaattttcatccaactgtatgtatatttgttgaattgtttccgattcaattggccacatgtatcattcttataccgtct

SEQ ID NO: 1591 - DNA, 2927 bp, Avena sativa
cggcccccacgcgccggccgcgccgcagggccggggtcatcagggcggtcttcgagcgcttcacggagcgagccgtcaaggctgtggtgctgtcccagagggaggcaaaggggctcagggagggcgccgtggcgccgcgccacatgctgctgggtctcattgcggaggaccgctccgccggaggcttcctctcgtcgggaatcagcatcgagcgcgcgcgcgaggagtgccgcagcatcggcgcccaggacgcgggggcatccccgccgcctccgacctcggggctggacacggacgtgcccttctccgggggctgcaagagggtgtttgaggtggcgttggagttgtccaggaacatgggctgcagcttcatctccccggagcacctcgccatagcgctcttcactctcgacgatcccactaccagcaatctcctcagaagcttgggggcagatcctagtcaactggcatccgttgcactcatccgactacagggagagcttgcaaaagatggcagagatcctgctggagcgtcttctttcaaagtgcctgagaaatctcctgctggagccggaagatctgccttcaccaaatccttgagtaacaagaaagaaaaaggtgcgctagatcagttttgtctagatttgaccacacaagccagcggaggatttgttgatcctattattggtcgtgaggaggagattgaaagagtagttcagattatatgcaggcggacaaagaacaatcccattcttttgggtgaggcaggtgttggtaaaactgcaattgccgaagggcttgctcttcgaattgcaaatggcaatgtccccatttacctcgtggcaaagcgtattatgtcactggatgttggcctacttattgctggtgcaaaagagaggggcgaattggagtccagggtcactagtttaattcgtgaagtccgtgaagcaggtgatgttattcttttcattgatgaggttcacaatcttattggatctggaactgttggaaagggtaagggttctggcctggatattagcaatttgctaaagccgccacttgcaagaggcgaactgcagtgcattgcagctacgactctagatgaacaccggatgcattttgagaaggataaggctttggcccgtaggttccagccagtattcgtagatgagcctagccaggaagatgctgtggaaatactacttggtcttcgtgagaattatgaaatttatcataaatgcaaattcactctagaagccatcaatgcagctgtttatttgtcagcaagatatatccctgacagacagcttcctgataaggctattgatcttattgatgaagctggcagtagagctcgaattgagacatttcaaaagaggaaggaagggcagtcttctgttctcttaaaggcaccagatgaatactggcaagagataaaagctgtgcaggccatgcatgaagtggtattatctaacaagatgaaatattctccaaatgagaatgatcaacatagtgacaatggtaacaatgaagcgccaaatcaggataaggctggatcagcatccacctcgcccgtctcaattgaggagccagttgtagttggaagagaagaaattgcaagagtcacctcattatggtcgggtataccagtccagcagctcactgctgatgacagaaagatcttagtaggactagatgatgagctcaaaatgcgtgttattggtcaagatgatgctgttgtggcaatatcaagagcagtgaagagatcacgtgttggactcagtgaccctgacagacctatcgctacatttcttttttgtggtcctacaggggttggtaaaactgagcttaccaaagctctagcggcgagctactttggatcggaatctgctatgcttaggttagacatgagcgaatatatggaaaggcacacagtgagcaagttgataggctctcctccagggtacatcggatatggtgaaactggtactttgacagaggcagtcaggagaaaaccatttaccgtggtactgcttgatgagatagagaaagctcaccctgatattttcaacattcttctccaaatttttgaagatgggcatctggcagactcgcagggtcgcagagtttcgttcaagaatacattgattgtcatgacatcaaatgttggttctacatcaatttctgacggacgacggagcataggcttctcaacagatgaaactgagtcaagcacatatattgcaatgaaatccctcgtgatggaagagctgaaggcattttttcgtccagaattgctcaacagaatcgatgagatggttgtgttccgtcctttagagaagactcagatgctagcaattcttgatatcatcctacaagaactgaagggtaagctcttggcccttgggataggcttagaggtttcagatgcaatgaagagcctgatttgccaagaaggctatgacaagagctacggtgcgcgaccactgagaagagctgtcacccaactgatggaggatgtcatcagtgaggcaattcttttcggtgagtacaagcctggcgacacgatactggtggataccgacaaggatgggaaaccttgcttgagccgattgaaccaacagatcgtccaactgtctgacccaacacggacactctaatgctcttgtagagtagagtagaggtctaattttttattctttcatgcaacgagattagtaattctttgataggtagacaccgaatatatttcattatgtatagatataacaatcgggaatccgtccaagcagccttgttcagaatccaactgtatattgtccctcggttagcaaatacggagtatattatattttgaaacagctctgctgccggaagttactgctaggacttctccgtgtgcatcttcctggaatggatattttgga

SEQ ID NO: 1592 - DNA, 1119 bp, Brachypodium distachyon
ccccaccgaagaaccgaaccgaagcaatggcgacgctctccgtccccgccgccgtcccgcccgtcgccgaggactgcgagcagctccgcaaggccttccaagggtggggcacgaacgagaggctgatcatctccatcctggcgcaccgcgacgccgcgcagcgccgcgccatccgcgccgcctacgccgagcagtacggcgaggagctgctccgcgccctcggcgacgagatccacggcaaattcgagcgggcggtgatccagtggacgctggacccggcggagcgggacgcggtgctggcgagcgaggaggccaggaagtggcacccgggcggccgcgcgctggtggagatcgcgtgcgcgcgcacgcccgcgcagctcttcgccgccaggcaggcataccacgaacgcttcaagcgctcgctcgaggaggacgtcgccgcccatgccaccggcgacttccgcaagcttttggtgcctctggtaagtgcataccgctatgatggcccggaggtgaatacatctctggcacactctgaagccaagatactccatgagaagatcaatgatggggcttacggtgatgatgagatcatcaggattctcactacaaggagcaaagctcagctgcttgcaacattcaatagttacaatgatcagttcagtcatcccatcactaaggatctgaaggctgatcccaaggacgagttccaggcaacattgagggcgatcataaggtgcttcacctgccccgacaggtacttcgagaaaatcatccgattggctcttggaggcgtgggcacagacgagaactcgctgacgaggatcataaccactcgcgccgaggtggacctgaagctgataaaggaggcataccagaagaggaacagcgtcccgctggagaaggctgtttccaaagacacaaccagagactacgaggatatgctccttgccctcctgggagcagagtactgaggcgcaggtctttgtcttgcccctcttgtttgatggggaaataaaactgcgaattctgtcgcttttttctggatgattgtacgtaaactagcctgcatggcactgctcgtctaataaatcggtcttgtgtgttggtttgtcattt

SEQ ID NO: 1593 - DNA, 968 bp, Brachypodium distachyon
gaaccgaaccgaagcaatggcgacgctctccgtccccgccgccgtcccgcccgtcgccgaggactgcgagcagctccgcaaggccttccaagggtggggcacgaacgagaggctgatcatctccatcctggcgcaccgcgacgccgcgcagcgccgcgccatccgcgccgcctacgccgagcagtacggcgaggagctgctccgcgccctcggcgacgagatccacggcaaattcgagcgggcggtgatccagtggacgctggacccggcggagcgggacgcggtgctggcgagcgaggaggccaggaagtggcacccgggcggccgcgcgctggtggagatcgcgtgcgcgcgcacgcccgcgcagctcttcgccgccaggcaggcataccacgaacgcttcaagcgctcgctcgaggaggacgtcgccgcccatgccaccggcgacttccgcaagcttttggtgcctctggtaagtgcataccgctatgatggcccggaggtgaatacatctctggcacactctgaagccaagatactccatgagaagatcaatgatggggcttacggtgatgatgagatcatcaggattctcactacaaggagcaaagctcagctgcttgcaacattcaatagttacaatgatcagttcagtcatcccatcactaaggatctgaaggctgatcccaaggacgagttccaggcaacattgagggcgatcataaggtgcttcacctgccccgacaggtacttcgagaaaatcatccgattggctcttggaggcgtgggcacagacgagaactcgctgacgaggatcataaccactcgcgccgaggtggacctgaagctgataaaggaggcataccagaagaggaacagcgtcccgctggagaaggctgtttccaaagacacaaccagagactacgaggatatgctccttgccctcctgggagcagagtactgaggcg

SEQ ID NO: 1594 - DNA, 1156 bp, Festuca arundinacea
cacattcggacattccttcccaatcccgaaatctcgccgaggcacacgcagagcggcagagggagaccgcacgaaccgtaccggaccaatggcgaccctcaccgtccccgccggtgtcccgcccgtcgccgaggactgcgagcagctccgcaaggccttcacaggctggggcacgaacgagaagctgatcatcgacatcctggcccaccgcgacgcggcgcagcgccgcgccatccgcgccgcctacgccgagacctacggcgaggagctcctccgcgccctcaacgacgagatccacggcaagttcgagagggcggtgatccagtggacgctggacccggcggagcgcgacgcggtgctggccaacgaggaggccaagaagtggcacgcggggggccgcgcgctcgtcgagatcgcctgcacgcgcacgcccgcgcagctctgggccgccaagcaggcctaccacgaacgcttcaagagatcgctcgaggaggacgtcgccgcgcacgtcaccggagaattccgcaagcttttggtgcctcttgtaagcgcataccgctatgacggcccagaggtgaacacatcgttggcacactctgaagccaagatactccagggtaagatccatgacaaggcctatggtgatgaggaaatcatcaggattctcactacaaggagcaaagctcagttgcttgcaacattcaacagttacaatgatcagttcagccatcccatcaataaggacttgaaggaagaccccaaggatgagtacctggcgaccctgagggcgatcataaggtgcttcacctgccccgacagatacttcgagaagattatcaggctggctattggaagcatgggtacagacgagaactcccttacgaggatcataaccacccgtgccgaggtggacctgaagctgatcaaggaggcttaccagaagaggaacagcgtcccactagagaaagctgtttccaaggacacgaccagagactatgaagatatgctgcttgcactcctgggagcagagtactgaggcgtatgtctgatctaccttcttgtgtgatggggggaataaagagtgcttaaaactgtgagatgtgttgttttttcctgaatgattataaactagcctgcatggcagtgctcgtctggt

SEQ ID NO: 1595 - DNA, 1174 bp, Leymus cinereus x Leymus triticoides
  misc_feature (5)..(6): n is a, c, g, or t
  misc_feature (8)..(9): n is a, c, g, or t
  misc_feature (813)..(813): n is a, c, g, or t
  misc_feature (902)..(902): n is a, c, g, or t
  misc_feature (1117)..(1117): n is a, c, g, or t
cgtcnncnncccaatcgcgcgaggcgcagacggacggacagacgaaccggaccgggccaatggcgaccctcagcgtccccgccgccgtcccgcccgtcgccgaggactgcgagcagctccgcaaggccttcacggggtggggcaccaacgagaggctcatcatctccatcctcgcccaccgcgacgccgcgcagcgccgcgccatccgccacgcctacgccgaggcctacggcgaggagctgctccgcgccctcaacgacgagatccacggcaagttcgagagggcggtgatccagtggacgctggacccggcggagcgggacgcggtgctggccaacgaggaggccaagaagtggcacccggggggccgcgcgctcgtcgagatcgcctgcgcgcgcacccccgcgcagctcttcgccgccaagcaggcctaccacgaccgcttcaagcactcgctcgaggaggacgtcgccgcgcacgtcaccggcgacttccgcaagcttttggtgcctcttgtaagctcataccgctacgatggcccagaggtgaacacatcgttggcacactctgaagccaaactactccatgggaagatcagcgacaaggcttacagtgatgacgagatcgtcaggattctcactacaaggagcaaagctcagctacttgcaacattcaacagctacaatgatcagttcagtcatcccatcactaaggacctgaaggaagatcccaaggacgagttcctcgcaaccctgagggcgatcataaggtgtttcacttgccctgacagatactttgagaaggtcatccgantggcccttggaggcgtcggcacagacgaggacacccttacgagggtcataaccactcgtgctgaggtggacctgaaggtgataaaggangcgtaccagaagaggaacagcgtcccgctggagaaggctgtttctaaggaaacaaccagagactatgaagatatgatgcttgcacttctgggagcagagtactgaggcatatgtttgatctaccttatgtttgatggatgaataagtgcataaaactgtcgagtgtgttgtctttcatggatgattataagttggcttgcatggcagtgctcgtntgataaattatattattttgtcatttgagctgcagaaatatcattggtgttttttga

SEQ ID NO: 1596 - DNA, 1324 bp, Zea mays
ccactccaatcggcgaggcgaggcattctccgcaaacccctccacaccccacgcactcacggtcacgcagaagccagaacccctcgtctcccggcgcctgttccccgcgcgcaccgcggctacacataccctctccccatcccatttcccagatcccaccaacgcagcgcagggatcgagtagcccaccaccccaccccgcgacgctaaccgacgcaatggcgacgctcaccgttccttcctccgtcccggccgtcgccgaggactgcgagcagctccacaaggctttcgaaggttggggcaccaacgagaagctgatcatctccatcctggcccaccgcaacgccgcgcagcgccgcgcgatccgccgcggctacgccgaggcgtacgggaaggagctgctccgcgctctcggcgacgagatccacggcaagttcgagagggcggtgatcctgtggacgctggaccccgcggagagggacgcggtgctggcgaacgaggaggcgaagaagagccaccccggcggccgcgcgctggtggagatcgcgtgcgcgcgcacgcccgcgcagctctttgcggtcaagcaggcgtaccatgaccggtttaagcgatcgctcgaggaggacgttgccgcgcatgtcaccggcgacttccgaaagcttttagtgcctcttgttagtgcgtaccgctatgatggcccagaggtgaacacatctttggctcattctgaagccaaaatacttcatgagaagatccataagaaggcttacagtgatgaggagatcattagaattctcaccacacggagcaaagctcagctacttgcaacattcaatagctacaaggatcagttcactcatgcaatcaacaaggatctgaaagctgaccccaaggatgagtttctttcaacactgcgggcgatcatccggtgcttcacctgccctgacagatacttcgagaaagtcattcgactggctcttggaggcatgggcactgatgaggatgacctcaccagggtcgtaactactcgcgccgaggtcgacctgaagctgataaaggaggcttatcagaagagaaacagtgtgccgctggagcgtgctgtggccaaagatacaactagagattatgaggatattatgcttgccctccttggggcggagtgaggaggcgtgcctcaactcgatctcatctgctcctacttgtttgatggggccaaaaaactgcatcgacgtggtatccacatggccgtggttttgaataataataaatttgtaacacgtagcctgcattagcagcgcgttttaaataaaggaacttcctgatat

SEQ ID NO: 1597 - DNA, 1126 bp, Saccharum officinarum
atcccattcccagatcccaccgacgcaatggcgacgctcaccgtcccctcctccgtgccggccgtcgccgaggactgcgagcagctccacaaggccttcgaaggttggggcaccaacgagaagctgatcatctccatcctggcccaccgcaacgccgcgcagcgccgcgcgatccgccgcgcctacgctgaggcgtacgggaaggagctgctccgcgccctcggcgacgagatccacggcaagttcgagagggcggtgatcctgtggacgctggaccccgcggagagggacgcggtgctggcgaacgaggaggcgaagaagtggcaccccggcggctgcgcgctggtggagatcgcgtgcgcgcgcacgcccgcgcagcttttcgcggccaagcaggcgtaccacgaccgcttcaagcgctcgctcgaggaggacgtcgcctcgcacgtcaccggcgacttccgcaagctgttagtgcctcttgtaagtgcatatcgctatgatggcccagaggtgaacacatctttggcccattctgaagccaaaattcttcatgagaagattgataagaaggcttacagtgacgaggagatcatcaggattctcaccacacggagcaaagctcagctacttgcaacattcaataactacaaggatcagttcggtcatgcaatcaacaagcatctgaaagctgaccccaaggatgagttccttgcaacactgcgggcgatcatccggtgcttcacctgccctgacagatacttcgagaaagtcattcgactggctcttggaggcgtgggcacagatgaggatgctctcaccagggtcataactactcgcgccgaggtcgacctgaagctgataaaggaggcttaccagaagaggaacagtgtgccgctggagcgcgctgttgctaaagatacaactagagattatgaggatattctccttgccctcctaggggcggagtgaggaggcgtgcctcaactcatctgctcctccttgtttgatggaacagaaaaactgcatcgatgtggtatacacgtggttgtgtttttgaataataatgagtttgtaacctagcctgcattagcagtgcccattaaataaaaaaaaacttcttggt

SEQ ID NO: 1598 - DNA, 1297 bp, Sorghum bicolor
cccctccacaccccacgcagagacccctcgcctcacctcccggcgtctgttccccgcgcgcaccgcggtctccgctcatatctgcccacatcccattcccagatcccaccgatcgaaacgcgaccccgaaccgacgcaatggcgaccctcaccgtcccctcctccgtcccggccgtcgccgaggacgccgagcagctccacaaggccttcgaaggttggggcaccaacgagaagctgatcatctccatcctggcccaccgcaacgcggcgcagcgccgcgcgatccgccgcgcgtacgccgaggcgtacgggaaggagctgctccgcgccctcggcgacgagatccacggcaagttcgagagaacggtgatcctgtggacgctggaccccgcggagagggacgcggtgctggcgaacgaggaggcgaagaaatggcaccccggcggccgcgcgctggtggagatcgcgtgcgcgcgcacccccgcgcagctcttcgcggccaagcaggcgtaccacgaccgcttcaagcgctcgctcgaggaggacgtcgcggcgcacgtcaccggcgacttccgcaagctgttggtgcctcttgtaagtgcataccgctatgatggcccagaggtgaacacgtctttggcccattctgaagccaaaattcttcatgagaagatcgataaaaaggcttacagtgacgaggagatcatcaggattctcaccacacggagcaaagctcagctacttgcaacattcaataactacaaggatcagtttggtcatgcaatcaacaaggatctgaaagctgaccccaaggatgagttcctttcaacactgcgagcgatcatccggtgcttcacctgccctgacagatacttcgagaaagtcattcgactggctcttggaggcgtgggcacagatgaggatgctctcaccagggtcataactactcgcgccgaggtcgacctgaagctaataggggaagcttaccagaagaggaacagtgtgccgctggaccgtgctgttgctaaagatacaactagagattatgaggatattctccttgccctcctaggggcggagtgaggaggcgtgcctcaactccatcccatctgctcctccttgtttgatgggaacaaaaaactgcatcgatgtggtatacacgtggttgtgtttttgaacaataataagtttgtaacctagcctgcattagcagcgcccgttaaataaaaaaaaaaaccttctcgataagcttgttatcttttgactgccattaatacaacctgtgtttattgtggct

SEQ ID NO: 1599 - DNA, 1287 bp, Sorghum bicolor
ccccacgcagagacccctcgcctcacctcccggcgtctgttccccgcgcgcaccgcggtctccgctcatatctgcccacatcccattcccagatcccaccgatcgaaacgcgaccccgaaccgacgcaatggcgaccctcaccgtcccctcctccgtcccggccgtcgccgaggacgccgagcagctccacaaggccttcgaaggttggggcaccaacgagaagctgatcatctccatcctggcccaccgcaacgcggcgcagcgccgcgcgatccgccgcgcgtacgccgaggcgtacgggaaggagctgctccgcgccctcggcgacgagatccacggcaagttcgagagaacggtgatcctgtggacgctggaccccgcggagagggacgcggtgctggcgaacgaggaggcgaagaaatggcaccccggcggccgcgcgctggtggagatcgcgtgcgcgcgcacccccgcgcagctcttcgcggccaagcaggcgtaccacgaccgcttcaagcgctcgctcgaggaggacgtcgcggcgcacgtcaccggcgacttccgcaagctgttggtgcctcttgtaagtgcataccgctatgatggcccagaggtgaacacgtctttggcccattctgaagccaaaattcttcatgagaagatcgataaaaaggcttacagtgacgaggagatcatcaggattctcaccacacggagcaaagctcagctacttgcaacattcaataactacaaggatcagtttggtcatgcaatcaacaaggatctgaaagctgaccccaaggatgagttcctttcaacactgcgagcgatcatccggtgcttcacctgccctgacagatacttcgagaaagtcattcgactggctcttggaggcgtgggcacagatgaggatgctctcaccagggtcataactactcgcgccgaggtcgacctgaagctaataggggaagcttaccagaagaggaacagtgtgccgctggaccgtgctgttgctaaagatacaactagagattatgaggatattctccttgccctcctaggggcggagtgaggaggcgtgcctcaactccatcccatctgctcctccttgtttgatgggaacaaaaaactgcatcgatgtggtatacacgtggttgtgtttttgaacaataataagtttgtaacctagcctgcattagcagcgcccgttaaataaaaaaaaaaaccttctcgataagcttgttatcttttgactgccattaatacaacctgtgtttattgtggct

SEQ ID NO: 1600 - DNA, 1165 bp, Saccharum officinarum
  misc_feature (896)..(896): n is a, c, g, or t
atcccattcccagatcccaccgacgcaatggcgacgctcaccgtcccctcctccgtgccggccgtcgccgaggactgcgagcagctccacaaggccttcgaaggttggggcaccaacgagaagctgatcatctccatcctggcccaccgcaacgccgcgcagcgccgcgcgatccgccgcgcctacgctgaggcgtacgggaaggagctgctccgcgccctcggcgacgagatccacggcaagttcgagagggcggtgatcctgtggacgctggaccccgcggagagggacgcggtgctggcgaacgaggaggcgaagaagtggcaccccggcggctgcgcgctggtggagatcgcgtgcgcgcgcacgcccgcgcagctcttcgcggccaagcaggcgtaccacgaccgcttcaagcgctcgctcgaggaggacgtcgcctcgcacgtcaccggcgacttccgcaagctgttagtgcctcttgtaagtgcatatcgctatgatggcccagaggtgaacacatctttggcccattctgaagccaaaattcttcatgagaagattgataagaaggcttacagtgacgaggagatcatcaggattctcaccacacggagcaaagctcagctacttgcaacattcaataactacaaggatcagttcggtcatgcaatcaacaagcatctgaaagctgaccccaaggatgagttccttgcaacactgcgggcgatcatccggtgcttcacctgccctgacagatacttcgagaaagtcattcgactggctcttggaggcgtgggcacagatgaggatgctctcaccagggtcataactactcgcgccgaggtcgacctgaagctgataaaggaggcttaccagaagaggaacagtgtgcngctggagcgcgctgttgctaaagatacaactagagattatgaggatattctccttgccctcctaggggcggagtgaggaggcgtgcctcaactcatctgctcctccttgtttgatggaacagaaaaactgcatcgatgtggtatacacgtggttgtgttttttaataataatgagtttgtaacctagcctgcattagcagtgcccattaaataaaaaaaaacttcttggtaggcttggtattcttgactgcaattaacacccctatttt

SEQ ID NO: 1601 - DNA, 1191 bp, Pseudoroegneria spicata
ccgttgctgtcggcgcaccactcgtcgcccacgcaccaacacatccatctccccgaatcgcgccgaggcgcacgcacaccggaccggacgaaatggcgacgctctccgtccccgccgccgtcccggccgtcgccgaggactgcgagcagctccgcaaggcgttcgcggggtggggcaccaacgagcggctcatcatctccatcctggcgcaccgcgacgccgcgcagcgccgcgccatccgccgcgcctacgccgaggcctacggcgaggagctgctccgcgccatcggcgacgagatccacggcaagttcgagagggcggtgatccagtggacgctggacccggcggagcgggacgcggtgctggccaacgaggaggccaagaagtggcagccggggggccgtgcgctcgtggagatcgcctgcgcgcgcacgcccgcgcagctcttcgccgccaagcaggcctaccacgaccgcttcaagcactcgctcgaggaggacgtcgccgcgcacgtcaccggcgacttccgcaagcttttggtgcctcttgtaagcgcataccgctacgatggcccggaggtgaacacctcgttggcacactctgaagccaagatactccatgggaagatcagcgagaaggcttacagtgatgatgaggtcgtcaggattctcactacaaggagcaaggctcagctacttgcaacattcaacagctacaatgatcagttcagtcatccaatcactaaggacctgaaggaagatcccaaggacgagttcctctcaaccctgagggcgatcataaggtgtttcacttgtcctgacagatactttgagaaggtcatccggttggcccttggaggcgtcggcacagacgaggacacccttacgagggtcataaccactcgtgctgaggtggacctgaaggtgataaaggaggcgtaccagaagaggaacagcgtccctctggagaaggctgtttctaaggaaacaaccagagagtatgaagatctgatgcttgcacttctgggggcagagtactgaggcgtgtgtctgatctaccatatgcttgttgatgggggaataagagtgcataaaactgtcaagtgtgttgtttttcatggatgattataagttagcctgcatggcagtactcgtccgataaattatatcatttcgtcatttgagctgcaga

SEQ ID NO: 1602 - DNA, 1306 bp, Hordeum vulgare
ccgcgactcacgggcacatccatccgtctccccggaacgcggcgaggcgcacacgcacggacggacagacgaaccggaccggaccggaccggaaatggcgacgctctccgtccccgccgccgtcccggccgtggccgaggactgcgagcagctccgcaaggcgttcgccgggtggggcaccaacgagcggctcatcatctccatcctggcccaccgcgacgccgcgcagcgccgcgccatccgcaagcactacgccgacgcctacggcgaggagctgctccgctccatcaccgacgagatccacggcaagttcgagagggcggtgatccagtggacgctggacccggcggagcgggacgcggtgctggccaacgaggaggccaagaagtggaacccggggggccgcgcgctcgtcgagatcgcctgcgcgcgcacccccgcgcacctcttcgccgccaagcaggcctaccacgaccgcttcaagcgctcgctcgaggaggacgtcgccgcgcacgtcaccggcgacttccgcaagcttttggtgcctcttgtaagcgcgtaccgctatgatggcccggaggtgaatacgtcgttggcgcactctgaagccaagatactccatgcgaagatcagcgagaaggcctacagtgatgatgaggtcgtcaggattctcactacaaggagcaaagctcagctacttgcaacattcaacagctacaatgatcagttcagtcaccctatcaccaaggacctcaaggaagatcccaaggacgagttcctctcgaccctgagggcgatcataaggtgtttcacttgccccgacagatactttgagaaggtcatccggttggctcttggtggtgtcggtacagacgagcacacccttactagggtgataaccactcgtgccgaggtggacctgaaggtgataaaggaggcgtaccagaagaggaacagcgtccccctggagaaggctgtttccaaggacacaaccagagactatgaagatatgatgcttgcacttctgggagcagagtactgaggtcatatgtttgatctaccttatgtttgatggaggaataagagattaagagcgcataaaactggcgagtgtgttgtttttcatggatgattataagctagcctgcatggcagtgctcttccgataaattatatcatttcgtcatttaagctgcagaaatatcattggtgttttgaaagttttctccggattcagaataatcatttgcactggtgttattcttcataggatgctcacgtctatagagaatatccatttgtttca

SEQ ID NO: 1603 - DNA, 1273 bp, Avena sativa
catccgatcccccacccgctcccgaaatcgagccgaggcacacgcagtcagacacagacctgcgcgaaccgcgtaccggaccaatggcgacgctcaccgtccccgccggtgtcccgcccgtcgccgaggactgcgagcagctccacaaggccttcggaggatggggcacgaacgagcggctcatcatctccattctggcccaccgcgacgccgcgcagcgccgcgccatccgacacgcctacgccgaggcctacggcgaggagctgctccgcgccatcaacgacgagatccacggcaagttcgagagggcggtgatccagtggacgctggacccggcggagcgggacgcggtgctggccaacgaggaggccaagaagtggcacgcggggggccgcgcgctcatcgagatcgcctgcacgcgcacgcccgcgcagctcttcgccgccaagcaggcctaccatgaccgcttcaagcgatcactcgaggaggacgtcgccgcacacgtcaccggagacttccgcaagcttttggtacctcttgtgagcgcataccgctatgacggcccagaggtgaacacatcagtggcacactctgaggccaaactactccatggtaagatccaggagaaggcttatggtgacgaggaaattatcaggattctcactacaaggagcaaatctcagctacttgcaacattcaacagttacaatgatcagttcagtcatcccatcaccaaggacctgaaggaggatcccaaggatgagttcctggcgaccctgagggcgatcataaggtgcttcgcctgccctgacagatactttgagaagatcgtccggttggctcttggaggtgtcggcacagacgagaactcccttacaaggatcataaccactcgcgccgaggtggacctgaaggtgatcaaggaggcctacctgaggaggaacagtgtcctgctggagaaagctgtttccaaggacacgaccagagactatgaagacatgatgcttgcacttctcggagcagagtactgaggcgtatggtctgatctgctaccttatgtggtggcccttcttgtttgatggcggaataaaattgtgtaaaaactgtgaggtgtgttgattttcctggatgattataagtggcccggcctgcatggcagattggcggtgctcgtctgataagatttcattccgtcatttgaagtgcggaaaatacagttggtgtattccaaagtttggacgattcgatgggacttcggtaagagctttttttg

SEQ ID NO: 1604 - DNA, 1230 bp, Triticum aestivum
cccgtcgccaatttccatacaccaacacatacatctccccgaatcgcgccgaggcgcacacgcacaccggacgaaacgaaatggcgacgctctccgtccccgccgccgtcccggccgtcgccgaggactgcgagcagctgcgcaaggcgttcgcggggtggggcaccaacgagcgcctcatcgtctccatcctggcgcaccgcgacgccgcgcagcgccgcgccatccgccgcgcctacgccgaggcctacggcgaggagctgctccgcgccatcggcgacgagatccacggcaagttcgagagggcggtgacccagtggacgctggacccggcggagcgggacgcggagctggccggcgaggaggccaagaagtggcagccggggggccgcgcgctcgtcgagatcgcctgcgcgcgcacccccgcgcagctcttcgccgccaagcaggcctaccacgaccgcttcaagcgctcgctcgaggaggacgtcgccgcgcacgtcaccggcgacttccgcaagcttctggtgcctcttgtaagcgcataccgctacgatggtccggaggtgaacacatcgttggcacactctgaagccaaaatactcaatggaaagatcaacgagaaggcctacagtgatgatgagatcgtcaggattctcactacaaggagcaaggctcagctacttgcaacattcaacagctacaatgatcagttcagtcatcccatcactaaggacctcaaggaagacccaaagaacgagttcctctcaaccctgagggcgatcataaggtgtttcacttgccctgacagatactttgagaaggtcgtccggttggcccttggaggcgtcggcacagacgagaacacccttacgagggtcataaccactcgcgccgaggtggacctgaaggtgataaaggaggcgtaccagaagaggaacagcgtcccgctggagaaggctgtttccaaggaaacaagcagagactatgaagatatgatgctcgcacttctgggggcagagtattgaggcgtgtgcctgatctaccatatgcttgatgatggggggaataagagtgcataaaactgtcgagtgtgttgtttttcatggatgattatacgttagcctgcatggcagtactcgtccgataagttatatcatttcgtcatttgagctgcagaaatatcattggtgttttttgaagtttactccagattcagaataatcattt

SEQ ID NO: 1605 - DNA, 1264 bp, Triticum aestivum
ctccccgaatcgcgcccaggcgcacaccggaccggacgaaaatggcgacgctctccgtccccgccgccgtcccggccgtcgccgaggactgcgagcagctgcgcaaggcgttcgcggggtggggcaccaacgagcgcctcatcgtctccatcctggcgcaccgcgacgccgcgcagcgccgcgccatccgccgcgcctacgccgaggcctacggcgaggagctgctccgcgccatcggcgacgagatccacggcaagttcgagagggcggtggcccagtggacgctggacccggcggagcgggacgcagagctggccggcgaggaggccaagaagtggcagccggggggccgcgcgctcgtggagatcgcctgcgcgcgcacccccgcgcagctcttcgccgccaggcaggcctaccacgaccgcttcaagcgctcgctcgaggaggacgtcgccgcgcacgtcaccggcgaattccgcaagcttttggtgcctcttgtaagcgcataccgctacgatggcccggaggtgaacacatcgttggcacactctgaagccaaaatactcaatggaaagatcaacgagaaggcctacagtgatgatgagatcatcaggattctcactacaaggagcaaagctcagctacttgcaacattcaacagctacaatgatcagttcagtcaccccatcactaaggacctcaaggaagaccccaagaacgagttcctctcaaccctgagggcgatcataaggtgtttcacttgccctgacagatactttgagaagatcatccggttggcccttggaggcgtcggcacagacgagaacacccttacgagggtcataaccactcgcgccgaggtggacctgaaggtgataaaggaggcgtaccagaagaggaacagcgtcccgctggacaaggctgtttctaaggaaacaagcagagactacgaggacatgatgcttgcacttctgggggcagagtactgaggcgtgtgcctgatctaccatatgcttgatgatggggggaataagagtgcataaaactgtcaagtgtgttgtttttcatggatgattataagttggcctgcatggcagtactcgtccgataagttataccatttcgtcatttgagctgcagaaatatcattggtgttttttgaagtttactccagattcacaataatcatttgcattggtgttattctttgtaggattctcatgtctatacagaatgatcatttgtttctactggtatgatttat

SEQ ID NO: 1606 - DNA, 1287 bp, Hordeum vulgare
acatccatccgtctccccggaacgcggcgaggcgcacacgcacggacggacagacgaaccggaccggaccggaccggaaatggcgacgctctccgtccccgccgccgtcccggccgtggccgaggactgcgagcagctccgcaaggcgttcgccgggtggggcaccaacgagcggctcatcatctccatcctggcccaccgcgacgccgcgcagcgccgcgccatccgcaagcactacgccgacgcctacggcgaggagctgctccgctccatcaccgacgagatccacggcaagttcgagagggcggtgatccagtggacgctggacccggcggagcgggacgcggtgctggccaacgaggaggccaagaagtggaacccggggggccgcgcgctcgtcgagatcgcctgcgcgcgcacccccgcgcacctcttcgccgccaagcaggcctaccacgaccgcttcaagcgctcgctcgaggaggacgtcgccgcgcacgtcaccggcgacttccgcagcttttggtgcctcttgtaagcgcgtaccgctatgatggcccggaggtgaatacgtcgttggcgcactctgaagccaagatactccatgcgaagatcagcgagaaggacagtgatgatgaggtcgtcaggattctcactacaaggagcaaagctcagctacttgcaacattcaacagctacaatgatcagttcagtcaccctatcaccaagatcccaaggacgagttcctctcgaccctgagggcgatcataaggtgtttcacttgccccgacagatactttgagaaggtcatccggttggctcttggtggtgtcggtacagacgagcacacccttactagggtgataaccactcgtgccgaggtggacctgaaggtgataaaggaggcgtaccagaagaggaacagcgtccccctggagaaggctgtttccaaggacacaaccagagactatgaagatatgatgcttgcacttctgggagcagagtactgaggtcatatgtttgatctaccttatgtttgatggaggaataagagattaagagcgtataaaactggcgagtgtgttgtttttcatggatgattataagctagcctgcatggcagtgctcttccgataaattatatcatttcgtcatttaagctgcagaaatatcattggtgttttgaaagttttctccggattcagaataatcatttgcactggtgttattcttcataggatgctcacgtctatagagaatatccatttgtttctactggtataattt

SEQ ID NO: 1607 - DNA, 1145 bp, Brachypodium distachyon
agcgccgatggcgacgctcacggtcccttcctccgtcccggccatcaccgacgactgcgagcagctccgcaaggccttccaagggtggggcacgaacgaggcgctgatcatctccatcctgggccaccgcgacgctgcgcagcgccgtgccatccgccgcgcctacgccgagacgtacggcgaggagctcctgcgcagcatcaccgacgagatctctggcgatttcgagagggccgtgatcctgtggacgctggacccggcggagagggacgcggtgctcgccaacgagggggccaagaagtggcaccccgggagccctgtgctggtcgagatcgcgtgcgcgcgcgggtccgggcagctcttcgcggtcaggcaggcgtaccatgagcgcttcaagcggtcgctcgaggaggatgtcgccgctcacgtcaccggcgccttccgcaagcttttggtgccacttgttagctcataccgctacgaggggccagaggtcaacacaaggttggcccattcagaagccaaaatactgcatgagaagattgagcataaggcttatggtgatgatgagatcatcagaatcctcacaactaggagcaaagctcagctgcttgcaacattcaatcattacaatgatgcatttggtcacccaatcactaaggatctcaaggctgaccccaaagatgagttccttaaaaccctgagggcagttatacggtgcttcacttgccctgataggtactttgagaaggttatcaggttggccattgcagggacaggaacagatgagaactcccttactaggatcataacaacccgtgccgaggtggacctgaagctgataaaggaggcataccagaagagaaacagcgttcccctggagcgggcagtcgcaggagacacctctggtgactatgagagcatgctccttgcccttctggggaaggagtgagtcttgtctctgacccaattctgttacatccgtatgtatcagtcgaaaaataaacttggtatcaaagctgtggtcatgctatatttgaggttgtgtttctgtactggtaataattactgcagcttccttaacagagataataaaatagtgatgtacttcgtgaatcatgatacagttaattcttttgtttgtg

SEQ ID NO: 1608 - DNA, 973 bp, Brachypodium distachyon
agcgccgatggcgacgctcacggtcccttcctccgtcccggccatcaccgacgactgcgagcagctccgcaaggccttccaagggtggggcacgaacgaggcgctgatcatctccatcctgggccaccgcgacgctgcgcagcgccgtgccatccgccgcgcctacgccgagacgtacggcgaggagctcctgcgcagcatcaccgacgagatctctggcgatttcgagagggccgtgatcctgtggacgctggacccggcggagagggacgcggtgctcgccaacgagggggccaagaagtggcaccccgggagccctgtgctggtcgagatcgcgtgcgcgcgcgggtccgggcagctcttcgcggtcaggcaggcgtaccatgagcgcttcaagcggtcgctcgaggaggatgtcgccgctcacgtcaccggcgccttccgcaagcttttggtgccacttgttagctcataccgctacgaggggccagaggtcaacacaaggttggcccattcagaagccaaaatactgcatgagaagattgagcataaggcttatggtgatgatgagatcatcagaatcctcacaactaggagcaaagctcagctgcttgcaacattcaatcattacaatgatgcatttggtcacccaatcactaaggatctcaaggctgaccccaaagatgagttccttaaaaccctgagggcagttatacggtgcttcacttgccctgataggtactttgagaaggttatcaggttggccattgcagggacaggaacagatgagaactcccttactaggatcataacaacccgtgccgaggtggacctgaagctgataaaggaggcataccagaagagaaacagcgttcccctggagcgggcagtcgcaggagacacctctggtgactatgagagcatgctccttgcccttctggggaaggagtgagtcttgtctctgacccaattc

SEQ ID NO: 1609 - DNA, 1261 bp, Saccharum officinarum
cccatctcaccctgttcggctgtcccctcgatcccgcatcacaagtcaccgtgaatggcgacgctcaaggtcccagccactgtccctcccgtcgccgatgactgcgagcagctccgcaaggcattccaagggtggggcacgaacgaggcgctcatcatctccatcctcggccaccgcgacgccgcgcagcgccgcgccatccgccgcgcctacgccgaggcccacggcgaggagctcctccgctccatcacggacgagatctccggcgacttcgagagggccgtgattctgtggacgctggacccagcggagcgggacgcggtgctggccaacgaggcggcgcggaagtggcagcccgggaaccgcgtgctcgtcgagatcgcctgcacgcgcacctccgcgcagatcttcgcggccaggcaggcgtatcacgagcggttcaagcgctcgcttgaggaggacatcgctgcgcacgtcactggggacttccgcaagctactggtgccacttgtaagtacataccgctatgatggaccagaggtcaacacaaggttggcacactcagaagccaaactacttcatgagaagatccatcacaaggcttacagtgatgatgagatcatcagaatcctcaccactaggagcaaacctcagctgctcgctacattcaatcattacaatgatgcatttggccaccgaatcaacaaggatctgaaggctgaccccaaggatgagtacctcaaaacgctgcgggcaatcatccggtgcttcagttgccccgacaggtactttgagaaggtcgcccggcaggccatagcggggctaggcacagacgagaacgccctgaccagggtcatcaccacccgcgctgaggtggacctgaagctgattaaggaggcgtaccagaagaggaacagcgtgcccctggagcgcgcggtcgccggggacaccgccggcgactacgagagcatgctcctcgcgctcctggggcaggagtgatgagccgtgatgcagtgcctctctgaccggcgccgtggtgtcgttcatgatcataataaacctgctatgcctagctgtacgtgaggttgtttcttcggacttcggtcctggtactgtcgctacagcttgcatagcagtggtgaactggtgataaataagttactgtgtttccgacgaatgaactcatttttttagctatttcgtgggcactaaggcactatggaacctctgctgcatatgttggcagagacgttaattaaca

SEQ ID NO: 1610 - DNA, 1594 bp, Sorghum bicolor
gcccctctccgcccctgttcgcctatcccctcgatcccgcatcacagtcaccgggaatggcgacgctcaaggtcccagccactgtccctcccgtcgccgatgactgcgagcagctccgcaaggcattccaagggtggggcacgaacgaggcgctcatcatctccatcctcggccaccgcgacgccgcgcagcgccgcgccatccgccgcgcctacgccgaggcccacggcgaggagctcctccgctccatcacggacgagatctccggcgacttcgagagggccgtgatcctgtggacgctggacccagcggagcgcgacgcggtgctggccaacgaggcggcgcggaagtggcagccagggaaccgcgtgctcgtcgagatcgcctgcacgcgcacctccgcgcaggtcttcgcggccaggcaggcgtatcacgagcggttcaagcgctcgcttgaggaggacatcgctgcgcacgtcactggggacttccgcaagctactggtgccacttgtaagtacataccgctatgatggaccagaggtcaacacaaggttggcacactcagaagccaaactactccatgagaagatccatcacaaggcttacagtgatgatgagatcatcagaatcctcaccactaggagcaaacctcagctgcttgctacattcaatcattacaatgatgcatttggccaccgaatcaacaaggatctgaaggctgaccccaaggatgagtacctcaaaacactgcgggcaatcatccggtgcttcagttgccccgacaggtactttgagaaggtcgccaggcaggccatagcggggctaggcacagacgagaacgccctgaccagggtcattaccacccgcgctgaggtggacctgaaactgattaaggaggcgtaccagaagaggaacagcgtgcccctggagcgcgccgtcgctggggacacctccggcgactacgagagcatgctcctcgcgctccttgggcaggagtgatgagccgtggtgcactgttgcgtctctgaccggcgccgtggtgtcgttcatgatgataatcagaataaacctggtatgcctagctgtaccagaggtggtttcttcggacttcggtcctggtattacagcttgcatagcagtggtgataaataagttactgtgttttcgacgaatgaactcaatgtttagctacgtgggcactaagtcgtggaacctctgttgcatatgttggcagagacgcagagacgttatatcatgagaaacagcccgggagctccagtgaccatcatagtgtaggcgactatggcggtatgcctttgttatctgctgctttattgtccacaggggtgcatatacataaactgtactcgtctcgttcgctgacattgcagtagtgttgcgacgtgacttgttccgtacccgagccacctggggaaaagaaaatgagaggcaatagcttcgagctgaaccgccgccccgctgtcgcgaccagcgaggaagcaataagcaaggccgtcggcccatgccgtagatagtactcctccggttgtcttaacatgtcacattaatattatcctaagtcaaatattagt

SEQ ID NO: 1611 - DNA, 1293 bp, Oryza sativa
tcacccactccccgttcgtccgggtctcctctcctcccccgccgacgcgcactcgatcccccccgcctccgcctccgcctccgcctccgcgtcgcccatctcgagatcccccgcatggcgacgctcaccgtcccctccgccgtcccgcccgtcgccgacgactgcgaccagctccgcaaggccttccaagggtggggcacgaacgaggcgctcatcatctccatcctggcccaccgcgacgcggcgcagcggcgcgccatccgccgcgcctacgccgacacctacggcgaggagctcctccgcagcatcaccgacgagatctccggcgacttcgagagggccgtgatcctgtggacgctggacccggcggagcgcgacgcggtgctcgccaacgaggtcgcgaggaagtggtacccagggagcgggagccgcgtgctggtcgagatcgcgtgcgcgcgcggccccgcgcagctgttcgcggtcaggcaggcctaccacgagcgcttcaagcgctcgctcgaggaggacgtcgcggcgcacgccactggtgacttccgcaagctcttggtgccacttataagtgcttaccgctatgaggggccggaagtcaacacaaagttggcacattcagaagccaaaattctgcatgagaagatccagcataaggcatatggtgatgatgagatcatcagaattctcactactaggagcaaggctcagttgattgcgacattcaatcgttacaatgatgaatatggtcacccaatcaacaaggatctcaaggctgatcccaaggacgagttcctttccacgctgcgtgcaatcatccgctgcttctgttgccctgacaggtacttcgagaaagtcatcaggttggccatcgcaggcatgggaacagacgagaactccctcactaggatcattaccactcgtgccgaggtggatctgaagctgatcacggaggcgtaccagaagaggaacagtgtcccgctggagcgtgcggtcgcaggggacacctccggggactacgagaggatgcttcttgctcttctgggtcaggagcagtgagccatgcctatcttgcccagtcacacacttcatgtgatcatgtcatatcagagaataaacctgttatgcaggggacacagccgtggtgattatgatgttgtttttccagtgtacggtactgtttgctgcagcttgcataacagtgacgatgaaataaatcatagtggaatgcgttggctcatgggacctcacttattttgcaactttttgacaggtcttatttca

SEQ ID NO: 1612 - DNA, 1594 bp, Sorghum bicolor
gcccctctccgcccctgttcgcctatcccctcgatcccgcatcacagtcaccgggaatggcgacgctcaaggtcccagccactgtccctcccgtcgccgatgactgcgagcagctccgcaaggcattccaagggtggggcacgaacgaggcgctcatcgtctccatcctcggccaccgcgacgccgcgcagcgccgcgccatccgccgcgcctacgccgaggcccacggcgaggagctcctccgctccatcacggacgagatctccggcgacttcgagagggccgtgatcctgtggacgctggacccagcggagcgcgacgcggtgctggccaacgaggcggcgcggaagtggcagccagggaaccgcgtgctcgtcgagatcgcctgcacgcgcacctccgcgcaggtcttcgcggccaggcaggcgtatcacgagcggttcaagcgctcgcttgaggaggacatcgctgcgcacgtcactggggacttccgcaagctactggtgccacttgtaagtacataccgctatgatggaccagaggtcaacacaaggttggcacactcagaagccaaactactccatgagaagatccatcacaaggcttacagtgatgatgagatcatcagaatcctcaccactaggagcaaacctcagctgcttgctacattcaatcattacaatgatgcatttggccaccgaatcaacaaggatctgaaggctgaccccaaggatgagtacctcaaaacactgcgggcaatcatccggtgcttcagttgccccgacaggtactttgagaaggtcgccaggcaggccatagcggggctaggcacagacgagaacgccctgaccagggtcattaccacccgcgctgaggtggacctgaaactgattaaggaggcgtaccagaagaggaacagcgtgcccctggagcgcgccgtcgctggggacacctccggcgactacgagagcatgctcctcgcgctccttgggcaggagtgatgagccgtggtgcactgttgcgtctctgaccggcgccgtggtgtcgttcatgatgataatcagaataaacctggtatgcctagctgtaccagaggtggtttcttcggacttcggtcctggtattacagcttgcatagcagtggtgataaataagttactgtgttttcgacgaatgaactcaatgtttagctacgtgggcactaagtcgtggaacctctgttgcatatgttggcagagacgcagagacgttatatcatgagaaacagcccgggagctccagtgaccatcatagtgtaggcgactatggcggtatgcctttgttatctgctgctttattgtccacaggggtgcatatacataaactgtactcgtctcgttcgctgacattgcagtagtgttgcgacgtgacttgttccgtacccgagccacctggggaaaagaaaatgagaggcaatagcttcgagctgaaccgccgccccgctgtcgcgaccagcgaggaagcaataagcaaggccgtcggcccatgccgtagatagtactcctccggttgtcttaacatgtcacattaatattatcctaagtcaaatattagt

SEQ ID NO: 1613 - DNA, 1254 bp, Zea mays
ccttctcttccccatcatctccgcgcattttatatgcaggcttgcgcctgtcacttctcccctgtccttgctccccctcgatcccgcatcagtgcgtcacattcaccgggaatggcaacgctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctgcacgcgcacctccgcgcagatcttcgcgaccaggcaggcttatcacgagcggttcaagcgctcgcttgaggaagacatcgctgcgcacgtcactggggacttccgcaagctattggtgccacttgtaagtacttaccgctatgatggaccagaggtcaacacaaggttggcacactcagaagccaaactacttcatgagaagatccatcacaaggcttacagtgatgatgagatcatcagaatcctcaccactaggagcaaacctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggaggcgtaccagaagaggaacagcgtgccgctggagcgggccgtcgcgggggacacctccggcgactacgagagcatgctcctcgcgctcctggggcaggagtgatgagccgtactggtgcgctggtgcctttctgaccggcgccgtggtgtttgttcgtgatcgtaataaacctgattgcctagctgtacgtgaggctgtttcttcggtcctggtactgtcgctgcagcatgcatagcagtggaccagtggtgataaataagttactgtgctttcgacgaatgaaccctttttttgtgtcta

SEQ ID NO: 1614 - DNA, 1231 bp, Panicum virgatum
gacggacgcgcactccaccaccaccaccaccgggcccgtctcgagatcccgcatcccaggccccgccgccgatggcgacgctaaaggtccccgccaccgtcccgacagcctccgacgactgcgagcagctccgcaaggcgttccaagggtggggcacgaacgaggcgctcatcatctccatcctgggccaccgcgacgccgcgcagcgccgcgccatccgccgcgcctacgcggagacgtacggcgaggagctcctccgctccatcaccgacgagatctcgggcgacttcgagagggccgtgatcctgtggacgctggacccggcggagcgggacgcggtgctcgccaacgaggcggccaggaagtggcagcccgggaaccgcgtgctcgtcgagatcgcgtgcacgcgcggctccgcgcagctcttcgccgtcaggcaggcgtaccacgagcgcttcaagcgctcgctggaggaggacatcgctgcgcacgtcaaaggggacttccgcaagctgttggtgccacttgtaactgcataccgttatgatggaccagaggtcaacacaaggttggcacactcagaagccaaaatacttcatgagaagatccaacacaagtcttacagtgatgatgagatcatcagaatcctcaccactaggagcaaagctcagctgcttgctacattcaattactacaatgatgcatttggccacccaatcaacaaggatctgaaggctgatcccaaggatgagtacctcaagacgctgcgggcaatcatccgctgcttcacctgccccgacaggtacttcgagaaggtcgtcaggcaggcgatcgcggggctaggcacggacgagagctccctgacccgggtcatcaccacgcgcgcagaggtggacctgaagctgatcaaggaggcgtaccagaagaggaacagcgtgccgctggatcgcgctgtcgcgggggacacctccggtgactacgagaatatgctcctcgcgctcctggggcaggagtgatcactgatcagcccttgcgtgccgcactgtcgctgcccggttccgtgccgtgctgtttgtggtctgatcgggtaataaatctggtatgcgctgctgtaagtcgctgtggacgtgaggttgtttcttcagtgctggttctgtcgctgcagcttgcataacagtggtgatcaaataaatgatgtctgcaatgaatcatggcatttgtttttgtagtt

SEQ ID NO: 1615 - DNA, 1230 bp, Avena sativa
agcacacctcgagatcccgcatcgcagcgcgtacggtacgatcccgatggcgacgctcaccgtccccgcctccgtcccggccatcgccgacgactgcgagcagctccgcaaggccttccaagggtggggcacgaacgaggcgctcatcatctccatcctgggccaccgcgacgccgcgcagcgccgcgccatccgcaaggcatacgccgacacctacggcgaggagctcctaaggagcatcaccgacgagatctccggcgacttcgagagggccgtgatcctgtggacgctggaccccgcggagcgggacgcggtgctcgccaacgagggcgccaagaagtggcagcccggaagccccgtgctcgtcgagatcgcgtgcgcgcgcgggtcgggccagctcttcgccgtcaggcaggcataccatgaccgcttcaagcgctccctcgaggaggacgtcgctgcccacgtcaccggcgacttccgcaagcttctggtgccacttgtaagcgcataccgctatgaaggaccagaggtcaacacaaggttggcacattcagaagccaaaatactgcatgaaaagattgagcataaggcttacggtgacgatgagatcatcaggatcctcaccactcggagcaaagctcagctgcttgcaacattcaacaattacaatgattcatttggtcacccaatcactaaggatctcaaggctgaccccaaagacgagttcctgaaaactctgcgggcggtgatccggtgcttgacctgccctgacaggtactttgagaaagttctcaggttggcaattgcaggcaacggaacagacgagagctccctcaacagggtcatcactacccgcgccgaggtggacctgaagcacataaaggaggcgtaccagaagaggaacagcgttccgctggagaaggcgatcgccggagacacctccggggactatgagagcatgctccttgcccttctggggaaggagtgagtgttggctctgtacccgatcctgttgccctttgtatctcagtcgtcggaggataggtttgctatatgccagggcctggtcaccctggttatgagattgttctgttataccggtacagttgctgcgccttgcgtaacagtggtaataaaatggagagatgatttgcaaatggatggtgttacctttgtagtagtactgtacttggctgctattggaatctttgcgtcaaaatactgaac

SEQ ID NO: 1616 - DNA, 1444 bp, Hordeum vulgare
gggggggagccccggccccgcggaaacgcgcaatccatcgtccacccctcccttcccccgcccgacctcgagatcccgcatcgcgtcgcgcgtccgaccccccggcaccggcaggcaggcacccggtcccgatggcgacgctcaaggtcccctccaacgtccccgccctcgccgacgactgcgacaacctccgcaaggccttccaagggtggggcacgaacgaggcgctcatcatctccatcctgggccaccgcgacgccgcgcagcgccgcgccatccgcaagcactacgccgacacctacggcgaggagctgctccggagcatcaccgacgagatctcaggcgacttcgagagggctgtgatcctgtggacgctggaccccgcggagcgggacgcggtgctcgccaacgagaccgccaagaagtggcacccggggaaccccgtgctcgtcgagatcgcctgctcgcgcggctccgcgcagctcttcgccgtcaggcaggcctaccatgaccgcttcaagcgctcgctcgaggaggacgtcgctgcgcacgtcaccggcgacttccgcaagctcttggtgccacttgtaagctcataccgctatgagggaccagaggtcaacacaaggttggcacattcagaggccaaaatactgcatgagaagatcgagcacaaggcttacggtgatgatgagatcatcagaatcctcaccaccaggagcaaagctcagctgcttgcaacactcaataactacaatgacacatttggtcacccaatcaccaaggatctgaaggctgaccccaaggatgagttcctcaaaaccctgcgggcggttatccggtgcttcacctgccctgataggtactttgagaaggttgccaggttggccattgcagggaatggaaccgatgagaactccctcactagggtcataacgacccgcgccgaggtggacctgaagctgatcaaagaggcataccagaagaggaacagtgtccccttggagaaggccgtcgcaggcgacacctccggcgactacgagaccatgctccttgccctcctggggaaggagtgagccttgcctctgtatccaccccctgttatccttttcatatctcaaatcagagaataaaccctggtatgcaaggccgttttcaacgctggttatgatctgctgcgccttgcataacggtgagaataagatagagagaggtgtgctttacgatgagtcatgcatggtgatacgtttttgtactagcttagatgttcattcgcgtgtgaaatgcagtggagatgttaaaaaagtgagttttctgtaagcctgaaaaatctgaattgcatctgtattttgcttgaattgaatcgagtacatcagttcctaaatcttttaaagagggagaaggttatactccatctgttcctaaatataagtcttttcagaag

SEQ ID NO: 1617 - DNA, 1445 bp, Hordeum vulgare
aatagccccggccccgcggaaacgcgcaatccatcgtccacccctcccttcccccgcccgacctcgagatcccgcatcgcgtcgcgcgtccgaccccccggcaccggcaggcaggcacccggtcccgatggcgacgctcaaggtcccctccaacgtccccgccctcgccgacgactgcgacaacctccgcaaggccttccaagggtggggcacgaacgaggcgctcatcatctccatcctgggccaccgcgacgccgcgcagcgccgcgccatccgcaagcactacgccgacacctacggcgaggagctgctccggagcatcaccgacgagatctcaggcgacttcgagagggctgtgatcctgtggacgctggaccccgcggagcgggacgcggtgctcgccaacgagaccgccaagaagtggcacccggggaaccccgtgctcgtcgagatcgcctgctcgcgcggctccgcgcagctcttcgccgtcaggcaggcctaccatgaccgcttcaagcgctcgctcgaggaggacgtcgctgcgcacgtcaccggcgacttccgcaagctcttggtgccacttgtaagctcataccgctatgagggaccagaggtcaacacaaggttggcacattcagaggccaaaatactgcatgagaagatcgagcacaaggcttacggtgatgatgagatcatcagaatcctcaccaccaggagcaaagctcagctgcttgcaacactcaataactacaatgacacatttggtcacccaatcaccaaggatctgaaggctgaccccaaggatgagttcctcaaaaccctgcgggcggttatccggtgcttcacctgccctgataggtactttgagaaggttgccaggttggccattgcagggaatggaaccgatgagaactccctcactagggtcataacgacccgcgccgaggtggacctgaagctgatcaaagaggcataccagaagaggaacagtgtccccttggagaaggccgtcgcaggcgacacctccggcgactacgagaccatgctccttgccctcctggggaaggagtgagccttgcctctgtatccaccccctgttatccttttcatatctcaaatcagagaataaaccctggtatgcaaggccgttttcaacgctggttatgatctgctgcgccttgcataacggtgagaataagatagagagaggtgtgctttacgatgagtcatgcatggtgatacgtttttgtactagcttagatgttcattcgcgtgtgaaatgcagtggagatgttaaaaaagtgagttttctgtaagcctgaaaaatctgaattgcatctgtattttgcttgaattgaatcgagtacatcagttcctaaatcttttaaagagggagaaggttatactccatctgttcctaaatataagtcttttcagaagtttca

SEQ ID NO: 1618 - DNA, 1250 bp, Pseudoroegneria spicata
  misc_feature (229)..(229): n is a, c, g, or t
  misc_feature (1194)..(1194): n is a, c, g, or t
gcccgatctcgagatcccacatcgcacgcaccgcggccgatccccggcaggcacccgaacccgatggcgacactcaaggtcccctcctccgtcccggccctcgccgacgactgcgacaacctccgcaaggccttccaagggtggggcacgaacgaggcgctcatcatctccatcctgggccaccgggacgccgcgcagcgccgcgccatccgcaagcactacgccgacncctacggcgaggagctgctccggagcatcaccgacgagatctcaggcgacttcgagagggccgtgatcctctggacgctggaccccgcggagcgggacgcggtgctcgccaacgagaccgccaagaagtggcaccccgggaaccccgtgctggtcgagatcgcgtgcgcgcgcggctccgcgcagctcttcgctgtcaggcaggcctaccatgaccgcttcaagcgctcgctcgaggaggacgtcgctgcccacgtcaccggcgacttccgcaagctgttggtgccacttgtaagctcataccgctatgagggaccagaggtcaacacaaggttggctcattctgaagccaaaatactccatgagaagatcgagcataaggcttacggtgatgatgagatcatcagaattctcaccactaggagcaaagctcagctgcttgcaacactcaaccattacaatgacacatttggtcacccaatcaccaaggatctgaaggctgaccccaaggatgagttcctcaaaacccttagggcggttatccgttgcttcacctgccctgataggtattttgagaaggttgccaggttggccattgcaggcaatggaacagatgagaactccctcactagggtcataacgacccgcgccgaggtggacctgaagctgatcaaagaggcgtatcagaaaagaaacagtgttcccctggagaaggccgtcgcaggcgacacctgcggcgactacgagatcatgctccttgccctcctgggcaaggagtaggccttgcccctgtatccacccctgttacacttttatatctcatcaatcggagaataaaccctggtatgcaaggccgttgtcacgctggttagatctgctgcaccttgcataacagtgagaataaaatagagagagatgtgatttacgatgagtcatgctggtacgttttgtacttagatgttcgcntgtgaaatgcagaggagatattaaaaagttgtgttttctgtaagcctgaaaatcca

SEQ ID NO: 1619 - DNA, 1228 bp, Leymus cinereus x Leymus triticoides
  misc_feature (6)..(6): n is a, c, g, or t
  misc_feature (8)..(8): n is a, c, g, or t
  misc_feature (1198)..(1198): n is a, c, g, or t
cgcccnanctcgagatcccgcctcccacatcgctccgcgtccgatcccggcaacacaccgatggcgacgctcaaggtcccctccaacgtcccggccctcgccgacgactgcgacaacctccgcaaggccttccaagggtggggcacgaacgaggcgctcatcatctccatcctcggccaccgcgacgcgtcgcagcgccgcgccatccgcaagcactacaacgacacctacggcgaggagctgctccggagcatcaccgacgagatctcaggcgacttcgagagggccgtgatcctgtggacgctggaccccgcggagcgggacgcggtgctcgccaacgaggccgccaagaagtggcaccccgggaaccctgtgctggtcgagatcgcgtgcgcgcgcggctccgcgcagctcttcgctgtcaggcaggcctaccatgaccgcttcaagcgctcgctcgaggaggacgtcgctgcccacgtcaccggcgacttccgcaagctgttggtgccacttgtaagctcataccgctatgagggaccagaggtcaacacaaggttggcacattcagaggccaaaatactgcatgagaagatcgagcataaggcttacggtgatgatgagatcatcagaattctcaccactaggagcaaagctcaactgcttgcaacactcaatcattacaatgacacatttggtcacccaatcaccaaggatctcaaggctgaccccaaagatgagttcctcaaaaccctgcgggctgttatccggtgcttcacctgccctgataggtactttgagaaggttgtcaggctggccattgcagggaatggaacagatgagaactccctcactagggtcataacaacccgtgccgaggtggacctgaagctgatcaaggaggcgtatcagaagagaaacagtgttcccctggagaaggcagtcacaggcgacacctccggtgactacgagagcatgctccttgccctcctggggaaggagtgagccttgcctctgtgtcctctcatgttaccctttttaagtgtatctcaatcggagaataaaccctggtgtgcaaggccgtactcacgctggttatgaccttgcataacagtgagaataaaatagagagagatgtgctttacgatgagtcatgcatggtaccttttgtacttggatgttcgcgtgtgaaataccnaggagatattaaaaagttgagttttctgga

SEQ ID NO: 1620 - DNA, 2201 bp, Panicum virgatum
aataagactcgatcccagtccagatcgtcgcagcagaggaatcccggggtcccggaccgactccatttccggccacgaggccaagatccatttcattccgcctttctttttcttggtgatctgatccagtcgcccccgttcgcgtccaatcctagcagcggcgcgtatcttcagccgttactgcgtacaatggcgctcaacctcgcgcaccagaccggcgcggcggcggccgtaacggcggccccggcggcgccgcgctcggcggtggtcgcggcggcctccaccgtcgcgccgtccgcgacggcgccctcgccggcgcccgcgctccaggcgcagacggtgacggtggacccggccccggcgcaggcggcggactcggtgaagccggacctggccatggtgtgccaggcgctggtggacggcaagccggaggcggagcacgcggacgtggccgccgaggtcaggagcaaggagggcgtgccggtgttcgtgatgatgccgctcgacacggtgcgcaaggacggcaacagcctgaaccggcggagggcggtggaggccagcctggcggcgctcaagagcgccggcgtcgagggcatcatggtggacgtgtggtggggtatcgccgaggccgagggccccgggcagtacaacttcaacggctacatggagctcatggagatggccaggaagaacgggctcaaggtgcaggccgtcatgtccttccaccagtgcggcggcaacgtcggcgactcagtcaccataccacttccgaaatgggttttggaggagatggacaaggaccaggacctggcctacaccgaccggagcgggcggcggaactacgagtacgtctcgctggggtgcgacgcgctgcccgtgctcaaggggcgcacccccatccagtgctacgccgacttcatgcgcgccttccgcgaccacttcgccacctacatgggcaacaccatcgtggagatccaggtcggcatgggccccgccggcgagctccgctacccgtcctacccggagagcaacggcacctggtgcttcccgggcatcggcgagttccagtgctacgacaggtacatgcttagcagcttgaaggcggcggctgaggccgtgggcaagccggagtggggcaacgccgggccgagcgactccggcagctacaagaactggcccgaggacacccccttcttccggcgcgagggcgggtggaacaccgagtacgggcagttcttcatgagctggtactcgcagatgctcctggagcacggcgagcgcatcctgtcggcggccaccggcgtgttcacggcctccccgggcgtcaagatctccgtcaaggtggccggcatccactggcactacggcacccgctcccacgcggcggagctgacggcggggtactacaacacccggcaccacgacgggtaccagccgatcgcgcgcatgctggggcgccacggcgccgtgctcaacttcacgtgcgtggagatgcgcgaccacgagcagccgcaggacgcgcagtgccggcccgaggggctggtgcagcaggtggccgcggcggcgcgggaggccggcatcgggctcgccggcgagaacgcgctgccccgctacgacgagacggcgcacgaccaggtggtggccacggcggccgagaaggccgaggaggaccggatggtggccttcacctacctccgcatgggccccgacctgttccagcccgacaactggcgccgcttcgccgccttcgtcaagcgcatgtccggcgccggcaagcgggacatgtgccgggagcaggtggagcgggaggcctccggagtcgcgcacgccacccagccgctcgtgcacgaggccgccgtcgcgctcaccaactagtggatccatcatccatccactactggatacgctactactactatgtacgatcgagtcgtaggctgctgcggcgccggccgtgccgtgtgcccgtgccggcgcgtgtaccgctcacaagggtgaagaagctgcgaggttaggggtggggtgactgggtaatgctggtacgtagttgccacgtttcaagcttggtggcagggagatacgatcgagtctgaagctctgctgctgcatgctacagttgatatcctactaaaaagtgtatggatatactactcatgatttgtactgctacgatttcacgaagaaagaaacaatactttctg

SEQ ID NO: 1621 - DNA, 2308 bp, Sorghum bicolor
taataaacatccgaatccccagtccagatcgccgtcacatcgcagcaggaggggagagtccccagggtcccggaccgaatccatttccagacaccaaggccaagcaagatccatccatctccctctctctctttcgctccagccagccatccttcctctttcttcgttcttggtgctctgatctcgtcgctcattcgagtccaatccgatccgatccgaccaaccaaccgctgtgaatgatggcgctcaacctggcccaccagaccggcgcggccgtgacggcggcaccgacggcgccacgctccgccgtcgtcgcggcggccgccaccgtgtcggcgccgtccgcgtcggcgtccgccgccccggcgcccgcgctccagatgcagacgatgacggtggacgcggcgcccgcgcaggcgccggacgccgtgaagccagacctcgccatggcgtgccaggcgctggtggaaggaagcacgcccgacgaggcgcagcacgccgacgtcgccgccgagctcaagaccaaggccggtgtgcccgtcttcgtgatgatgccgctcgacaccgtgcgtaaggacggcaactcgctcaaccgccggaaggccgtcgaggccagcctggcggcgctcaagagcgccggggtggaaggcatcatggtggacgtctggtggggcatcgccgaggctgatggccccgggcagtacaactttaacgggtacatggagctcatggagatggccaggaagaccgggctcaaggtccaggccgtcatgtccttccaccagtgcggcggcaacgtcggcgattcagtcaccataccacttccgagatgggttgtggaggagatggacaaggaccaggacctggcctacaccgaccggagcggccgccggaactacgagtacgtctccctcggctgcgacacgctgcccgtgctcaagggccgcacgcccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtccttccctggcatcggcgagttccagtgctatgacaggtacatgttgagtagcttgaaggcggctgctgagtcggtgggcaagccggagtggggcaacggtggtccgggcgacgccggcggctacaagaactggcctgaggacacgggcttcttccgtcgcgagggcgggtggagcaacgagtacgggcagttcttcatgagctggtactcgcagatgctcctggagcacggcgagcgcatcctgtcggcggcgacgggggtgtacacgggttcccccggcgtgaagatctcggtgaaggtggccgggatccactggcactacggcacccggtcgcacgcggcggagctgacggcggggtactacaacacccggcaccacgacgggtacgcgcccatcgcgcgcatgctggcgcgccacggcgccgtgctcaacttcacgtgcgtggagatgcgggaccacgagcagccgcaggacgcgcagtgcaggcccgaggcgctggtgcagcaggtggcggccgcggcgcgggaggccggcgtcgggctggcgggcgagaacgcgctgccgcgctacgacgagacggcgcacgaccaggtggtggccacggcggccgacagggccgccgaggaccgcatggtggcgttcacgtacctgcgcatggggcccgacctgttccagcccgacaactggcgccgcttcgccgccttcgtcaagcgcatgtcccagccgggcgcacgggacgcgtgccgggagcaggtggagcgcgaggccgacggcgtcgcgcacgccacccagccgctcgtgcacgaggccgccgtcgcgctcaccaactgacctcgatctgatgcgcgcggtggccggcgttcccaccctctttgcctgcccgtgttcactagtagacggtgttatgtacgctactctactacctcctcctcagtacctaatcatacataagctgtgcgcccgccggcgtgtcgtcgattggtgcgtgcgccgcgcaatagtgtacgtaaaagggatgctgcgaccgaggtaggggtcggtgactgggtacggggtacggtacacgttggaggctttggcgttggtcagagcttggcaggagatgggtttgatgttctgctgctgtgttactatcctacacgtacagaatcatgatttgtactgctataatttgaaacaaagaaacgaacttttcaaaacgtacctcg

SEQ ID NO: 1622 - DNA, 2064 bp, Sorghum bicolor
atggcgctcaacctggcccaccagaccggcgcggccgtgacggcggcaccgacggcgccacgctccgccgtcgtcgcggcggccgccaccgtgtcggcgccgtccgcgtcggcgtccgccgccccggcgcccgcgctccagatgcagacgatgacggtggacgcggcgcccgcgcaggcgccggacgccgtgaagccagacctcgccatggcgtgccaggcgctggtggaaggaagcacgcccgacgaggcgcagcacgccgacgtcgccgccgagctcaagaccaaggccggtgtgcccgtcttcgtgatgatgccgctcgacaccgtgcgtaaggacggcaactcgctcaaccgccggaaggccgtcgaggccagcctggcggcgctcaagagcgccggggtggaaggcatcatggtggacgtctggtggggcatcgccgaggctgatggccccgggcagtacaactttaacgggtacatggagctcatggagatggccaggaagaccgggctcaaggtccaggccgtcatgtccttccaccagtgcggcggcaacgtcggcgattcagtcaccataccacttccgagatgggttgtggaggagatggacaaggaccaggacctggcctacaccgaccggagcggccgccggaactacgagtacgtctccctcggctgcgacacgctgcccgtgctcaagggccgcacgcccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtccttccctggcatcggcgagttccagtgctatgacaggtacatgttgagtagcttgaaggcggctgctgagtcggtgggcaagccggagtggggcaacggtggtccgggcgacgccggcggctacaagaactggcctgaggacacgggcttcttccgtcgcgagggcgggtggagcaacgagtacgggcagttcttcatgagctggtactcgcagatgctcctggagcacggcgagcgcatcctgtcggcggcgacgggggtgtacacgggttcccccggcgtgaagatctcggtgaaggtggccgggatccactggcactacggcacccggtcgcacgcggcggagctgacggcggggtactacaacacccggcaccacgacgggtacgcgcccatcgcgcgcatgctggcgcgccacggcgccgtgctcaacttcacgtgcgtggagatgcgggaccacgagcagccgcaggacgcgcagtgcaggcccgaggcgctggtgcagcaggtggcggccgcggcgcgggaggccggcgtcgggctggcgggcgagaacgcgctgccgcgctacgacgagacggcgcacgaccaggtggtggccacggcggccgacagggccgccgaggaccgcatggtggcgttcacgtacctgcgcatggggcccgacctgttccagcccgacaactggcgccgcttcgccgccttcgtcaagcgcatgtcccagccgggcgcacgggacgcgtgccgggagcaggtggagcgcgaggccgacggcgtcgcgcacgccacccagccgctcgtgcacgaggccgccgtcgcgctcaccaactgacctcgatctgatgcgcgcggtggccggcgttcccaccctctttgcctgcccgtgttcactagtagacggtgttatgtacgctactctactacctcctcctcagtacctaatcatacataagctgtgcgcccgccggcgtgtcgtcgattggtgcgtgcgccgcgcaatagtgtacgtaaaagggatgctgcgaccgaggtaggggtcggtgactgggtacggggtacggtacacgttggaggctttggcgttggtcagagcttggcaggagatgggtttgatgttctgctgctgtgttactatcctacacgtacagaatcatgatttgtactgctataatttgaaacaaagaaacgaacttttcaaaacgta

SEQ ID NO: 1623 - DNA, 2299 bp, Zea mays
gcttcccccgtaataataaccgaatccccagaccaaatcgccgtcgccgtcgcatcgcagcagcgggagtcccagggtcccggaccgaatccatttccagacacccaaggccaagatccatcgctcgttccaaccagccttcttcttcttctgcttggtcgtctgatctcgttttccattcgtgtccaatccgatccagccaaccgctgtgaatgatggcgctcaacctgtcccaccagaccggcgcggccgtggcggcggcaccggcggcgccacgcgcggccgtcgtcgcggcggcggccacggcgccacgctcggccgtcgtcgccgcggcggccaccgtggcgccgccgcccgcgtcggcgcccgcccccgctccggcgctccagctgcagacgatgacggtggacccggcccccgcgcaggcgcccgacgcggtgaagccggacctcgccatggcgtgccaggcgctggtggaggccgcgcccgaggcggagcacgccgacgtggccgccgagctccggagcagggccggggtgcccgtcttcgtcatgatgccgctcgacaccgtgcgcaaggacggcaactcgctcaaccggcgcaaggccgtggaggccagcctggcggcgctcaagagcgccggggtggagggcatcatggtggacgtctggtggggcatcgccgaggccgacgggcccgggcagtacaacttcaacgggtacatggagctcatggagatggccaagaagaccgggctcaaggtccaggccgtcatgtccttccaccagtgcggcggcaacgtcggtgattcagtcaccataccacttccgggatgggtcttggaggagatggacaaggaccaggacctggcctacacggaccggagcggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaaggcggctgctgaggccgtgggcaagccggagtggggcaacgcgggtccgggcgactccggcagctacaaggactggccggaggacacgggcttcttccggcgcgagggcgggtggagcacggagtacggggagttcttcatgagctggtactcgcagatgctcctggagcacggcgagcgcatcctgtcggcggcgacgggcgtgttcacgggttcccccggcgtgaagatctcggtgaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccacggccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgatgactacctgtatggcgagtccctatacttactcatacataagctgcgccgccgtgtcgtcggtgcgtgcaccgcgcagtagtgtgcgtacagcggaagctgcgactgcgagcgaggtagggtgtggggtgggtgactggggtacggtacgtaggtgccacgttggaggctttggcgtttgctcagagcctggcaggagatgggtttgatgttctgctgctgtgttactgtatcctacacctacagaatgtgctatgatttgtactgctataatttttaacgaagatacaaacttctacaaaa

SEQ ID NO: 1624 - DNA, 2254 bp, Triticum aestivum
  misc_feature (521)..(521): n is a, c, g, or t
gcacgaggttccttcccttcggtcgaggaaggcagcagcaataaatctaggtccggagtcgactccgttcccacccattcccagaaccattccgaccggcgaacacattcaataaactccgttcgcccgtccggttctgtcgtcaccggtgatctgatctaagttgagcagcgtccgtcgtcgtcgtccaagctctccgtcgcacgcgcgcacgtgatccggcccagcccgtcgtcgtcgtcgtcgtccacatggccctcaacctgacccaccagaccggcgctgcggccatcgcggccacgccggcgccgggcgcgcgcgcttcggtgttcgcggcggcctcgcccgccgccgccgccgccgccggctccgccgtggcgccggcgcaggcgaccagcctgaggatgcagacgcagctggtggagcccgcgcagccgcaggcgccggagatgttccaggccatggcgcccgaccagcagcagcagggcgaggccgcgcacccggacgcgggcggcgaggangcacgcaaggtgggcgtgccggtgttcgtgatgatgccgctggacacggtgcgcaaggacggcagcgcgctgaaccggcgcaaggcggtgcaggcgtccctggcggcgctcaagagcgccggcacggccggcatcatggtggacgtgtggtggggcatcgccgagagcgagggccccggccagtacaacttcgccggctacatcgagctcatggagatggccaagaaggccgggctcaaggtgcaggccgtcatgtctttccaccagtgcggcggcaacgtcggagactcagtcaacataccacttccgaaatgggtgacggaggagatggaccaggaccaggacctggcgtacacggacaggtgcggccgccggaactacgagtacatctcgctgggcgccgacgcgctcccggcgctcaagggccgcacccccatccagtgctacgccgacttcatgcgcgccttccgcgaccacctcgcgccctacatgggcaacaccatctgcgagatccaggtcggcatgggccccgccggcgagctccgctacccctcctacccggagagcaacggcacctggtccttccccggcatcggcgagttccagtgctacgaccgctacatgcgcgccagcctcaaggccgccgccgaggcggtgggcaggcccgagtggggcaacgccggccccgaggactcgggcagctacaaccagtggccagaggacaccggcttcttccgccgcgagggcggctggaacaccgactacggccagttcttcatgagttggtactcgcagatgctgatcgagcacggcgagcggatactctccgcctgctcctccgtcttcacgggtacccctggggtcaaggtctccgtcaaggtggccggcatccactggcactacggcacccgctcccacgcgcccgagctcaccgccggctactacaacaccaggaaccacgacgggtacctgcccatcgcgcgcatgatcggtcgccacggcgccgtgctcaacttcacctgcgtcgagatgcgcaaccacgagcagccgcaggacgcgcagtgcatgcccgaggcgctcgtgagccaggtggccagcgccgccaaggaggccggagtgggcctcgccggggagaacgccctacccaggtacgacgagacggcgcacgaccaggtgctggccaccgcggcggagaaggctgaggaggaccgcatggtcgccttcacctaccttcgcatgggccccgacctcttccagcccgacaactggcgccgcttcgccgcgttcgtcaagcgcatgacggagaccggcgtcagggacgtgagccgggagcaggtggagcgcgaggctcagggcgtcgcccacgccacccagggcgtcatccaggaggccgccgtcgccctctgcaactaatcaactatgcattacatacatacgtaccgtgatgatcgaaggtgtgtaccgaatgaaggtgggaaggaaacgtagggggatcgatcgatcgatcgggtgacttgggagtagttgccgcgcctgaagcttcgatggcatggcgatgccggtttcggcgtcgctacctcaaagcttgcagaggactgatgtactactacgtactaagctgccgcagtagcatgttgcactgtaagatcgatactcgaaaatgttgtaacgccttgctgtatctgttccactaaagtgaaatgaagaacagagcttggcgagcaaaaaaaaaa

SEQ ID NO: 1625 - DNA, 2829 bp, Brachypodium distachyon
acagcctcacaaaccacgcaacccaagcaaacccacaaaaaacacgcgcacaaggagccccccttgtgtggatccttctcatccatataatccccgcagattcgctttgctggcttggcggagccaggatcgtcttccggctgccgaattcgtgctctgctgcttcgatttcccccccgcggcgcagggcggggccggggccctgcctctagcttggattattagcgcgcgctcctgttgcttggtgggttgttgtgcttgctcggagcttacgagttcgacgaattggcagtgggaggagcggatttgggcgttcaatttgtgttctgctgggttcgctgcccccattcggccgttttgtgagcgagattttggatttgagcggttttttgagctggtggttgttagtaagaggttggggaatccgcggcgaccatgtccgtgccgacgatggccgtctacaccagcccgccggggggattgtacgcgtcgtcggagcttgagacgagctcccgcggctccgcgccctgcgcgacagcggcgcccccgtcgcccgccagctcccaccgccactcctccttctccggcggcctctcctgcctcttctcctccccgaccgccgcgcctcgttcgtcggcgctcgacgagctcggcgcgctctggcacgacagatctgacgagccggccgtcgccggccggggcggcggctactcatgcccccagccgtcctcgtcgctcaagtggcgggaccacctccaccacagccccgtctcgctgttccacagcccggcctcctcgccagcttccaggagcccgtcggcgtcttggctcgccagccgcgagcgcgagcggctcttctccagcttcgtgcgcaacgcgcttggctcctgcgtcgactacgccccggtcacttccccggcgctgggcgtcaccgctgctgctggcgtcgacgctgctgagcttgccttcgagctcgacgagaacctgtcgggggcagagccgtcatgcgaaccttacgctagagacctcctcgccggcgcgcaggctcgccaccgcatcttccacgacgagctcgttgttaaggccttcttcgaggccgagaaggctcaccggggccagacacgggcgagtggtgatccttacttgcagcattgcgtagagactgccgtgcttctggccaaaataggtgcaaacgcaaccgtagtctctgccggactactgcatgacacaattgatgattctttcatggactacgatcatatcttcaggatgttcggcgctggcgtggctgatcttgttgaaggggtctctaaattaagccacttgagcaaacttgctcgggacaacaatactgcaagcagaactgttgaagcagatcgattgcatacaatgtttcttgcaatggctgatgcacgagctgttttgataaagctagcagatcgtctgcacaacatgaagacgatagaagctttgcctttcgtaaaacaacaaagatttgcgaaagagactatggaaatatttgtgccattggctaataggttaggaattgctagctggaaagaacagctggaaaatatttgcttcaagcacttgaatccagaggagcacaaagagctttcctcgaaacttgtgatatcttttgatgaagcacttcttacatcaactttagataaactagataaaggtctcagagatgaaggtatttcataccacagtgtttctgggaggcacaagagtctgtacagtatatactccaagatgataaagaagaacttaacaatggacgatgtgcatgacatccatggtctgcgacttgtggttgagacagagaaagattgctatcgagctcttgacattgttcataaactgtggcctggagtatcgggaagattcaaggactatatattgcatccaaaagtgaatggatatcggtcattgcacaccgttatcttgtgtgagggtgtccacccatttgaagtgcagatccgcaccaaagaaatgcatctacaagcagagtttggatttgcagcacattggagatataaagaaggtggctgcaggcatgcctttgtactccaaatggtggaatgggcaagatgggtgctaacatggcaatgtgaagcaatgagcaaagagcggccctctggtctagtcagctctgattccgtcaagtcgtcatgccctttccccttgcattcagaggagtgcccttattcttacacccgccagtgcaaccatgatggtcccatatttgtgatcatgctcgaacacgataagatgtcggtgcaagagctccctgcaaactcaaccatagtcaatctgatggagcgagtcagcgcgagtagtccaagatggagcccttacagcttcccactgaaagaagagctgcggccaagggttaatcaccagcccataagtgatcctaacagaacgctgtgcatgggcgacgtggtggagctgacccctgccctcccgcacaagtcactaaccgagtacagggaagagatccagcgcatgtatgagcgaggtgggttcgccctcgccaccacccgtggcgcccctgcaagctgacagtgcagggaatacaatgctgattaacctgttgttgtaaatgtacactgcccttgatctccacttgtaaatatgaactaattctcgcagcagagagaaaatcccagtgagcattcccaactgaactgtcaaagctgtgcaacgtgttcttctggtcgaaaaggctgttgtacatgacacttcacaagttgatgaaatttgttgaagatactcatgttgagaaagctgagagtaatctgagtatatttacagttcatc

SEQ ID NO: 1626 - DNA, 2530 bp, Brachypodium distachyon
aaaacacgcgcacaaggagccccccttgtgtggatccttctcatccatataatccccgcagattcgctttgctggcttggcggagccaggatcgtcttccggctgccgaattcgtgctctgctgcttcgatttcccccccgcggcgcagggcggggccggggccctgcctctagcttggattattagcgcgcgctcctgttgcttggtgggttgttgtgcttgctcggagcttacgagttcgacgaattggcagtgggaggagcggatttgggcgttcaatttgtgttctgctgggttcgctgcccccattcggccgttttgtgagcgagattttggatttgagcggttttttgagctggtggttgttagtaagaggttggggaatccgcggcgaccatgtccgtgccgacgatggccgtctacaccagcccgccggggggattgtacgcgtcgtcggagcttgagacgagctcccgcggctccgcgccctgcgcgacagcggcgcccccgtcgcccgccagctcccaccgccactcctccttctccggcggcctctcctgcctcttctcctccccgaccgccgcgcctcgttcgtcggcgctcgacgagctcggcgcgctctggcacgacagatctgacgagccggcgtcgccggccggggcggcggctactcatgcccccagccgtcctcgtcgctcaagtggcgggaccacctccaccacagccccgtctcgctgttccacagcccggcctcctcgccagcttccaggagcccgtcggcgtcttggctcgccagcccgcgagcgcgagcggctcttctccagcttcgtgcgcaacgcgcttggctcctgcgtcgactacgccccggtcacttccccggcgctgggcgtcaccgctgctgctggcgtcgacgctgctgagcttgccttcgagctcgacgagaacctgtcgggggcagagccgtcatgcgaaccttacgctagagacctcctcgccggcgcgcaggctcgccaccgcatcttccacgacgagctcgttgttaaggccttcttcgaggccgagaaggctcaccggggccagacacgggcgagtggtgatccttacttgcagcattgcgtagagactgccgtgcttctggccaaaataggtgcaaacgcaaccgtagtctctgccggactactgcatgacacaattgatgattctttcatggactacgatcatatcttcaggatgttcggcgctggcgtggctgatcttgttgaaggggtctctaaattaagccacttgagcaaacttgctcgggacaacaatactgcaagcagaactgttgaagcagatcgattgcatacaatgtttcttgcaatggctgatgcacgagctgttttgataaagctagcagatcgtctgcacaacatgaagacgatagaagctttgcctttcgtaaaacaacaaagatttgcgaaagagactatggaaatatttgtgccattggctaataggttaggaattgctagctggaaagaacagctggaaaatatttgcttcaagcacttgaatccagaggagcacaaagagctttcctcgaaacttgtgatatcttttgatgaagcacttcttacatcaactttagataaactagataaaggtctcagagatgaaggtatttcataccacagtgtttctgggaggcacaagagtctgtacagtatatactccaagatgataaagaagaacttaacaatggacgatgtgcatgacatccatggtctgcgacttgtggttgagacagagaaagattgctatcgagctcttgacattgttcataaactgtggcctggagtatcgggaagattcaaggactatatattgcatccaaaagtgaatggatatcggtcattgcacaccgttatcttgtgtgagggtgtccacccatttgaagtgcagatccgcaccaaagaaatgcatctacaagcagagtttggatttgcagcacattggagatataaagaaggtggctgcaggcatgcctttgtactccaaatggtggaatgggcaagatgggtgctaacatggcaatgtgaagcaatgagcaaagagcggccctctggtctagtcagctctgattccgtcaagtcgtcatgccctttccccttgcattcagaggagtgcccttattcttacacccgccagtgcaaccatgatggtcccatatttgtgatcatgctcgaacacgataagatgtcggtgcaagagctccctgcaaactcaaccatagtcaatctgatggagcgagtcagcgcgagtagtccaagatggagcccttacagcttcccactgaaagaagagctgcggccaagggttaatcaccagcccataagtgatcctaacagaacgctgtgcatgggcgacgtggtggagctgacccctgccctcccgcacaagtcactaaccgagtacagggaagagatccagcgcatgtatgagcgaggtgggttcgccctcgccaccacccgtggcgcccctgcaagc

SEQ ID NO: 1627 - DNA, 753 bp, Brachypodium distachyon
cgtcctacgagcgagcgagcgagcggctgatcaatcctgtcaagatgcagatcttcgtcaagaccctgaccggaaagaccatcacgctggaggtcgagagcagcgacaccatcgacaacatcaaggccaaaatccaggacagggaaggcatccctccggaccagcagcgcctcatcttcgcggggaagcagcttgaggacgggcgcaccctggcggactacaatatccagaaggagtcgacgctgcacctggtgcttcgcctccgcggcggaagcaggggccactacatcatcaaggagcccagcctgctgcagctcgcgctcaagtacaacgagaagaagatggtctgccgcaagtgctatgcacgccttcccttcagggctaccaactgccgcaagaagaagtgcggccacaccgaccagatcaggctgaagaagaagtttatcaaccaactgtctatgtgaagatgtatcggttggaaacacaagggggagtcgtcgtcatcgtggtccgcgcgcggccgaacaagttcttctgattccgagtctgttttttcccttaatcatcaagttctaactagcacacatgcatggttctggatgtgggtctattgaaactctatcagtactggagtagttgttattttgtttcgaaaacccctttaccactttttaccacttcttatgaatatgaattgtgaagggatcgaccatggagttttaagggatctatggccccaactttttatgtgtc

SEQ ID NO: 1628 - DNA, 795 bp, Oryza sativa
atatccacattaccgcctccatttttgcaccggccgccactaatctgcgggagagagcgttcgttcgttcgccggcgagagggagagtggcaagatgcagatcttcgtgaagacgctcaccgggaagacgatcacgctggaggtggagagcagcgacaccatcgacaacgtcaaggccaagatccaggacaaggaaggtatcccgccggaccagcagcgtctcatcttcgcggggaagcagctcgaggatggccgcaccctggccgactacaacattcagaaggagtcgacgcttcacctggtgctccgcctccgcggtggcagcaggggcggctaccccaaggggatcgagcccaacctccgcgagctcgcgcagaagtacaacgagaacaagctggtttgccgcaggtgctatgcacgccttcccctcaggtccaccaactgccgcaagaagaagtgtggccacagcaatgagataagggcaaagaagaggtttatgtccaagctttcgaagtgaaccactggaaagctccgtcgtggatcagttcaatcgaccgccttgcagcttttataccttcttattagttactttgtctcttcatggagagatgcttatgagattttgctttcaagtttctgttactggattttggacaaatctctatgaataaagttttggtataaaattttatttactgcccagctaaattcttttgggcttatgtgaacgagcatccatacttatcatgttgaaagtatgtattcttaaattaacaatggaataacaattagtat

SEQ ID NO: 1629 - DNA, 821 bp, Hordeum vulgare
agagtgggtgagggggggaagaaaagagcagatcttcgtcaagaccctcaccgggaagacaatcacgctcgaggtcgagagcagcgacaccatcgacaatgtcaaggccaagatccaggacaaggaaggcatccctccggatcagcagcgtctgatcttcgcggggaaggagctggaggacgggcgcacgctggccgactacaacatccagaaggagtcgacgctgcacctggtgctccgtctccggggcggcagccggggccagtacatcatcctcgaccccaacctgctgcaactcgcgctcaagtacagggagaagaagatgatctgccgcaagtgctacgcgcgcctcccccacggctccagcaactgccgcaagaagaagtgcggccacagcaacgagctcaggaagaagaagaggttcatcgacaagaccaccatgatctgaagaaagaaagcacaagatagatttcgttccatattatattagctagcttatgtacagtacgtgctatagcaagactttttttgtggtgacaagactatttgtctaaagtattggagcttttatagtgaatgagggcagggtaatgtaggcaccgaaaaagaaaagaaagtaaaacttcaggggggggccggagacccattttaccgtggaggggggtgaagtgcagtgggatggggggggggttaaagggtcggaagtggggaagccgtggggttcacggagtggaagggcttgggggcgacgccgatatggccggcgaggtgtaaggcgaaggagcccgcgcccttaatccctgacagaatatcgccaccct

SEQ ID NO: 1630 - DNA, 696 bp, Triticum aestivum
ttacccacgacgatcatcaaacgactgaagcgagggagcggttgatcgatcaaccctgcaagatgcagatcttcctcaagaccctgaccgggaagacgatcacgctcgaggtcgagagcagcgacaccatcgacaacgtcaaggccaagattcaggacaaggaaggcatccctccggaccagcagcggctcatcttcgcggagaagcagctggaagaggggcgcaccctggccaactacaacatccagaaggagtcgacgctgcacctggtgctccgcctccgcggcggcaccaggggaggctacctaaacgtggagccaaatctcctgcagctcgcgctcaagtacaacgagaagaagatggtctgccgcaagtgctacgctcggcttcccctgaggtcaaccaactgccgcaagaagaagtgcggccacagcaaccagatcaggcccaagaagaggttcatcaacaagctttcgaactgaagatcgaatcggtaggggagagagaagggaaggaccgtctgtgaataaattgtttcattcggtttatcaagttgctttagtgattttgaataaaaagggtgatatgttctagctagctagtctgaagtttcaagccatgcaagggttacttaagagttggatgcatgtattacccacatattctgttggtttttcttttctttccttttttttt

SEQ ID NO: 1631 - DNA, 853 bp, Hordeum vulgare
agtcgatgcggtgggccaagaaaagagcagatcttcgtcaagaccctcaccgggaagacaatcacgctcgaggtcgagagcagcgacaccatcgacaatgtcaaggccaagatccaggacaaggaaggcatccctccggatcagcagcgtctgatcttcgccgggaagcagctggaggacgggcgcacgctggccgactacaacatccagaaggagtcgacgctgcacctggtgctccgtctccggggcggcagccggggccagtacatcatcctcgaccccaacctgctgcaactcgcgctcaagtacagggagaagaagatgatctgccgcaagtgctacgcgcgcctcccccacggctccagcaactgccgcaagaagaagtgcggccacagcaacgagcttccgaagaaaaacaggttcatcgaccagaccaccatgatctgaagaaagaagcgcaagatagatttcgttccatatatatattagcgtggcttattacggtacggttctataacaagacttttttttttgtggaccagacgttttgtctaaagtcttggaacttttatggtttataatggcaggataaagtgggcccaaaaagtaacctccaaaaggagaacgcgagggggggcccagatgccctatttcgcccctattgaggagggtaaatgttgtgaggggggcagtgtggcccctgctcaggggtgggaaagccttggtggcttcggattgaagaaggggaggtgcgcgctcgccttttgatgtggggtggtgtgcgaagaagtgcccgacgaaaggatcttccgagagtttgcgataccacttagccgctggggcggtggccgtg

SEQ ID NO: 1632 - DNA, 551 bp, Hordeum vulgare
aagaaaagagcagatcttcgtcaagaccctcaccgggaagacaatcacgctcgaggtcgagagcagcgacaccatcgacaatgtcaaggccaagatccaggacaaggaaggcatccctccggatcagcagcgtctgatcttcgcggggaaggagctggaggacgggcgcaccctggccgactacaacatccagaaagagtcgacgctgcacctggtgctccgtctccggggcggcagccggggccagtacatcatcctcgaccccaacctgctgcaactcgcgctcaagtacagggagaagaagatgatctgccggaagtgctacgcgcgcctcccccacgggtccagcaactgccgcaagaagaagtgcggccacagcaacgagctcaggaagaaaaagaggttcatcgacaagaccaccatgatctgaagaaagaagcacaagatagatttcgttccatattatattagctagcttattacagtacgtgctataacaagactttttttgtggtgacaagacgatttgtctaaagtattggaacttttat

SEQ ID NO: 1633 - DNA, 881 bp, Brachypodium distachyon
cgatcgaaggcgaggagggaagatgcagatcttcgtcaagacgctgacggggaagacgatcacgctggaggtcgagagcagggacaccatcgacagcgtcaaggcaaagatccaggacaaggaaggtatccccccagaccagcagcgtctcatcttcgcagggaagcagctggacgatggccgcactctggccgactacaacatccagaaggagtccacgcttcacctggtgctgcgtctccgcgctaagatgcagatcttcgtgaagacactgacggggaagacgatcacgctcgaggttgagagcagcgacaccatcgacaacgtcaaggccaagatccatgacaaggaaggtatccccccggaccagcagcgtctcatctttgcggggaagcagctggaggatggccgcaccctggccgactacaacatccagaaggagtccacgcttcacctagtactgcgcctccgtggcggcagcagaggccagtaccccaagaacctcgagcccaatctccgcatccttgctcagaaatacaatgagaacaagatggtctgccgcaagtgctatgcacgcctccccctcagagcgacccactgccgcaagaagaagtgtggccacagcaaccagctgagggaaaagaagaggtttatgtccaagtttgggtcggacagctgaatcaactttcgtggcaagcatcatatcagagtacttatcatcagagtttaagcagtcgtgtcctagctagctagttaatttaccttttcaaatactagtggtttatgcatagatgtggcgtggttatgaaatggtggtgcaagtcccctacccagtattgtacattgaaccttttcatcgatgaagaaaagataataatgct

SEQ ID NO: 1634 - DNA, 572 bp, Sorghum bicolor
gggcagcaaattaaagatgcagatcttcgtgaagacgctgacggggaagacgatcacgctggaggtggagagcagcgacaccatcgacaacgtgaaggcaaagatccaggacaaggaaggcatcccgccggaccagcagcggctgatcttcgccgggaagcagctggacgacggccgcaccctggccgactacaacatccagaaggagtcgacgctgcacctggtgctgcgcctccgcggcggcagcaggggcggctaccccacgaccatctcgcccagcctccgcgagctcgcgcagaagtacaacgagaacaagatggtctgccgcaagtgctatgcacggcttccgcccagggcaaccaactgccgcaagaagaagtgtggccacaccaacgcgctgaggtcaaagaagaggttcatgtctaagattggtggaacaaataaatgagcgttggagagccttgtcatgcatcagttaggaattttgggatgctattttactttcctttgctttttatgaataaagttgtggtaggagaaagtgtgctactcttggttaataagatgttttt

SEQ ID NO: 1635 - DNA, 592 bp, Triticum aestivum
atcacgacacatcacgtacgcggatcctacctcttgggcgagagctcgctcgcggttggtcgttccggcgagatgcagatcttcgtgaagaccttgacggggaagaccatcaccctcgaggtcgagagcagcgacaccatcgacaatgtcaaggccaaaatccaggacaaggaagggatcccgccggtgcagcagcggctgatcttcgccgggaagcagctggacgagggccgcacgctggccgactacaacgtccagaaggagtcgacgctccacctggtgctgcgcctccgtggcggcagccgcggcggccgccccacctctatcccgcccaacctcctgcagctcgcgctcaagcacaacgagaagaggatggtctgccgcaagtgctacgcgcgccttccccccagggctaccaactgccgcaagaagaagtgcggccacaccaacgagctgaggcccaagaagaagtttgtttgagcagcgagcgagcgagcaattctgcttcgtcggctattctttcgttgggcgtcgtccggcatggactagctgaataaatcgtcttagcatcgtgtccgtgtcagggttttaa

SEQ ID NO: 1636 - DNA, 702 bp, Oryza sativa
ccgatatcgaattagccaaaagtttgttagtaccactgccttgcgagatccacgtctctgcaagatgcagatcttcgtgaagaccctgacggggaagaccatcaccctcgaggtcgagagcagcgacaccatcgacaatgtcaaggccaagatccaggacaaggaagggatcccgccggaccagcagcggctgatcttcgccgggaagcagctggaggacggccggacgctggccgactacaacatccagaaggagtcgacgctgcacctcgtgcttcgcctccgcggcggcggccgcccgggctacccgatgatcgagcccaacctcctcgccctcgcccgcagcaagatggagaagaagatgatctgccgcaagtgctacgcgcgccttccctacaaggctaccaactgtcgcaagaagaaatgcggccacaccaacgagctgaggccaaagaagaagctggtatccaagctttctgtttgagaccacaatttgccattgctaagcttgcatgcagactcattgttctatatatggggacgtatcgcgtatcgtcatgcatagccgaataactaaattatttattatctagtaatttagtaccgtatctgtgttatttgaggtttttgttaagtctgaagcccctgctgaatgctgaactattattattattattattattattattattattattatta

SEQ ID NO: 1637 - DNA, 1519 bp, Panicum virgatum
accaaatcctgcgcgtccgtactcctgcttcccctccgaccacggcggcgctgctctccgcaggtcggaagatgttggatcttccgctacaaatccaggcattgacgataaagtttagtttctctttctgttaagtttcaatatttcattcacagtttggcgagttgttatttccccccccccccccaaatttaagcagctgctgttttgaaggtttcttctccgggaaaaattcaaatcccggaaccgactggggttgcagtacccgcagatgctgctaactatcaagttcccggacctataaattactcgacttgtgatttcgtttgttaaatcctagctattgcgttcgacgtgcctgtgatttctgacccgtgatgaattggaaccgcagaaatctctaggagacgaatcgaatcgagcaggttaccaggtagcggaggaaccaggcggccatggctgagcacctggcgtccatctttggcacggagaaggaccgcgtgaactgccccttctacttcaagatcggcgcgtgccggcacggcgaccggtgctcccgcctgcacaacaagccgtccatctcgccgacgctgctgctctgcaacatgtaccagcgcccggacatgatcaccccgggcgtggacgcgcagggcaaccccatcgacccggagcggatccaggaggacttcgaggacttctacgaggacatcttcgaggagctcagcaagcacggcgagatcgagagcctccacgtctgcgacaacctcgccgaccacatgatcggcaacgtctatgtgcagttccgcgaggaggagcaggccgcccgcgcgctgcaggcgctgcagggccgctactactcgggccgccccatcatcgccgagttctcgccggtcaccgacttccgggaggccacctgccgccagttcgaggagcacagctgcaaccgcggcgggtactgcaacttcatgcacgtcaagcaggtcggccgggacctgcggcggaagctgttcggccacctgcaccggacccgccggagccgcagccggagcagccgcagcccgagcccgtaccgctaccgccggagctcgtcgcggtcgagggaccgcgacgacgactacgactactactaccactaccgtagtggcagtggcagccggaggagcagcgagaggcaccgcagccacgacagcgacgggagccgccgccggcgcgggcggtcgaggagccggagcccggtgagggaaggcagcgaggagcggagggcgcggatcgagcagtggaatcgcgagagggaggccgcgcaggtgtgagcagagcagctgctgtgggcatgccaggctgcagtttaccgcagtgatggtgttcgcttggtttgtgaaaatttcatcttgtactagtagttagtcatgtcgtaaattgaactcaaaattcgggggttttaattgttaccaaattgaacctgtggttgttattgaacttgctctggatgtatcgatagaacctaattgcttgtttcagt

SEQ ID NO: 1638 - DNA, 1513 bp, Zea mays
gaagcatccaggcatccagcaaatccagcgggtccgtactcatctgcttcacctccgggctccggctacggcggcactcttctctggcaaccggtcggaagatgttggatcttccgcttcaaatcgacgcataaaggatgcagattagttttgttcgcgtcaaatttattttgctcggtgtagttctgtccattaattaattatttgtactggatttaaggtgctgctattttgaaggttttttctcccggaaattttcacatcccgaaacgactggaaattgaagtagccatttgatgctgttacctgggttcataagttgttagacttgttgttatttgtttgttaatcctatagctattgcatattgtgtgcctgatcaggaccacagaaacctctaggcgacgaatcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcaggcggcccgcgccctgcaggcgctgcagggccgctactactcgggccgacccatcatcgccgagttctcgccggtgacggacttccgggaggccacctgccgccagttcgaggagcacagctgcaaccgcggcggatactgcaactttatgcacgtcaagcaggtcggccgggacctgcggcggaagctgtttggccacctgcatcgctccctccggagccacagccgaggcagccgcagcccgagcccataccgccgccgcggtagctcgtccaggtccagggaccgcgacgattaccacgactactactaccactactaccgtagtggcagtggcagccgcaggagcagcgagagacaccgcagccacgacagcgacgggagccgccgtcgacgcgggcggtcgaggagccggagccggagcccggtgagggaaggcagcgaggagcggagggcaaagattgagcagtggaaccgcgagcgggaggcagctcaggtgtaagcaagttccccttccctagttgccatgttggttgctgcagtgttattggccttgctagttgccatgttgctgttgctgaagcctgttatcatgtattgtggtgtggttcaggcagggtaaggccataaattgagcctgaaattggactgtgatctcttttgctgtggacgggttaccattaaacttgatttggatgtgctgatggaatct

SEQ ID NO: 1639 - DNA, 1550 bp, Panicum virgatum
accaaatcctgcgcgtccgtactctgcttcccctccggccacggcggcgctgctctccggtcggaagatgttggatcttccgctacaaatccaagcattgaggataaagattagtttccctttctgttaaatttctctcacagtttggcgagctgttaatttccccccaaatttaagcagctgctgttttgaaggtttcttctccgggaaaaaaatttcaaatcccgaaaccgaccgaggttgcagtagccgcagatgctgctacccatcaagttcccgggcccataaattatactcgacttgtgatttcgtttgtcaatcctagctattgcattctgcgtgcatgtggtttctgacccgtgaattggaaccgcagaaatctctaggcgacgaatcgaatcgaatcgagcaggtaccaggtagaggaggaaccaggcggccatggctgagcacctggcgtccatctttggcacggagaaggaccgcgtgaactgccccttctacttcaagatcggcgcgtgccggcacggcgaccggtgctcccgcctgcacaacaagccgtccatctcgccgacgctgctgctctgcaacatgtaccagcgcccggacatgatcaccccgggcgtggacgcgcagggcaaccccatcgacccggagcggatccaggaggacttcgaggacttctacgaggacatcttcgaggagctgagcaagcacggcgagatcgatagcctccacgtctgcgacaacctcgccgaccacatgatcgggaacgtgtacgtgcagttccgcgaggaggagcaggccgcccgcgcgctgcaggggctgcagggccgctactactcgggccgccccatcatcgccgagttctcaccggtcacggacttccgggaggccacctgccgccagttcgaggagcacagctgcaaccgcggcggctactgcaacttcatgcacgtgaagcaggtcggccgggacctgcggcggaagctgttcggccacctgcaccggtcccgccggagccacagccggagcagccgcagcccgagcccgtaccgccaccgccggagctcgtcgcggtcgagggaccgcgacgacgactacgactactactaccactaccgtagtggcagtggcagccggaggagcagcgagaggcaccgcagccacgacaacgacgggagccgccgccggcgcgggcggtcgaggagccggagcccggtgagggaaggcagcgaggagcggagggcgcggatcgagcagtggaaccgcgagagggaggccgcgcaggtgtgagcagagcagctgctgtggctatgctcggctgcagttcgccgcagtgatgatgtccgcttggttagtttgcaaggtcgctgaaaatttcatcttgtactagtagttagtcaggatcatgtcgtaaattgaactcaaaattcgggggtttcaattgtgaccatagtgtacttgtggttgtcattgaacttgctctggatgtatcgatggaacctaatttccagtttcagtatgagcttgtgctgatgatcggtgct

SEQ ID NO: 1640 - DNA, 1164 bp, Brachypodium distachyon
gagatctctagcttttctgtccagtcgccgccatggccgagcacctggcctcaatcttcggcacggagaaggaccgcgtgaactgcccgttctacttcaagatcggcgcgtgccggcacggcgaccgctgctcccgcctgcacaacaaaccgtccgtctcgccgacgctgctgctgtgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgtggtagagagcctgcacgtctgcgacaacctcgccgaccacctgatcggcaacgtgtacgtgcagttcagggaggaggaccaggccgccagggccctgcaggcgctgcaggggcgcttctactcgggccgccccatcattgctgagttctcgccggtcaccgacttccgggaggccacctgccggcaatttgaggagcacaattgcaaccgtggagggtactgcaacttcatgcatgtgaaggagatcggcagggatctgaggaagaggctgtatgggcacctgcatcgttccaggagaagccacagcaggagccccagcccgtaccatcgccacccgagggaccgtgatcgcaggagctcatcgcggtccagggacaaccgtggcggcgactactacggtggcagcctggaccgtggcgactacggggactactaccaccacagcaggaggaggagcagcgagaggcaccgcaactacgacagtgacgatgggagcaggcgacgccggcacaggagccggactaggagccccgtcagagagggcagcgaggagcggagggcaaagatcgagcagtggaatcgcgagagggaggcggcgcaagcttgagtcggtcttgtctcatttcaggttgcattgttcagttcaccggacgccttggttcttactgtgtgagcttgtactggtagatgaagttagaatgtgggcttagtggatttactggggtgtctaatgtgacatcttcactcttcagaatcttcagtgtgatccttactgaactacctttggatgtcttgttggaaccaattttcctactcggtgatcaaattgtgaatgttcttgagcttggtgc

SEQ ID NO: 1641 - DNA, 1013 bp, Brachypodium distachyon
tatcaagttctttccccttcttgaatgaattatctggcacgctcttagtttaatcctggctgcaattccttttgtgtaccttctgattcgtgttgtgggactgcagagatctctagcttttctgtccagtcgccgccatggccgagcacctggcctcaatcttcggcacggagaaggaccgcgtgaactgcccgttctacttcaagatcggcgcgtgccggcacggcgaccgctgctcccgcctgcacaacaaaccgtccgtctcgccgacgctgctgctgtgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgtggtagagagcctgcacgtctgcgacaacctcgccgaccacctgatcggcaacgtgtacgtgcagttcagggaggaggaccaggccgccagggccctgcaggcgctgcaggggcgcttctactcgggccgccccatcattgctgagttctcgccggtcaccgacttccgggaggccacctgccggcaatttgaggagcacaattgcaaccgtggagggtactgcaacttcatgcatgtgaaggagatcggcagggatctgaggaagaggctgtatgggcacctgcatcgttccaggagaagccacagcaggagccccagcccgtaccatcgccacccgagggaccgtgatcgcaggagctcatcgcggtccagggacaaccgtggcggcgactactacggtggcagcctggaccgtggcgactacggggactactaccaccacagcaggaggaggagcagcgagaggcaccgcaactacgacagtgacgatgggagcaggcgacgccggcacaggagccggactaggagccccgtcagagagggcagcgaggagcggagggcaaagatcgagcagtggaatcgcgagagggaggcg

SEQ ID NO: 1642 - DNA, 1455 bp, Cenchrus ciliaris
  misc_feature (759)..(759): n is a, c, g, or t
  misc_feature (908)..(908): n is a, c, g, or t
  misc_feature (920)..(920): n is a, c, g, or t
  misc_feature (993)..(993): n is a, c, g, or t
  misc_feature (1138)..(1138): n is a, c, g, or t
  misc_feature (1174)..(1174): n is a, c, g, or t
  misc_feature (1303)..(1303): n is a, c, g, or t
  misc_feature (1306)..(1306): n is a, c, g, or t
  misc_feature (1396)..(1396): n is a, c, g, or t
  misc_feature (1411)..(1411): n is a, c, g, or t
gcgtactctgcttcccttccgaccacggcggcgccgctctccgttatcaggtcggaagatgttggatcttccgctacaaattcaagcattgaggataaagattagtttcctttctgttaaatttctttcactgttaagctacttgttaatttcccctcaaatttaagcggatgctgttttgaaggtttattctccgagaaaaattcagatcccgaaaccgactgggattgcagtagccactgatgctgttatctgtcaagttctccaactcctacaattatagtcgatttgttatttgtctgctaataatccttgctaattgcgtcctgtgtgcgccttgaatttctgaacctgcagaaatttccaggcgacgaatcaaatcgagcaggtagaggaggaatcaggcggccatggctgagcacctggcttccatctttggcacggagaaggaccgcgtgaactgccccttctacttcaagatcggcgcgtgccggcacggcgaccggtgctcccgcgtgcacaacaagccgtccatctcgccgacgctgctgctctgcaacatgtaccagcgcccggacatgatcaccccgggcgtggacgcgcagggcaaccccatcgacccggagcagatccaggaggacttcgaggatttctacgaggatatcttcgaggagctgagcaagcacggcgagatcgagagcctccacgtctgcgacaacctcgccgaccacatgattgggaacgtgtacgtgcagttcngggaggaggagcaggcggcgcgcgcgctgcaggcgctgcagggacgctactactcgggccgccccatcatcgccgagttctcgccggtgacggacttccgggaggccacctgccgccagttcgaggagcacagctgcaaccgcggcggntactgcaacttnatgcacgtgaagcagatcgggagggacctgcggcggaagctgttcggccacctgcacaggtaccgccggagcnacagccggagcagccgcagcccgagcccgtaccgccaccgccggagctcgtccaggtccagggaccgcgacgacgactacgactactactaccagtaccgtagtggcagtgccagccggaggagcagcgagaggcaccgcagccncgacagcgacgggagccgccgccggcgcgggcggtntaggagccggagcccagtgagggagggcagcgaggagaggagggcgcggatcgagcagtggaaccgcgagagggaggccgcgcaggtgtgaccgtgtgaagcagagctgtggttgctgacactgtcatnttntgctggtagttagtgaggaccaggtcgtaattgaattcagaaattcgtgtaatcgtgaccaaattgaacttgctgttgttgctgaactcnttttggatgtatttntggaacccagttgcatgtttgattatgagcttgggcgatgatga

SEQ ID NO: 1643 - DNA, 1075 bp, Pseudoroegneria spicata
cgggggcgccgccatggccgagcacctcgcgtcaatcttcggcaccgagaaggaccgcgtgaactgcccgttctacttcaagataggcgcgtgccggcatggcgaccgctgctcccgcctgcacaacaagccgtccgtctcgccgacgcttctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaaccttgccgaccacctgattggcaacgtgtacgtgcagttcagggaggaggaccaggccgccaaggccctccaggcgctgcaggggaggttctactcgggccgccccatcattgctgagttctcgccggtcaccgacttccgggaggccacctgccggcagttcgaggagcacaattgcaaccgtggagggtactgcaacttcatgcatgtcaaggagattggcagggacctgaggaagaggctgtatgggcacctgcataggtccaggaggagccacagcaggagcagccggagcctgagcccctaccgtcaccacgccagggaccatgatcgctcctcacggtctagggaccgcggcgactattatggaggcagcttggaccgtggagactacggcgactactaccaccatagccggaggagcagtgagaggaaccgcaactatgacagtgatgggagcaggcggcgccggcgacacaggtctaggactaggagccctgtcagagagggcagcgaggagaggagggcgaagatcgagcagtggaaccgcgaaagggagatggcgcaggcctgagatctccggtctgtctgcaggttgcagtgttgccttgttcaccggatgttctgcttgcttgtctgatcttgtaatggtggatggagttagaatgtggtctttagtgaacttactcagatgcctgatgtaacattttcagtgtggttcttgttgaactttctcttcggatgtgttgatgga

SEQ ID NO: 1644 - DNA, 1485 bp, Sorghum bicolor
atccaccaaatccagccagtccgtactcggctgcttctcctccggcccgtgcctacggcggcgctgctctctggtaaccggtcggaagatgttggatcttccgctacaaatcgacgcataaaggatacagattagtttaatttacgtcaaatttatttcactccgtgtagttctgtacgttgatttattaatttcgcctggatttaagctgctgctattttgaaggtttcttctcttctccgggaaaatttcagatcccggaaacaactggaattgaagtagccactgatgctgttgccgtgttcttgagctcataaattgctatttgttaatgctcaaattgtgtgcctgaccacagaaatctctaggcgacgaatcgagcaggtagaggaggaatcaggcatccatggctgagcatcttgcgtccatctttggcacggagaaggaccgcgtgaactgccccttctacttcaagatcggcgcgtgccgccacggcgaccggtgctcccgcctgcacaacaagccgtccatctccccgacgctgctgctgtgcaacatgtaccagcggccggacatgatcaccccgggcgtggacgcgcaggggaaccccatcgacccggagcggatccaggaggacttcgaggacttctacgaggacatcttcgaggagctgagcaagcacggcgagatcgagagcctccacgtgtgcgacaacctcgcggaccacatgatcgggaacgtgtacgtgcagttccgcgaggaggagcaggcggcgcgcgcgctgcaggctctgcagggccgctactactcgggccgccccatcatcgccgagttctcccccgtgacggacttccgggaggccacctgccgccagttcgaggagcacagctgcaaccgcggcggatactgcaacttcatgcacgtcaagcaggtcggacgggacctgcggcggaagctgttcggccacctgcatcgctcccaccggagccatagccgcggcagccgcagcccgagcccgtaccgccgccacggtagctcgtccaggtccagggaccgtgacgatgaccatgactattactaccactaccgtagcggtagtggcagccgcaggagcagcgagagacaccgcagccacgacagcgacgggagccgccgtcggcgcgggcgatccaggagccggagcaagagcccgtggagggaaggcagcgaggagcggagggcaaagattgagcagtggaaccgcgagcgggaggcagcgcaggtgtaggcaggttcccctgtgactctgccggctgcagcctgcaggttgctgcagtactgttggcattgctagtctgacaggctgctgaagctgtcatcatgtattttagttatgtattgtagttttaggccttgtttagttcgtaaaattttttgtttttggctactgtagcatttcgtttttatttgacaaacattgtccaatcatggagtaactaggcttaa

SEQ ID NO: 1645 - DNA, 1286 bp, Triticum aestivum
ccctgctccaccttctgctccccctccggctacggcggcgctgatctccgagatctctagcttgcgaatccagggtgcgccgccatggccgagcacctcgcgtcgatcttcggcacggagaaggaccgcgtgaactgcccgttctacttcaagatcggcgcgtgccggcacggcgaccgctgctcccgcctgcacaacaagccgtctgtctcgcccacgctgctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaacctcgccgaccacctcattggcaacgtctacgtgcagttcagggaggaggaccaggccgccaaggccctccaggcgctgcaggggaggttctactcgggccgccccatcattgctgagttctcgcccgtcaccgacttcagggaggccacctgccggcagtttgaggagcacaactgcaaccgcggagggtactgcaacttcatgcatgtcaaggagataggcagggacctgaggaagaggctgtatgggcacctgcataggtccgggaggagccacagcaggagcagccggagcccgagcccctaccgtcaccatgccagggaccgtgatcgctcctcacggtctagggaccgcggcgactactatggaggtagcttggaccgtggcgactatggtgactactaccaccatagccggaggagcagcgagaggaaccgcaactatgacagtgatgggagcaggtgccggcgacacaggtccaggactaggagccccgtcagggagggcagcgaggagaggagggcgaagattgagcagtggaaccgtgaaagggaggcgcctgccaggcagggcagcgaagagaggagggcgaagatcgatcagtggaaccgtgagagggagactgctcaggcgtgagatctcctgtctgactgcaggttgaagtgttgccttgttcaccggatgttctgcttgcttgtctgatcgtgtaatggtagatggagttagaatttggtcctagtgaacttgcttggatgcctgatgtaacatcttcagtgttgttcttgttgaacttcctctatggatttgttgatggaacatatttggtgttggacttgttattgttatgattattatagtgtgttccctgaatgttcctttgctctaaaaaaaaa

SEQ ID NO: 1646 - DNA, 1656 bp, Saccharum officinarum
  misc_feature (597)..(597): n is a, c, g, or t
  misc_feature (615)..(615): n is a, c, g, or t
  misc_feature (1077)..(1077): n is a, c, g, or t
  misc_feature (1079)..(1079): n is a, c, g, or t
  misc_feature (1085)..(1085): n is a, c, g, or t
  misc_feature (1088)..(1088): n is a, c, g, or t
  misc_feature (1099)..(1099): n is a, c, g, or t
  misc_feature (1154)..(1154): n is a, c, g, or t
  misc_feature (1158)..(1158): n is a, c, g, or t
  misc_feature (1311)..(1311): n is a, c, g, or t
  misc_feature (1411)..(1411): n is a, c, g, or t
cggttccgtactcatcttcttcccctccgggctcgggctccggctacggcggcgctgctctctggtcggaagatgttggatcttccgctacaaatcgacgcataaaggatacagattagttttatttacgtcagatttcttttactcggtgtagttctgtgcattcattaaatcaatttcgcctggatctaagctgctgctattttgaaggtttcttctccggggaaaatttcagatcccggaaacgactggaattgaagtagccactgatgctgttatctagctagttcttgctcataagttgcttgtagttatttgtttgtttgttaatcctagctgttgcatattgtgtgcctgaatcgaatcgagtcgagcaggtagaggaggaatcaggcatccatggctgagcatcttgcgtccatctttggcacggagaaggaccgcgtgaactgccccttctacttcaagatcggcgcgtgccgccacggcgaccggtgctcccgcctgcacaacaagccgtccatctccccgacgctgctgctgtgcaacatgtaccagcggccggacatgatcaccccgggcgtggacgcgcagggnaaccccatcgacccggancggatccaggaggacttcgaggacttctacgaggacatcttcgaggagctgagcaagcacggcgagatcgagagcctccacgtgtgcgacaacctcgcggaccacattatcgggaacgtgtacgtgcagttccgcgaggaggagcaggcggccgcgccctgcaggcgctgcagggccgctactactcgggccgccccatcatcgccgagttttcgccggtgacggacttccgggaggccacttgccgccagttcgaggagcacagctgcaaccgcggcggatactgcaacttcatgcacgtcaagcaggtcggccgggacctgcggcggaagctgttcggccacctgcatggctcccaccggagtcacagccggggcagccgcagccccagcccgtaccgccgccgcggtagctcgtccaggtccagggaccgcgacgatgaccacgactattactactacnantaccgnagnggcagtggcanccgcaggagcagcgagagacaccgcagccacgacagcgacgggagccgccgtcgncgcnggcggtcgaggagccggagcaggagcccggtgagggaaggcagcgaggagaggagggcaaagattgagcagtggaaccgcgagcgggaggcagcgcaggttctcctgtgactccggctgcagcctgctggttgccgcagtgttgttgccttgntggtattgctagtttgccaacaagttgctgaatctgtcgtcaggtcgtaaattgaatctaaaaattgaattatgacctcttctgctgtggactagctggntgtgattcaacctttgatttggatgtgctgacgaaatctagttgttgtgagtaacttgctcagatggtcaagtggcgcctaatggttgcattgagcttgtgtccaaacaaagaaagaaaaagaatcgaagcatctttgatgatcttcaaagatcgcatggagaaggattttcagacaaatgtcttctcacagcacagtgagaatcgtacttgtcctcgtgttctaaaaataatcgcctttacaag

SEQ ID NO: 1647 - DNA, 1247 bp, Triticum aestivum
cccacgcgtccgaaaacaaaaacaaatctgccctgctccaccttctgcttcccctccggcgacggcggcgctgatctccgagatctgtagcttctctccgggggggcgaacccagggggcgccgccatggccgagcacctcgcgtctatcttcggcacggagaaggaccgcgtgaactgcccgttctacttcaagatcggcgcgtgccggcacggcgaccgctgctcccgcctgcacaacaagccgtccgtctcgcccacgctgctgctctgcaacatgtaccagcgccccgacatgatcaccccgggcgtggacgcgcagggcaaccccatcgaccccgtcaagatccagggcgacttcgaggacttctacgaggacatcttcgacgagctcagcaagcacggcgaggtcgagaacctgcacgtctgcgacaacctcgccgaccacctgattggcaacgtgtacgtgcagttcagggaggaggaccaggccgccaaggccctccaggcgctgcaggggaggttctactcgggccgccccatcatcgctgagttctcgcccgtcaccgacttccgggaggccacctgccggcagttcgaggagcacaactgcaaccgtggagggtactgcaacttcatgcatgtcaaggagattggcagggacctgaggaagaggctctatgggcacctgcataggtccaggaggagccacagcaggagcccgagcccctaccgtcaccacgccagggaccgtgatcgctcctcacggtctagggaccggggcgactactatggaggcagcctggaccgtggtgactacggcgactactaccaccacagccggaggagcagcgagaggaatcgcaactatgacagcgatgggagcaggcggcgccggcgacacaggtctaggactaggagcccggtcagggagggcagcgaggagaggagggcaaagattgagcagtggaaccgtgaaagggaggcgcctgccaggcagggcagcgaggagaggagggcgaagatcgagcagtggaaccgcgaaagggagactgctcaggcgtgagatctcctgtctgactgcaggttgcagtgttgccttgttcaccggatgttctgcttgcttgtctgatcttgtaatggtagatggagttggattgtggtcctagtgaacttacttggatgcctgatgtaacatcttcagtgttgttcttgttgaacttcctctatggatttgttgatggaaca

SEQ ID NO: 1648 - DNA, 1614 bp, Avena sativa
atctcccgtgctcctcctgcctcctctccggcgacggcggcggcgctgatttccggtcgggagataggatcttcctccctcgcaaatcgaagagaaaataagttatggattagttttactgccgttaattttcgtttacttaatcgccgttcgttcatcgatttgacctggaatttaagtgcctgctattttgaaggtttcctcagttctacgggaattggaattgcagtgtctactactcatgatgttctatcaagttcttttccaacctcttttgaattatctggcatgccgttggttaatcctagtggtaattttgcgtatataattcctgattcttgtggttggactgcagatctctagtttttctgcgaggggacgaacaggtggcagcatccagccgccgccatggctgagcacctcgcgtcgatcttcggcacggagaaggaccgcgtgaactgcccgttctacttcaagatcggcgcgtgccgccacggcgaccgctgctcccgcctgcacaaccgcccctctgtctcgccgaccctgctgctctgcaacatgtaccagcgcccggacatgatcaccccgggcttcgacccgcagggcaaccccatcgaacccagcaagatccagggtgacttcgaggacttctatgaggacatcttcgacgagctcagcaagtacggcgaggtggagaacctgcacgtctgcgacaacctcgctgaccacctcatcggcaacgtgtatgtctcgttcagggaggaggaccaggccgccaaggccctccaggcgctgcaggggaggttctactccggccgtcccatcattgctgagttctcgccggtcaccgacttccgcgaggccacctgcaggcagttcgaggagcacaactgcaaccgtggtgggtactgcaacttcatgcatgtgaaggagatcggcagggacctgaggaagaggttgtatgggcacctgcataggtcccggaggagccacagcaggagcagcaggagcccgagcccttaccattaccactcgagggaccgtgatcggtcgtcccggttgtcaagggaccgtggcgactactatggcggcagcttggaccgcggcgactatggggattaccaccaccatagccgtaggagcagcgagaggaatcgcaactatgacagtgatgggagcaggcggcgacggcacagaagccggactagaagccctgtcagggagggcagcgaggagaggagggcgaagattgagcagtggaaccgtgaaagggaggcgcaggcctaagagttcaggtcttattgcaggttgcagtgctgccttgttcaccaaatgtctgcctgtctgaacttgtattggtagatgagttagaatgtgttcttagtgatcttacttggatgcatgatgtagcctattcagtgtttttcttgttgaacttcatttggatgtgtccatggaacctatttggtgatgaacttgttatgattaaggttttctctggatgttcctttttctgcattatgtgcgttgcttgctcccagcttgtcccagtccctttactctcttgtatgatagacagaatttagagtgtgttcttaatgaacttactcagat

SEQ ID NO: 1649 - DNA, 1810 bp, Hordeum vulgare
atgtgtaggttcgaacggtttgtgttgcccgtgcccacgtattacgctcgtcccttttctctcggtccgaacggattggattgatgatgctttcgtgtgtcttctctgtcgattcttatcaggtcgggagataggttcttccccccctcgcgaatcgaagagataaatgaagttatggattagtcttactctcgtttagttccgttttctttcgatttggtccggaatttaagtgcctgctaattttgaaggtttccacagttccaccggaattgggatgaattgcagtatcaagttcttgttccccctccttcgaattatctggaatgttatccgttgatcttggctgcagcttcgtgtgtatgatttgtgtttcgtgtggtggaactgcagagatctatctagcttttctgcgagggaactaatccagggggcgccgccatggccgagcacctcgcgtcgatcttcggcaccgagaaggaccgcgtgaactgcccgttctacttcaagatcggcgcgtgccggcacggcgaccgctgctcccgcctgcacaacaagccgtccgtctcgccgacgctgctgctctgcaacatgtaccagcgccccgacatgatcaccccgggggtggacgcgcagggcaaccccatcaaccccgtcaagatccagggcgacttcgaggacttctacgaggacatcttcgacgagctcagcaagcacggcgaggtcgagaacctgcacgtctgcgacaacctcgccgaccacctgattggcaacgtctacgtgcagttcagggaggaggaccaggctgccaaggccctccaggcgctgcaggggaggttctactcgggccgccccatcattgccgagttctcgccggtcaccgacttccgggaggccacctgccggcagttcgaggagcacaactgcaaccgtggaggatactgcaacttcatgcatgtcaaacagattggcagggacctgaggaagaggctgtatgggcacctgcatagctccaggaggagccacagcaggagcagccggagcccaagcccctaccgtcaccacgccagggaccgtgatcgctcctcacggtctaaggaccgtggcgattactatggaggcagcctggaccgtggtgactatggcgactactaccaccatagccggaggagcagcgagaggaatcgcaactatgacagcgatgggagcaggcgccggcgacacaggtctagaactaggagcccggtcagggagggcagcgaggagaggagggcgaagattgagcagtggaaccgtgaaagggatgcgcctgccaggcagggcagcgaggagaggagggcgaagatcgagcagtggaaccgtgaaagggagacggctcaggcctgagatctccggtctgactgcaggttacagtgttgccttgttcacaggatgttctgcttgcttatctgatcttgtaatgttagatggagttagattgttgccctagtgaacttactcagatgcctcatgtagaacctcttcagtgtggttcttgttgaacttctttttggatgtgttgatggaacatatttggtgttgaatttgttattgttatgattatagtgtgttccctcaaaatgttcctttgcccacatactttgtttcagtctaaatgcattgggggttgtatttttgtaccactcgacatcaacttaggttcaatcaaatttcctgccagtttgaaaggcagagagtttagcactcagggctaaatgagaaactataacatgtaatctagtgtgtcagctcgccgcattgttaaatttat

SEQ ID NO: 1650 - DNA, 1537 bp, Sorghum bicolor
gaagcaccgtgcaccactggagatcgttccttccttctgctatcctctccgcgtcttggtcgtctcgtcttcctccctccgtcccttcctcccccaacagaggcacagagcagagaatggggagcggcgagaagaccgtcaccgcttatggcgagtacacctatgctgagctggagagggagccctactggccaagtgagaagctgaggatttcgattactggtgctggtggtttcattggatcccacattgctcgccgtctgaagagcgagggccattacatcattgcctctgactggaagaagaatgagcacatgaccgaggacatgttctgccatgagttccaccttgttgacctcagggtcatggacaactgtctgaaggtcacccaaggtgtcgaccatgtctttaatcttgctgctgatatgggtggcatggggttcatccagtccaatcactctgtgatcatgtacaacaacaccatgatcagtttcaacatgctggaggctgcacgtatcaatggtgtgaagaggttcttctacgcttcaagtgcatgcatttaccctgaattcaagcagcttgacacaaatgtgagcctgaaggaatctgatgcctggcctgctgagcctcaagacgcctatggcttggagaagcttgcaactgaggagctgtgcaagcactacaccaaggactttggcatcgagtgccgcgttggccgcttccacaacatttacggcccttttggtacatggaaaggtggtcgtgagaaggcaccggccgccttctgcagaaaggctcagacatccacggagaggtttgagatgtggggtgatggtctccagacccgatccttcactttcatcgacgagtgtgttgagggtgttctgagattgaccaagtcagacttccgcgagccagtgaacatcggaagcgatgagatggtgagcatgaacgagatggctgagatcgtgctgagctttgaggataggaagctgcccatccaccacatccctggtccagagggggtccgtgggcgcaactctgacaacacccttatcaaggagaagcttggctgggccccaacaatgaagctcaaggatgggctgaggttcacctacttctggatcaaggagcagatcgagaaggagaagacccagggggttgacatcgcggcgtatgggtcgtccaaggtggtgtccacccaggcgcccgtgcagctgggctccctccgtgccgctgatggcaaggagggcctctgagcgatgagacttcgtccatcagttcaccgcgtaccgtagtgggatatgacatactgtttggagagtttggacggtagaatatactacagtagcagcaaaaatactcttgggccccttttttgggggttctattctatttttctatctattcaccgctccattaatttatgccatgcatcttgttcatttttgcatgtcttctgtaccttgtttgaactcctttggccatgaccggcaataaaattttccctatttctgctgtatgtggaatatgtgtg

SEQ ID NO: 1651 - DNA, 1524 bp, Sorghum bicolor
gtgcaccactggagatcgttccttccttctgctatcctctccgcgtcttggtcgtctcgtcttcctccctccgtcccttcctcccccaacagaggcacagagcagagaatggggagcggcgagaagaccgtcaccgcttatggcgagtacacctatgctgagctggagagggagccctactggccaagtgagaagctgaggatttcgattactggtgctggtggtttcattggatcccacattgctcgccgtctgaagagcgagggccattacatcattgcctctgactggaagaagaatgagcacatgaccgaggacatgttctgccatgagttccaccttgttgacctcagggtcatggacaactgtctgaaggtcacccaaggtgtcgaccatgtctttaatcttgctgctgatatgggtggcatggggttcatccagtccaatcactctgtgatcatgtacaacaacaccatgatcagtttcaacatgctggaggctgcacgtatcaatggtgtgaagaggttcttctacgcttcaagtgcatgcatttaccctgaattcaagcagcttgacacaaatgtgagcctgaaggaatctgatgcctggcctgctgagcctcaagacgcctatggcttggagaagcttgcaactgaggagctgtgcaagcactacaccaaggactttggcatcgagtgccgcgttggccgcttccacaacatttacggcccttttggtacatggaaaggtggtcgtgagaaggcaccggccgccttctgcagaaaggctcagacatccacggagaggtttgagatgtggggtgatggtctccagacccgatccttcactttcatcgacgagtgtgttgagggtgttctgagattgaccaagtcagacttccgcgagccagtgaacatcggaagcgatgagatggtgagcatgaacgagatggctgagatcgtgctgagctttgaggataggaagctgcccatccaccacatccctggtccagagggggtccgtgggcgcaactctgacaacacccttatcaaggagaagcttggctgggccccaacaatgaagctcaaggatgggctgaggttcacctacttctggatcaaggagcagatcgagaaggagaagacccagggggttgacatcgcggcgtatgggtcgtccaaggtggtgtccacccaggcgcccgtgcagctgggctccctccgtgccgctgatggcaaggagggcctctgagcgatgagacttcgtccatcagttcaccgcgtaccgtagtgggatatgacatactgtttggagagtttggacggtagaatatactacagtagcagcaaaaatactcttgggccccttttttgggggttctattctatttttctatctattcaccgctccattaatttatgccatgcatcttgttcatttttgcatgtcttctgtaccttgtttgaactcctttggccatgaccggcaataaaattttccctatttctgctgtatgtggaatat

SEQ ID NO: 1652 - DNA, 1503 bp, Zea mays
gaagcacaccgcaggacaggagaagcttgggtctcctatcctccccacccctctctcggtctcttccccaccgcgtcttcgtcgtctcgtcttcctgcctccttcgcccgagaaaggagagaatggggagcagcgagaagaccgttaccgcttacggcgagtacacctacgctgagctggagagggagccctactggccgagtgagaagctgaggatttcgattactggggctggtggtttcattggatcccacattgctcgccgtctgaagaacgagggccattacatcattgcctctgactggaagaagaacgagcacatgaccgaggacatgttctgccatgagttccacctcgttgatctcagggtcatggacaactgtctcaaggtcacccatggtgtcgaccatgtcttcaatcttgctgcagatatgggtggcatggggttcatccagtcaaatcactctgtgatcatgtacaacaacaccatgatcagttttaacatgctggaggctgcacgtatcaatggtgtgaagaggttcttctatgcctcgagtgcatgcatttaccctgagttcaagcagcttgacacaaatgtgagcttgaaggaatctgatgcctggcctgctgagcctcaagatgcctatggcttggagaagcttgcaaccgaggagctgtgcaagcactacaccaaggactttggcatcgagtgccgcgtcggccgcttccacaacatctacggccctttcggaacatggaaaggtggccgcgagaaggcaccggctgccttctgcagaaaggctcagacatccacggagaggtttgagatgtggggcgatggtctccagaccaggtccttcaccttcatcgacgagtgcgtggagggtgttctgagattgaccaagtcagacttccgcgagccagtgaacatcggaagcgatgagatggtgagcatgaacgagatggctgagatcgtgctgggctttgaggataggaagctgcccatccaccacatccctggcccggaaggggtccgcgggcgcaactctgacaacacccttatcaaggagaagcttggctgggccccgacgatgaagctcaaggatgggctgcggttcacctacttctggatcaaagagcagatcgagaaggagaagacgcagggggtcgacatcgcggcgtacgggtcgtccaaggtggtgtccacccaggcgcccgtgcagctgggctccctccgcgccgccgacggcaaggagggcctctaaagcgacgacccagggctgtctggcgtaccatggcgggatatactgtttgcggtagaatatcacagtagcagcaaaactagtacttttggaggttcagacatgacggtcgccttcttttctattttcccattcatcgctccatttatttatgatgccatgcaactcgttgaatttttgctgtactccctttatttggtcttggccggccggcaataaaattctccctgtttctactaca

SEQ ID NO: 1653 - DNA, 1443 bp, Saccharum officinarum
gttccgtcgtctcctatcctctccgcgtcttggtcgtctcttcttcctccctccctcccccgacagagcagagaatggggagcagcgagaagaccgccaccgcttatggcgagtacacctatgctgagctggagagggagccctactggccaactgagaagctgaggatttcgattactggggctggtggtttcattggatcccacattgctcgccgtctgaagagcgagggccattacatcattgcctctgactggaagaagaatgagcacatgaccgaggacatgttctgccatgagttccaccttgttgacctcagggtcatggacaactgtctgaaggtcacccaaggtgtcgaccatgtctttaatcttgctgctgatatgggtggcatggggttcatccagtcaaatcactctgtgatcatgtacaacaacaccatgatcagtttcaacatgctggaggctgcacgtatcaatggtgtgaagaggttcttctatgcttcgagtgcatgcatttaccctgaattcaagcagctcgacacaaatgtgagcttgaaggaatctgatgcctggcctgctgagcctcaagacgcctatggcttggagaaacttgcaactgaggagctgtgcaagcactacaccaaggactttggcattgagtgccgcgttggccgcttccacaacatctacggtccttttggtacatggaaaggtggtcgtgagaaggcaccggctgccttctgcagaaaggctcagacatccactgagaggtttgagatgtggggtgatggtctccagacccgatccttcactttcatcgacgagtgcgtcgagggtgttctgagattgaccaagtcagacttccgcgagccagtgaacataggaagcgatgagatggtgagcatgaacgagatggctgagatcgtgctgagctttgaggataggaagctgcccatccaccacatccctggtccggagggggtgcgtgggcgcaactctgacaacacccttatcaaggagaagcttggctgggccccaacaatgaagctcaaggatgggctgaggttcacctacttctggatcaaagagcagatcgagaaggagaagaccctgggggtcgacatcgcggcgtacgggtcgtccaaggtggtgtccacccaggcgcccgtgcagctgggctccctccgtgccgccgacggcaaggagggcctctgagcgatgaggctgcttcgtccatcatcgcgtaccgtagtgggatatgagtgacgtactgtttggagagtttggacggtagaatatactacagtagcagcaaaaagtactgttgggtcccttttggggggttctattctatttttctatccattcaccgctccattaatttatgccatgcatcttgttcatttttgcatgtcttctgtaccttgattgaactcctttg

SEQ ID NO: 1654 - DNA, 1484 bp, Saccharum officinarum
  misc_feature (109)..(109): n is a, c, g, or t
gcacgaggttccgtcgtctcctatcctctccgcgtcttggtcgtctcttcttcctccctccctcccccgacagagcagagaatggggagcagcgagaagaccgccaccncttatggcgagtacacctatgctgagctggagagggagccctactggccaactgagaagctgaggatttcgattactggggctggtggtttcattggatcccacattgctcgccgtctgaagagcgagggccattacatcattgcctctgactggaagaagaatgagcacatgaccgaggacatgttctgccatgagttccaccttgttgacctcagggtcatggacaactgtctgaaggtcacccaaggtgtcgaccatgtctttaatcttgctgctgatatgggtggcatggggttcatccagtcaaatcactctgtgatcatgtacaacaacaccatgatcagtttcaacatgctggaggctgcacgtatcaatggtgtgaagaggttcttctatgcttcgagtgcatgcatttaccctgaattcaagcagctcgacacaaatgtgagcttgaaggaatctgatgcctggcctgctgagcctcaagacgcctatggcttggagaaacttgcaactgaggagctgtgcaagcactacaccaaggactttggcattgagtgccgcgttggccgcttccacaacatctacggtccttttggtacatggaaaggtggtcgtgagaaggcaccggctgccttctgcagaaaggctcagacatccactgagaggtttgagatgtggggtgatggtctccagacccgatccttcactttcatcgacgagtgcgtcgagggtgttctgagattgaccaagtcagacttccgcgagccagtgaacataggaagcgatgagatggtgagcatgaacgagatggctgagatcgtgctgagctttgaggataggaagctgcccatccaccacatccctggtccggagggggtgcgtgggcgcaactctgacaacacccttatcaaggagaagcttggctgggccccaacaatgaagctcaaggatgggctgaggttcacctacttctggatcaaagagcagatcgagaaggagaagaccctgggggtcgacatcgcggcgtacgggtcgtccaaggtggtgtccacccaggcgcccgtgcagctgggctccctccgtgccgccgacggcaaggagggcctctgagcgatgaggctgcttcgtccatcatcgcgtaccgtagtgggatatgagtgacgtactgtttggagagtttggacggtagaatatactacagtagcagcaaaaagtactgttgggtcccttttggggggttctattctatttttctatccattcaccgctccattaatttatgccatgcatcttgttcatttttgcatgtcttctgtaccttgattgaactcctttggccttgaccggcaataaaattttccctgtttctc

SEQ ID NO: 1655 - DNA, 1541 bp, Panicum virgatum
cggcggggggtgcactacaggagatcctccctctcctatcctctccaccccacctccctcccctccgtgtcttcgtcgtctccctcgccgacaaagcagagaatggggagcagcgagaagactgttactgcttatggcgagtacacctatgctgagctggagagggagccctactggccaagtgagaagttgaggatttcgattactggggctggtggtttcattggatcccacattgctcgccgtctgaagagcgagggccattatatcattgcctctgactggaagaagaatgagcacatgaccgaggacatgttctgccatgagttccacctggttgatctcagggtcatggacaactgtctgaaggttacccaaggcgtcgatcatgtattcaatcttgctgctgatatgggtggcatggggttcatccagtcaaaccactctgtcatcatgtacaacaacaccatgatcagtttcaacatgctagaggctgcacgtatcaatggtgtgaagaggttcttctacgcctccagtgcatgcatttaccctgaattcaagcagcttgacacaaatgtgagcctgaaggaatccgatgcctggcctgctgagcctcaagacgcctatggcttggagaagcttgcaactgaggagttgtgcaagcactacaccaaggactttggcatcgagtgccgcattggccgtttccataacatctatggtcccttcggtacatggaaaggtggtcgtgagaaggcacctgctgccttctgcagaaaggctcagacatcaaccgagaggtttgagatgtggggcgatggcctccaaacccgatccttcactttcatcgacgaatgcgtcgagggtgttctaagattgaccaagtccgacttccgcgagccagtgaacattgggagtgacgagatggtgagcatgaacgagatggctgagatcgtgctgagctttgaggataggaagctgcccatccaccacatccctggtccagagggtgtccgcgggcgcaactctgacaacacccttatcaaggagaagctcgggtgggctccgacaatgaagctcaaggacgggcttcggttcacctacttctggatcaaggagcagatcgagaaggagaagatccagggcatcgacatcgcggcgtacgggtcctctaaggtggtgtcgacccaggcgcccgtgcagctgggctccctccgcgccgccgacggcaaggagggcctctgagtgccgatcccatagctgcatacggaagctgtcggagagttgttgggacggtagaaagagtacacaacagcaaacatacggtttagcccctttgaggggggttagagacgatcgatcgtgttccattctgtattcaccaccccattagtttttgtgtcatcttggtaattgcctgtgtattttcacattcagtttgctcctatgcccgtgatggacaataaaatcccctgtttctatcatgtatatgaagttactcgcgagtgccattggcctgcaatttacggtatgtgtgatgt

SEQ ID NO: 1656 - DNA, 1556 bp, Panicum virgatum
gaacccggcctccctcgccttttcttctcccattcaccccgcgccagcgctctcctaggcgacgactgggcgacgcccgcagccgccgccctacgccaggtgcccaggtcttcgccggcgacgagcacccacccaccagaatggggagcagcgagaagaccgtcagcgcttatggtgagtacacctatgctgagctggagagggagccctactggccgagtgagaagctgaggatttcgattactggggctggtggtttcattggatcccacattgctcgccgtctcaagagcgagggccattacatcatcgcctctgactggaagaagaatgagcacatgacagaggacatgttctgccatgagttccatcttgttgacctcagggtcatggacaactgtctcaaggttacccaaggcgtcgaccatgtattcaatcttgctgctgatatgggtggcatggggttcatccagtcaaaccactctgtcatcatgtacaacaacaccatgatcagtttcaacatgcttgaggctgcacgcatcaatggtgtgaagaggttcttctatgcctcgagtgcatgcatttaccctgaattcaagcagcttgacacaaatgtgagcttgaaggaatctgatgcctggcctgctgagcctcaagatgcctatggcttggagaagcttgcaactgaggagctgtgcaagcactacaccaaggactttggcatcgagtgccgcattgggcgtttccacaacatctatggcccctttggaacatggaaaggtggtcgtgagaaggcacctgctgccttctgcagaaaggctcagacatctaccgagaggtttgagatgtggggcgacggactccagacacgatccttcactttcatcgacgagtgtgtcgagggtgttctgaggttgaccaagtctgacttctgcgagccggtgaacatcgggagcgacgagatggtgagcatgaacgagatggccgagatcgtcctgagcttcgaggataggaagctgcccatccaccacatccctggccccgagggggtccgcgggcgcaactccgacaacaccctcatcaaggagaagcttggctgggccccgaccatgaagctcaaggacgggctgaggttcacctacttctggatcaaggagcagatcgagaaggagaagacgcagggggtcgacgtcgcggcgtacgggtcctccaaggtggtgtccacccaggcgcccgtgcagctgggctccctccgcgccgccgacggcaaggagggcctctgaggaggcattgactgaaccgatggtttggttcaggactgcatacggatactgttgaaaagttggacggcagtagagtttttgcagcaaccatatataccttttagccccatctggggttagagacgatcgtgttctagcaattcagcgcccccattgatttatttttggtgccatcttgttaattgcatgtgtgtttctttttcactgttgtactcctttggtcatgatgaacagttaaaatccctgtgctttactgtgaatgatacaataaaa

SEQ ID NO: 1657 - DNA, 1454 bp, Pennisetum glaucum
gaggaagaagaaatccttcccccaacctcaacctctcctgctccgcgtgttcgtcgtcgcttcgtcctgcccaccctcgccgacaaagccgagaatggggagcagtgtttatggtgagtacacctatgctgaactggagagggagccctactggccgagtgagaagctgaggatttcaattactggggctggtggtttcattggatcacacattgctcgccgtctgaagagtgagggccattacatcattgcttccgactggaagaaaaatgagcacatgactgaggacatgttctgccatgagttccaccttgttgacctcagggtcatggacaactgtctgaaggttacccaaggtgtcgaccatgtattcaatcttgctgctgatatgggtggcatgggtttcatccagtcaaaccactctgtcatcatgtacaacaacaccatgatcagtttcaacatgcttgaagctgcacgtatcaatggtgtgaagaggttcttctacgcctcaagtgcatgcatttaccctgaattcaaacagctggacacaaatgtgagcttgaaggaatctgatgcctggccggctgagcctcaagacgcctatggcttggagaagcttgcaactgaggagttgtgcaagcattacaccaaggactttggcattgagtgccgcattggccgtttccacaacatatatggcccctttggaacatggaagggtggtcgtgagaaggcacctgctgccttctgcagaaaggctcagacatccaccgagaggtttgagatgtggggtgatggtctccagacccgatccttcactttcatcgacgagtgtgtcgagggtgttctgagattgaccaagtcagacttccgcgagcccgtgaacattggaagcgatgagatggtgagcatgaacgagatggctgagatcgtcctgagctttgaggataggaagctgcccatccaccacatccctggtccagagggggtccgcgggcgcaactctgacaacacccttatcaaggagaagcttgggtgggccccaacaatgaagctcaaggatgggcttcgtttcacgtacttctggatcaaggagcagatcgagaaggagaagacccagggcatcgacatcgctgcgtatggttcctccaaggtggtgtcgacccaggcgcccgtgcagctgggctctcttcgcgccgccgacggcaacgagggcctctaaatccgtcactgcattccgtaactgtgggagattcagaacagtagagagtgagagtatagcaacaaacatgccttttatccccctttggagggttagagacgatcgtgttgtacgcagcattcaccaccaccattaattttggtattcacctttgatttttttttggacgccacctttgatgattgtactcctttgcccgtgatggaaaataaaattccctgtgttgttgtta

SEQ ID NO: 1658 - DNA, 1639 bp, Brachypodium distachyon
acttccctttctgataaaaaaacggggatcttgtcgatttgggtattccagctcgagtgaccaccattggccctataaataatggccgctaagaagaaccccgtggcaccacgacagatctcctccctgttcaatccagcccatttatctccccctccggtttattccttccacgagtcaggagagaggtaaaacccgccgaactttgctgaggcagagataccaagaactttgtatgggattgggacacctggtgaccatgcctgcatggttagtttgggtgtgattcactgccaatccttgccatacagggtggccgtggtcggttgaactgtgacagaatggggagcaccgacaagaccggaactccttatggtgagtacacatatgctgagctggagagggaactatactggccatctgagaagctgaggatttcgatcactggagctggtggtttcattggatcccatattgctcgtcgtctgaagagtgagggacactacatcattgcctctgactggaagaagaacgagcatatgactgaggacatgttctgccatgagttccaccttgttgacctcagggtcatggataactgccttaaggtcaccaatggtgtggaccatgtcttcaatcttgctgctgatatgggtggcatgggtttcattcagtccaaccactccgttatcatgtacaacaacaccatgatcagttttaacattcttgaggctgggcgtatcaatggtgtgaagaggttcttctatgcctcgagcgcatgcatttaccctgaattcaagcagcttgagacaaatgtgagcttgaaggaagctgatgcctggcctgctgagccacaagatgcctatggcttggagaagctggcgactgaggagctgtgcaagcactacaccaaggactttgccattgagtgccgtgttggccgtttccacaatatttacggtccctttggaacatggaaaggtggtcgcgagaaggcacctgctgccttctgcaggaaggcccagacctccacagagcggtttgagatgtggggtgacggtctccagacccgatccttcacttttatcgacgagtgtgtcgagggtgttctgaggttgacaaagtcggacttccgcgagccagtgaacattgggagcgatgaaatggtgagcatgaacgagatggcagagattgttctgggctttgaggacaagaagctgcccatccaccacatccctggtcccgagggtgtccgtggacgcaactccgacaatacccttatcaaggagaagcttggctgggctcccacgatgagactcaaggatggcctgaggttcacctacttctggatcaaggagcagatcgagaaggagaggacggaggggatggacgtggccaggtacgggtcatccaaggtggtgtctacccaagcgccggttcagctgggctctctccgcgccgctgacggcaaggagtgaactcaacacttgtcggggacgttgggaccatcttcacatgctcatgattcctattcatcgtcacgacccgattaatttatttattttggtgtgtgtcacgtagttcctcaaacaccatacatttgattcggtgaacaataaaattcccttattttctccga

SEQ ID NO: 1659 - DNA, 1348 bp, Brachypodium distachyon
atccagcccatttatctccccctccggtttattccttccacgagtcaggagagaggtaaaacccgccgaactttgctgaggcagagataccaagaactttgtatgggattgggacacctggtgaccatgcctgcatggttagtttgggtgtgattcactgccaatccttgccatacagggtggccgtggtcggttgaactgtgacagaatggggagcaccgacaagaccggaactccttatggtgagtacacatatgctgagctggagagggaactatactggccatctgagaagctgaggatttcgatcactggagctggtggtttcattggatcccatattgctcgtcgtctgaagagtgagggacactacatcattgcctctgactggaagaagaacgagcatatgactgaggacatgttctgccatgagttccaccttgttgacctcagggtcatggataactgccttaaggtcaccaatggtgtggaccatgtcttcaatcttgctgctgatatgggtggcatgggtttcattcagtccaaccactccgttatcatgtacaacaacaccatgatcagttttaacattcttgaggctgggcgtatcaatggtgtgaagaggttcttctatgcctcgagcgcatgcatttaccctgaattcaagcagcttgagacaaatgtgagcttgaaggaagctgatgcctggcctgctgagccacaagatgcctatggcttggagaagctggcgactgaggagctgtgcaagcactacaccaaggactttgccattgagtgccgtgttggccgtttccacaatatttacggtccctttggaacatggaaaggtggtcgcgagaaggcacctgctgccttctgcaggaaggcccagacctccacagagcggtttgagatgtggggtgacggtctccagacccgatccttcacttttatcgacgagtgtgtcgagggtgttctgaggttgacaaagtcggacttccgcgagccagtgaacattgggagcgatgaaatggtgagcatgaacgagatggcagagattgttctgggctttgaggacaagaagctgcccatccaccacatccctggtcccgagggtgtccgtggacgcaactccgacaatacccttatcaaggagaagcttggctgggctcccacgatgagactcaaggatggcctgaggttcacctacttctggatcaaggagcagatcgagaaggagaggacggaggggatggacgtggccaggtacgggtcatccaaggtggtgtctacccaagcgccggttcagctgggctctctccgcgccgctgacggcaaggagtgaact

SEQ ID NO: 1660 - DNA, 1474 bp, Quercus alba
ctgcctctaaaaccatagccattcagcttctctttgaaccatttcttcttcaacaatattttctccgtctctgtttccacagctctaaaggctcaacttcaacgcttttcagaatgggaagtactggtgaagccaaatatggtgcatacacctatgagaaccttgagagggaaccatactggccatcagagaagctccgaatttctattactggggcaggtggttttattgcctcccacattgcccggcgcttgaagagtgagggtcactacattattgcttctgattggaagaagaatgagcacatgactgaagacatgttctgtcatgaattccaccttgtggacttgagggtcatggataattgcttgaaggtcactaatggagttgaccatgtgttcaatcttgctgctgatatgggtggcatgggattcattcagtccaaccactcagttatcatgtataacaacacaatgatcagtttcaacatgcttgaggctggcaggattaatggtgttaagaggtttttctatgcctctagtgcttgtatctatcctgaatttaagcagctggaaactaatgtgagcctaaaggagtctgatgcctggcctgctgagcctcaagatgcttatggcttagagaagcttgcaacagaggagttgtgcaagcactacaccaaagattttggtattgagtgccgtgttggaagattccataacatttatggtccttttggaacatggaaaggtgggagggagaaggctccagctgctttttgtagaaaggctcaaacttccaccgataagtttgagatgtggggggatggacttcagaccagatcattcaccttcattgatgaatgtgtagaaggtgttcttagattgacgaagtcagacttccgcgagccagtgaacattggaagtgatgagatggttagcatgaatgaaatggctgaaattgtgcttagctttgagaacaagcagctccctatccaccacattcctggcccagagggagtccgtggtcgtaactcagacaacacactcatcaaagagaaacttggttgggctcctaccatgaagttgaaggatgggctgagatttacatacttctggatcaaggagcagattgagaaagagaaggctcaaggtgttgacttgtcgacttatgggtcatctaaggtggttggaactcaggctccagttcagctaggctcacttcgtgctgctgatggcaaagaatgaggtggttgaagccagatagctcaatggcaaagaatgagatagttgaagccagatagctcaataaattgcaccgatgaagtcccaagttttattaaggtttggttattatgtttcattgcataggaaggtatttatggtaatcgaaacttgccatgttgagctgttattatttagagatatcacgtttgtagtattttgttttgtttaaggaagctttcatgctcccaagg

SEQ ID NO: 1661 - DNA, 1223 bp, Cenchrus ciliaris
  misc_feature (267)..(267): n is a, c, g, or t
  misc_feature (288)..(288): n is a, c, g, or t
  misc_feature (318)..(318): n is a, c, g, or t
  misc_feature (339)..(339): n is a, c, g, or t
  misc_feature (356)..(356): n is a, c, g, or t
  misc_feature (360)..(360): n is a, c, g, or t
  misc_feature (468)..(468): n is a, c, g, or t
  misc_feature (477)..(477): n is a, c, g, or t
  misc_feature (504)..(504): n is a, c, g, or t
  misc_feature (528)..(528): n is a, c, g, or t
  misc_feature (537)..(537): n is a, c, g, or t
  misc_feature (546)..(546): n is a, c, g, or t
  misc_feature (559)..(559): n is a, c, g, or t
  misc_feature (597)..(597): n is a, c, g, or t
  misc_feature (600)..(600): n is a, c, g, or t
  misc_feature (624)..(624): n is a, c, g, or t
  misc_feature (631)..(631): n is a, c, g, or t
  misc_feature (633)..(633): n is a, c, g, or t
  misc_feature (657)..(657): n is a, c, g, or t
  misc_feature (663)..(663): n is a, c, g, or t
  misc_feature (672)..(673): n is a, c, g, or t
  misc_feature (693)..(693): n is a, c, g, or t
  misc_feature (699)..(699): n is a, c, g, or t
  misc_feature (705)..(705): n is a, c, g, or t
  misc_feature (708)..(708): n is a, c, g, or t
  misc_feature (717)..(717): n is a, c, g, or t
  misc_feature (723)..(723): n is a, c, g, or t
  misc_feature (738)..(738): n is a, c, g, or t
  misc_feature (819)..(819): n is a, c, g, or t
  misc_feature (825)..(825): n is a, c, g, or t
  misc_feature (828)..(828): n is a, c, g, or t
  misc_feature (834)..(834): n is a, c, g, or t
  misc_feature (852)..(853): n is a, c, g, or t
  misc_feature (879)..(879): n is a, c, g, or t
  misc_feature (891)..(891): n is a, c, g, or t
  misc_feature (897)..(897): n is a, c, g, or t
  misc_feature (1004)..(1004): n is a, c, g, or t
  misc_feature (1032)..(1032): n is a, c, g, or t
  misc_feature (1035)..(1035): n is a, c, g, or t
  misc_feature (1041)..(1041): n is a, c, g, or t
  misc_feature (1044)..(1044): n is a, c, g, or t
  misc_feature (1066)..(1066): n is a, c, g, or t
  misc_feature (1068)..(1069): n is a, c, g, or t
  misc_feature (1077)..(1077): n is a, c, g, or t
  misc_feature (1083)..(1083): n is a, c, g, or t
  misc_feature (1116)..(1116): n is a, c, g, or t
  misc_feature (1122)..(1123): n is a, c, g, or t
  misc_feature (1125)..(1125): n is a, c, g, or t
  misc_feature (1129)..(1129): n is a, c, g, or t
  misc_feature (1140)..(1140): n is a, c, g, or t
  misc_feature (1155)..(1155): n is a, c, g, or t
  misc_feature (1157)..(1157): n is a, c, g, or t
  misc_feature (1160)..(1160): n is a, c, g, or t
  misc_feature (1164)..(1164): n is a, c, g, or t
  misc_feature (1188)..(1188): n is a, c, g, or t
  misc_feature (1191)..(1191): n is a, c, g, or t
  misc_feature (1209)..(1209): n is a, c, g, or t
  misc_feature (1215)..(1215): n is a, c, g, or t
  misc_feature (1220)..(1220): n is a, c, g, or t
caaacccgacctctctctccgtgtcttcccttcgtcgtcgtcgctccgtcctgcccaccctcgccgacaaagcggagaatggggagcagcgagaagactgttaccgcttatggtgagtacacctatgctgagctggagagggagccctactggccgagtgagaagctgaggatttcaattactggggctggtggtttcattggatcacacattgctcgtcggctgaagagtgagggccattacatcatcgcctctgactggaagaanaatgagcacatgactgagganatgttctgccatgagttccaccttgttganctcagggtcatggacaactgnctgaaggttacccaagncgtngaccatgtattcaatcttgctgctgatatgggtggcatggggttcatccagtcaaaccactctgtcatcatgtacaacaacaccatgatcagtttcaacatgcttgangctgcacgnatcaatggtgtgaagaggttcttctangcctcgagtgcatgcatttacccngaattcaancagcttganacaaatgtgagcntgaaggaatctgatgcctggcctgctgagcctcaagangcntatggcttggagaagcttgcaacngaggagntntgcaagcactacaccaaggacttnggcatngagtgccgnnttggccgtttccacaacatntatggncccttnggnacatggaanggtggncgtgagaaggcaccngctgccttctgcagaaaggctcagacatccacggagaggtttgagatgtggggcgatggtctccagacccgatccttcacnttcatngangagtgngtcgagggtgttctgagnntgaccaagtcagacttccgcgagccngtgaacattggnagcgangagatggtgagcatgaacgagatggccgagattgtcctgagctttgaggataggaagctgcccatccaccacatccctggtccagagggggtccgtgggcgcaactntgacaacacccttatcaaggagaagctnggntgggcnccnacaatgaagctcaaggatgggntnnggttcacntacttntggatcaaggagcagatcgagaaggagaagacncagggnntngacntcgcggcgtangggtcctccaaggtngngtngacncaggcgcccgtgcagctgggctcnctncgcgccgccgacggcaangagggnctttnagt

SEQ ID NO: 1662 - DNA, 1582 bp, Castanea mollissima
cactgcctttaaaaccatacccattcagcttctctttgaaccatttcttcttcaacaatattttctccatctccgtttccacagctctaaaggctcaacttcaacgcttttcagaatgggaagtactggtgaagccaaatatggtgcatacacctatgagaaccttgagagggaaccatactggccatcagagaagctccgaatttctattactggggcaggtggttttatcgcctcccacattgcccggcgcttgaagagcgagggtcactacattattgcttctgattggaagaagaatgagcacatgactgaagacatgttctgtcatgaattccaccttgtggacttgagggtcatggataattgcttgaaggtcactaagggagttgaccatgtgttcaatcttgctgctgatatgggtggcatgggcttcattcagtccaaccactcggttatcatgtataacaacacaatgatcagtttcaatatgctcgaggctggcaggattaatggtgttaagaggtttttctatgcctctagtgcttgtatctatcctgaatttaagcagctggaaactaatgtgagcctaaaggagtctgatgcctggcctgcagagcctcaagatgcttatggcttagagaagcttgcaacagaggagttgtgcaaacactacaccaaagattttggtattgagtgccgtattggaagattccataacatttatggtccttttggaacatggaaaggtgggagggagaaggctccagctgctttttgtagaaaggctcaaacttccaccgataagtttgagatgtggggggatggacttcagaccagatccttcaccttcattgatgaatgtgtagaaggtgttcttagattgacgaagtcagacttccgcgagccagtgaacattggaagtgatgagatggttagcatgaatgaaatggctgagatcgtgcttagctttgagaacaagcagctccctatccaccacattcctggtccagagggagtccgtggtcgtaactcagacaacacactcatcaaagagaaacttggttgggctcctaccatgaagttgaaggatgggctgagatttacatacttctggatcaaggagcagattgagaaagagaaggctcaaggtgttgacttggcggcttacgggtcatctaaggtggttggaacccaggctccagttcagctaggctcacttcgtgctgccgatggcaaagaatgagatagttgaagctagatagctcaatggcaaagaacaagatggttgaagccagatagctcaataaattgctccgagaaagtcccaagttttattaaggtttggttagtatgtttcattgcataggaaggtatctatggtaatcgaaacttgccaagttgagctgttattatttagaggtatcacgtttgtagtattttgttttgtataaggaagctttcatgctcccaaggtatgtgatctagtttttcagacaacctgctattgtcggatgtcatgatccatgttatttttttttatttatgagataaatttgtggttaaatcttgtaaaaaaaaa

SEQ ID NO: 1663 - DNA, 1552 bp, Ricinus communis
gaatcatctctctcaaacttttctcctctgctcttattttgcattatcttcttttctcagacacccaatttccaggtcttacagtatgggaagcagtgaaggaaccaactatggggcttacacctatgagaaccttgagagggaaccttactggccatctgagaagcttcgaatttcaattactggtgctggtggttttattgcctcccacattgctcgccgtttgaagagtgagggccattacattattgcttccgactggaagaagaatgagcacatgacagaagatatgttctgtcatgaattccatcttgtggatctgagggtcatggataactgcttgaaggttactaagggtgtagaccatgtatttaaccttgctgctgatatgggtgggatgggtttcatccagtccaaccactctgtcattatgtacaacaacacaatgatcagcttcaacatgcttgaggcctctaggatcaatggagttaagaggctcttctatgcctctagtgcttgtatttaccctgaatttaagcaactggacactaatgttagcttgaaggagtctgatgcttggcctgcagagcctcaagatgcatacggcttggagaaacttgctacagaggagttgtgcaagcactacaccaaggactttggaattgaatgccgcattggaagattccataacatttacggtccttttggaacatggaaaggtggcagggagaaggcacctgctgctttttgcagaaaggctctgacttccaccgacaagtttgagatgtggggagatggacttcagacccgatcattcacctttattgatgaatgcgtggagggtgtgcttagattgaccaagtcagatttccgggagccagtgaacattggaagtgatgaaatggttagcatgaatgagatggctgagattgttcttagctttgaggacaggaagctccccatccatcacattcctggcccagaaggtgtccgtgggcgtaactctgacaacaccctgatcaaagaaaagctcggttgggctcctacgatgaggctaaaggatggcctgagaattacatacttctggatcaaggaacagatagagaaagagaagtctcaaggagttgacttgtccatttatggatcatctaaagtggtgggaactcaagcaccagttcaattgggttcacttcgtgctgctgatggcaaagagtgaagcagttgaaggtacgaagctctttcagtaatgttaaagaaagccgactatgagggtgtttatgagaatggaccgccttttagcttaagttactatttggtttctattttgtattatgttcctatatttaaggaagttatcatgctcccattttatcttttcctgttaaggtctcgggctttggtactgtaatttagcatttgttggcaatctttttctcatcaatgttgtatcttgtaatattaaagggctaagcttagcagctatcagtattcagtatagttgttatggaggaagctttgattctgcaaataaaaccctttgatttgggattac

SEQ ID NO: 1664 - DNA, 1327 bp, Ricinus communis
cttttctcctctgctcttattttgcattatcttcttttctcagacacccaatttccaggtcttacagtatgggaagcagtgaaggaaccaactatggggcttacacctatgagaaccttgagagggaaccttactggccatctgagaagcttcgaatttcaattactggtgctggtggttttattgcctcccacattgctcgccgtttgaagagtgagggccattacattattgcttccgactggaagaagaatgagcacatgacagaagatatgttctgtcatgaattccatcttgtggatctgagggtcatggataactgcttgaaggttactaagggtgtagaccatgtatttaaccttgctgctgatatgggtgggatgggtttcatccagtccaaccactctgtcattatgtacaacaacacaatgatcagcttcaacatgcttgaggcctctaggatcaatggagttaagaggctcttctatgcctctagtgcttgtatttaccctgaatttaagcaactggacactaatgttagcttgaaggagtctgatgcttggcctgcagagcctcaagatgcatacggcttggagaaacttgctacagaggagttgtgcaagcactacaccaaggactttggaattgaatgccgcattggaagattccataacatttacggtccttttggaacatggaaaggtggcagggagaaggcacctgctgctttttgcagaaaggctctgacttccaccgacaagtttgagatgtggggagatggacttcagacccgatcattcacctttattgatgaatgcgtggagggtgtgcttagattgaccaagtcagatttccgggagccagtgaacattggaagtgatgaaatggttagcatgaatgagatggctgagattgttcttagctttgaggacaggaagctccccatccatcacattcctggcccagaaggtgtccgtgggcgtaactctgacaacaccctgatcaaagaaaagctcggttgggctcctacgatgaggctaaaggatggcctgagaattacatacttctggatcaaggaacagatagagaaagagaagtctcaaggagttgacttgtccatttatggatcatctaaagtggtgggaactcaagcaccagttcaattgggttcacttcgtgctgctgatggcaaagagtgaagcagttgaaggtacgaagctctttcagtaatgttaaagaaagccgactatgagggtgtttatgagaatggaccgccttttagcttaagttactatttggtttctattttgtattatgttcctatatt

SEQ ID NO: 1665 - DNA, 1614 bp, Citrus sinensis
tcgacccacgcgtcttccaaagccagccattctcctcctcctttatcttctcctctttcattaaactctcaaagttcaggtgtttttcagaatgggaagttctgaaggaacctatggtgcatacacctatgaggagcttgagagggaaccttactggccttctgagaagctccgaatttctgtcactggggcaggtggttttattgcctcccacattgctcggcgtctgaagagtgaaggccattacattattgcctctgactggaagaagaatgagcacatgactgaggatatgttctgtcatgaattccaccttgttgaccttagggtcatggacaattgcttgaaagttactaagggggttgaccatgtgtttaaccttgctgctgatatgggtggtatgggctttattcagtccaaccactctgttatcatgtataacaataccatgatcagcttcaacatgcttgaggcttctaggatcagtggagtaaagaggtttttctatgcctccagtgcctgcatctatcccgaatttaagcagctggaaactaacgtaagcttgaaggagtctgatgcctggcccgctgagcctcaagatgcttatggcttggagaagcttgcaagtgaggagttgtgtaagcactacacgaaagactttggaattgagtgtcgtgttggaagattccacaatatttatgggccttttggaacatggaaaggtggaagggaaaaagctcctgctgctttttgccgaaaggctcttacttcaactgacaagtttgagatgtggggagatggacttcaaactcgatctttcaccttcattgatgaatgtgttgaaggtgtgctcagattgacgaagtcagacttccgtgagccagtgaacattggtagtgatgagatggttagcatgaacgagatggctgagattgttcttagctttgaggacaagaagctacctatccaccacattcctggccctgagggtgtccgtggtcgtaattcagacaacacactgatcaaagagaagcttggttgggcaccatcaatgaagttgaaggatgggctgagaattacatatttctggatcaaggaacagattgagaaggagaagactcaaggtattgacctatctgtttatggatcatcgaaggtggtaggaactcaagctccagttcagttaggctcacttcgtgctgctgatggcaaagaatgaagtggttgagccatacatctctcgtagttgccctcagaaaagccatgttttattatgctatttctagcaatcataattccatgttgtctttatgatataaagctatcattatgagttaaaaatttacttgtgtggagatttaggaacgcttcgagtttggaccattcttcaaattggtttctagtctgtactatgctgaagtgtctgggagaagcttttgcgctcacattgtattttacctagcttttcagtggaggctgctacagtaggatgatataagagcatttcccttttgtgtattatttgtcggtttgaaataaaaataatttcaattttatttccaagttgtttctgaatttatttgtcggtttgaaataaaaataatttcaatttta

SEQ ID NO: 1666 - DNA, 1556 bp, Hordeum vulgare
aattggcacgaggcataacccgatctagatcgcgggaagcccatcaatccatccagggccgcacaccgccgcctcctatcccgccaccccgacgagaaaaagggagaccacgccgccatcgccatcgccagtcgccacctcccccgcctcgttaccgccgccggcaccccctccccccgcaagcgcaagaatggggagcaccgacgagactggaactccctatggcgagtacacctatgctgagctggagagggagttgtactggccatccgagaagctgagaatctcggttactggagctggtggtttcattggatcccatattgctcgccgcctgaagagtgaggggcactacatcattgcctctgactggaagaagaacgagcatatgaccgaggacatgttctgccatgagttccaccttgctgacctcagggtcatggacaactgccttaaggtcaccaccaacgtcgaccatgtcttcaatcttgctgctgatatgggaggcatggggttcattcagtccaaccactctgttatcatgtacaataacaccatgatcagtttcaacatgcttgaggccgggcgtatcaacggtgtgaagaggttcttctatgcctcgagcgcatgcatctaccctgaattcaaacagcttgagacaaatgtgagcttgaaggaagctgatgcctggcctgctgagccacaagatgcctatggcttggagaagctcgcgaccgaggagctgtgcaagcactacaccaaggactttgacattgagtgccgtattggccgttttcacaacatttatggtccctttggaacatggaaaggcggtcgcgagaaggcaccagctgccttctgtagaaaggctcagacctccaccgaacggtttgagatgtggggtgatggtctacagactcgatcgttcacttttatcgacgagtgcgtcgagggtgttctgagattgacaaagtcagacttctgcgagcccgtgaacattggaagtgatgaaatggtgagcatgaacgagatggctgagattgttctcggcttcgaggacaagaagctacccatccaccacatccctggtccagagggtgtccgcggccgcaactctgacaacaccctcatcaaggagaagcttggctgggcccccacaatgaagctcaaggatggcctaaggttcacctacttctggatcaaggagcagatcgagaaggagaggaccgaggggaaggacgtcgcccggtacggatcatccaaggtggtgtccacacaggcaccggtgcagctgggctccctccgcgcggctgacggcaaggagtaaacaactatgcatatcaaccccaggcctattatgccactgcccaattgcccaccgatcggatccttcgttgcgaaaacacttgagaattgcacagcctgccctgcctaccccatgtgtgattcagcagattctagtgctcctgttcattgtcacccccattaattattatcatcgtgtcaacagaattcctcgtacatcacacttttgattggatgcacaataaaattcc

SEQ ID NO: 1667 - DNA, 1623 bp, Hordeum vulgare
aattggcacgaggcataacccgatctagatcgcgggaagcccatcaatccatccagggccgcacaccgccgcctcctatcccgccaccccgacgagaaaaagggagaccacgccgccatcgccatcgccagtcgccacctcccccgcctcgttaccgccgccggcaccccctccccccgcaagcgcaagaatggggagcaccgacgagactggaactccctatggcgagtacacctatgctgagctggagagggagttgtactggccatccgagaagctgagaatctcggttactggagctggtggtttcattggatcccatattgctcgccgcctgaagagtgaggggcactacatcattgcctctgactggaagaagaacgagcatatgaccgaggacatgttctgccatgagttccaccttgctgacctcagggtcatggacaactgccttaaggtcaccaccaacgtcgaccatgtcttcaatcttgctgctgatatgggaggcatggggttcattcagtccaaccactctgttatcatgtacaataacaccatgatcagtttcaacatgcttgaggccgggcgtatcaacggtgtgaagaggttcttctatgcctcgagcgcatgcatctaccctgaattcaaacagcttgagacaaatgtgagcttgaaggaagctgatgcctggcctgctgagccacaagatgcctatggcttggagaagctcgcgaccgaggagctgtgcaagcactacaccaaggactttgacattgagtgccgtattggccgttttcacaacatttatggtccctttggaacatggaaaggcggtcgcgagaaggcaccagctgccttctgtagaaaggctcagacctccaccgaacggtttgagatgtggggtgatggtctacagactcgatcgttcacttttatcgacgagtgcgtcgagggtgttctgagattgacaaagtcagacttctgcgagcccgtgaacattggaagtgatgaaatggtgagcatgaacgagatggctgagattgttctcggcttcgaggacaagaagctacccatccaccacatccctggtccagagggtgtccgcggccgcaactctgacaacaccctcatcaaggagaagcttggctgggcccccacaatgaagctcaaggatggcctaaggttcacctacttctggatcaaggagcagatcgagaaggagaggaccgaggggaaggacgtcgcccggtacggatcatccaaggtggtgtccacacaggcaccggtgcagctgggctccctccgcgcggctgacggcaaggagtaaacaactatgcatatcaaccccaggcctattatgccactgcccaattgcccaccgatcggatccttcgttgcgaaaacacttgagaattgcacagcctgccctgcctaccccatgtgtgattcagcagattctagtgctcctgttcattgtcacccccattaattattatcatcgtgtcaacagaattcctcgtacatcacacttttgattggatgcacaataaaattcccttttctcttgtcaacatttttaaactgatgccttgcccttggtgctttgttgtccaagttggccac

SEQ ID NO: 1668 - DNA, 1498 bp, Theobroma cacao
  misc_feature (1492)..(1492): n is a, c, g, or t
aatccatacccattcgtctcctatctcaagtttcctccctttctcgctccttgcatttatctcttctcttcaaaagttcccaacttttaactcgtttcagaatgggaagtgctgatgggaccaactatggtgcttacacctatgaggccctggagagggagccttactggccatctgagaaactccgaatttcaattactggggcaggtgggttcattgcatcccacattgctcgacgtctgaagagtgaaggccattacatcattgcttctgactggaagaagaatgagcacatgactgaagatatgttttgtcatgaattccatctcgcggatcttcgggtcatggacaattgcttgaaagttaccaatggagtggatcatgttttcaaccttgctgccgatatgggtgggatgggttttattcagtccaatcactctgtcattatgtacaacaacacaatgatcagtttcaacatgcttgaggctgctaggatcaacggagttaagaggtttttctatgcctccagtgcttgtatctaccctgaatttaagcagttggagactaatgtgagcttgaaagaatccgatgcctggcctgctgagcctcaagatgcttatggcttggagaagcttgcgacagaggagttgtgcaagcactacactaaagactttggaattgaatgtcgcattggacggttccacaacatttatggcccttttggaacatggaaaggtggaagggagaaggctccagctgccttttgcagaaaagctattacatccaccgacaagtttgagatgtggggagatggtcttcagacccgatctttcaccttcattgatgaatgtgtagaaggtgtacttagattgacgaagtctgatttccgtgagcctgtgaacattggaagcgatgagatggttagcatgaatgagatggctgagattgttcttagctttgaggataaaaagcttccaattcatcatatccctggtccagagggtgtccgtggtcgtaattcagacaatacattgatcaaagaaaaacttgggtgggctcctacgatgaggttgaaggatggcctgagaattacatacttctggatcaaggaacaaattgagaaagagaagtctcaaggcattgacctgactatttatgggtcatctaaggtggtgggaactcaagcaccagttcagttgggctcacttcgtgctgcagacggcaaagaatgaagtagcgtatagttgctttaaagccaagttttattatggtatagctatgctaatggcaatgaataggaatgcgtcaaccagtgtcaggttgactatttatttttggtatttagttggtgtactatggtcatcgtctaaggggaagcttatatgcccccactgtattcaaaggagctttccgtggtagcctgctgttgtaagatggtatgcttggcttgatagcctttaaataataaaattcgtttctgggtttaagcatngattca

SEQ ID NO: 1669 - DNA, 1515 bp, Eschscholzia californica
cacaagaagaatggattccattaatctataaatagtacagaaccttagcaggagggatccattcaagtttttttggagacacaaaagcatatcttcttctcttctttcaatcttctaattctaggtttttcagaatggggagtactggtggtgattatggtgaatacacatacgctgagttagtgagagagccttactggccttccgaaaagctaaagatttcgatcacaggagctggtgggttcattgcttcccacattgctcgtcgtttgaagagtgaaggtcactacattatagcctcagactggaaaaagaatgaacacatgactgaggatatgttctgtcatgagttccatcttgttgatcttagggttatggataactgtttgaaggttacttccggagtcgatcacgttttcaatcttgctgctgatatgggaggaatgggtttcattcaatctaaccattcagtcattatgtataacaacactatgattagtttcaatatgcttgaagctggtaggattaatggtgtcaaaaggttcttttatgcttctagtgcttgtatctaccctgaattcaagcagttggagactaatgtcagcttgaaggaagctgatgcttggcctgctgagccccaagatgcttatggtcttgagaagcttgcaactgaagaattgtgcaagcactacactaaagacttcggcattgaatgccgtattgggcgttttcacaacatttacggaccatttggtacatggaaaggtgggagagagaaagctccagctgcattctgtagaaaggctcaaacatccactgataagtttgaaatgtggggagatgggttgcaaaccaggtccttcaccttcatcgacgaatgcgttgaaggtgtcctcagattgaccaaatctgacttccgggagccagttaacattggaagtgatgagatggttagcatgaacgagatggccgagattgttctgggcttcgaggataagaatctcccaatccaccatattcccggaccagagggtgtgaggggtcgaaattccgacaacactctcattaaggagaaacttggatgggcaccgaccatgaggctcaaggatggacttcggttcacatacttctggatcaaggaacagattgagaaagagaaaaaccaaggaattgatctttccgtttacggatcttccaaagttgtcggaacacaagcacctgttcaactcggatccctccgtgcagctgacggcaaggaatgaagtttgagtggtctaaattttcttacttccatgaaccgagtggccaagcctttcgaccagtatcgggttatttctgtattaaggaagatttgggtatgaaacaataactcagactgcaaacctgtttgcaagttcctgttctttttctttcagggtttaagagtggttgttttaaatattgttctttgctcaagctttagctgagcttctattgttgcactgtgtaattccaagtaatatatcttgcatttat

SEQ ID NO: 1670 - DNA, 1513 bp, Petunia hybrida
atcttcatctattaacccttcaactctccttatctctccattttccagccaacttttagagaatgggaagctctggtggcattgactatggtgcttacacctatgagaatcttgagagggaaccttactggccatccgagaagctccgtatttctataactggggccggaggatttattgcttctcacattgctcgtcgtttgaagagtgagggccactacataattgcctctgattggaagaagaatgagcacatgacagaagatatgttctgtcatgagtttcatcttgcggatcttagggtcatggataattgcttgaaagttacaaaaggagttgaccatgtcttcaaccttgctgctgatatgggtggcatgggcttcattcagtccaaccactcagttattttctataacaacactatgatcagcttcaacatgatggaagctgctaggattaatggtgtcaaaaggttcttctatgcatctagtgcttgcatttaccctgagtttaaacaactcgaaacaaatgtcagcctgaaagaatctgatgcatggcccgcagagcctcaagatgcatacggcttggagaagcttgcaacagaagaattatgcaagcattacaataaggattttggaattgaatgccgtattggaaggttccacaatatctatggtccatttggaacttggaaaggtggacgggaaaaagctcctgctgctttttgtagaaaagcccaaactgctacggataagtttgaaatgtggggggatggacttcaaacacgttcattcaccttcattgatgagtgtgttgaaggggttcttagattgacaaagtccgacttccgggagccagtgaacattggaagtgatgagatggtcagcatgaatgagatggctgagattgttcttagctttgaggacaagaagcttcccatccaccacattcctggccccgaaggtgtccgtggtaggaactctgacaacacactgataaaggagaagcttggttgggctcctacaatgagattgaaggatggtttgagatttacctacttctggatcaaggagcagatcgagaaagagaaatctcaaggagttgatattggaacttatggatcctctaaggtggtgggcacccaagctccagttcaacttggttcacttcgtgctgctgatggcaaggaataagttcatccgttctgttagtttctcaatgggaagccaatcgatgctatgacattgctgcattttataatatgatgtcgtagaagaatgcattaaaattttcataattgttgtcttttccccttggcttgtgaaggggatagttgctttagctgtataaatcagccgtttgagaagatatctatctgttaattgaataaccagtacatcctttatgttgttcaagatctagctgttctaagatatgcgagacttcaatgcaaagctcttgctcaagtagcaatgggactcataatttgtcaaggatattgaaatatggaagg

SEQ ID NO: 1671 - DNA, 1565 bp, Cleome gynandra
atatataaatacatctcctccactcctgcaaaattgtacctttccatcgcttcgctcacctttcttctgcgttctccttcaccctatctgatctcttcgaagcttttcagcatgggaagcaacaatggaaccgaatatggtgcctacacttacaaggagcttgaaagagagccctattggccttctgagaagttaaggatatcaattactggtgctggtggtttcattgcatctcacattgctcgtcgtttgaagaacgagggccattacattattgcttctgactggaagaagaacgagcacatgactgaggacatgttctgccatgaattccaccttgttgatctcagggtgatggacaattgcctcaaggtcaccaagggagttgatcatgtctttaacttagctgctgatatgggtggtatgggttttatccagtccaaccactctgttatcatgtataacaacacaatgattagcttcaacatgatcgaggctgctaggatcaatggggttaagaggtttttctatgcgtcaagtgcgtgtatctacccagaattcaagcagctggatactaatgtgagcctgaaggagtcagatgcttggcctgcagagcctcaagacgcgtatggattggagaaacttgcaactgaggagttatgtaagcactacaacaaagattttggaattgagtgccgcattggaaggttccacaacatctatggtccttttggaacatggaagggtggaagggagaaggctccagctgctttctgcagaaaggctctcacttccaccgataggtttgagatgtggggagatggacttcagacccgttcttttaccttcatcgacgagtgtgttgagggtgtgcttaggttgacaaaatcagacttccgtgagccagtaaacatcggaagcgatgaaatggttagcatgaatgaaatggctgagatggttctcagttttgaggacaaaaagcttcctattcaccacatccctggcccagaaggtgtccgtggtcgtaactcggacaatacactgatcaaggaaaagcttggctgggctcccactatgagattgaaggatgggcttagaatcacatacttctggatcaaggaacagattgagaaagagaagtctcagggtggtgatgtgtcggcatatgggtcatccaaggttgtgggaactcaagctccggttcagttgggctcactccgggccgctgatggaaaagagtgaaaggttccagcttttgtgaatcctcttacaggaaggcaatatctaaagggttagctagtgttttcgttatctcccggttgtgctttctggtcaagctcttccatacatccacaaacttttccaatcttataatgatacatatattattagggtatagctttggaaaggaaggcataattaagtgttgagttgggttttcattctcctctgttattctttagtagtatgctctttcctcactgcggagtttcaaacctcgtttcttgtcaaagctgtggttttttgttattctatcggaaaagtttgttcttttgcctgcccta

SEQ ID NO: 1672 - DNA, 1462 bp, Gossypium hirsutum
catctcctgtctctgttttgcttccatttctttcttcaattatcttttctcttcaaagatttcaactcttttctcagaatgggaagtaccgatgggaccagctatggtgcttacacctatgatgccctggagagggagccttactggccatccgagaaacttcgaatttccatcaccggtgctggtggcttcatcgcttcgcacatcgctcgacgtctgaagagtgaaggacattacatcattgcttctgattggaagaagaatgagcacatgacagaagatatgttctgtcacgaattccatcttgtcgatcttcgagtgatggaaaattgcttgaaggttaccaatggagtggatcatgttttcaaccttgccgctgatatgggtggcatgggcttcatccagtccaaccactctgtcattatgtacaacaacacaatgatcagtttcaacatgctcgaggctgctcgaatcagtggagttaagaggtttttttacgcctccagtgcttgtatctatcctgaatttaagcaattggaaactaatgtgagcttgaaagaatccgatgcctggcctgctgagccacaagatgcttacggcttggagaagcttgcaacagaggagttgtgcaagcattacaccaaagactttggaattgaatgtcgcattggaaggttccacaacatttacggcccttttggaacttggaaaggtggaagggagaaggctccagctgccttttgcagaaaggctattacttccattgacaagtttgagatgtggggagatggtcttcagacccgatctttcactttcattgatgaatgtgttgaaggtgtacttagattgacaaagtctgatttccgtgagcctgtgaacatcggaagtgatgagatggttagcatgaacgagatggcggagattgtgcttagctttgaagataaaaagcttccaatccaccatatccccggtccagagggtgtccgtggtcgtaattcagacaatacattgatcaaagaaaaacttggttgggcccctacaatgaggttgaaggatgggctgagaattacatacttctggatcaaggaacagattgagaaagagaaggctcaaggcattgatctatctgtttacggatcatctaaggtggtaggaacccaagcaccggtccagctcgggtcacttcgtgctgctgacggcaaagaatgaagtaaacttgctttggaaccaagttttattatgatatagctatgctagtggcattgaatccaaaaagtatcaaccaatatcaggtaagattatttattttgtcgtatttagtttgtgcactatgatctttgtccaaggggaagcttttatgtttccactgtatccaaaatagcttgctgttgtaagttgatatgcttaggcttttatagcctttatataataaaatttctttctgcatttgagtattggattc

SEQ ID NO: 1673 - DNA, 1478 bp, Vitis vinifera
gcgtgcattttgtgtataagagaggcgttacaagagcatacaccctcacaaccattcactcccttgagagcttcacattatcttcttcttctaaatctcgagaatgggaagtaacgatggaaccacttatggtgcgtacacctacggggagcttgagagggaaccatactggcaatctgaaaagctccggatttcaatcactggtgctggtggttttattgcctctcacattgctcggcgtctgaagaccgagggccactacattattgcttctgactggaagaagaacgagcacatgactgaagatatgttctgtcatgaatttcatcttgttgatctcagggtgatggataactgcttgaaggtcactactggagttgaccatgtgtttaaccttgctgctgatatgggtggaatggggttcatccagtccaaccattcagttattatgtacaataacacaatgatcagcttcaacatgcttgaggcgtctaggatcaatggggttaagaggttcttctatgcctctagtgcttgcatctaccctgaatttaagcagttggaaactaatgtgagcttgaaggagtctgatgcatggcctgcagagcctcaagatgcttatggattggagaaacttgctacggaggagttgtgtaagcattataccaaagactttggaattgaatgccgcattggaagattccataacatttatggaccttttggaacatggaaaggtgggagagagaaggctcctgctgctttttgccgaaaggctctcacttccaccgacaagtttgagatgtggggagacggacttcaaactcgttctttcaccttcattgatgaatgtgtagaaggtgttctcaggctgacaaagtcggacttccgggagccagtgaacattggaagtgatgagatggttagcatgaatgagatggccgagattgttctcagctttgagaacaagaaccttcccatccatcacattccaggcccagagggtgtgcgtggtcgtaactcagacaacacactgatcaaagagaagctcggttgggctccaacaatgaaattgaaggatgggctgagaattacatacttctggatcaaggaacagattgagaaagagaaagttcagggcattgatctgtctatttatgggtcatccaaggtggtgggtacccaagccccggttcagctaggctcacttcgtgctgctgatggcaaagagtgaagctgttgaggccaacagctctggtagcttatgccataaaagcttactatcagctaccatgttccattgaaatgataagatatctatagcatcttcctggttccatggctactatttcagtctgtttaagtccatctgtacaagggaaacttctgttctcccattttattttgtttagcttttcagagtgatgctccattgtagtgtgatatggtaccttctgaataaaatttcttattcccta

SEQ ID NO: 1674 - DNA, 1722 bp, Carica papaya
agaggcaaattagaacgagtggctttatttcttctacttcctcctccctttctcctctgctctgcctttatatacctgctcgccttcctgcattatcgtttattctccatctctcgcatcttcaatccccttcctctccctctccctctctctctttccctctccagaatgggaagcaatgatggaactgattatggtgcatacacctacaaggaactcgaaagggagccctattggccgtctgagaagcttcgaatttcgattactggggcaggtggtttcattgcctcccatattgctcgtcgtttgaaaagcgagggccattacataattgcttcagactggaagaagaatgagcatatgactgaggatatgttctgtcatgaattccaccttgttgatctcagggttatggacaattgcttgaaggttactaagggagttgatcatgtgtttaaccttgctgctgacatgggtgggatgggattcatccagtccaaccactcggtcattatgtataacaataccatgatcagcttcaacatgcttgaggcttccaggattaatggagtcaagagatttttctatgcatccagcgcgtgtatctatcctgaatttaagcagctagaaactaatgtgagcttgaaggagtctgatgcttggcctgcagagcctcaagatgcatatggtttggaaaagcttgcgactgaggaattatgcaagcactatacaaaagatttcggaattgagtgtcgtattggaagattccataacatttatggtccttttgggacgtggaaaggtggaagggagaaggcaccggctgctttttgtagaaaggctatcacttccactgacaagtttgagatgtggggagatggaattcaaactcgctctttcaccttcatcgatgaatgtgttgaaggtgtcctcagattaacaaagtcagatttccgtgagccggtaaacattggaagtgatgagatggttagcatgaatgagatggctgagattgttctcagttttgagaacaaaaagcttcccatccaacacattcctggcccagagggagtgcgaggtcgtaattcggacaatacactgataaaagagaagcttggctgggctcctacaatgaagttgaaggatgggctaagaattacatacttctggatcaaggaacaaattgagaaagagaaatctcagggtattgatctgtctatttatggatcatctaaggtggtgggaactcaagcaccggttcagttgggctcacttcgtgctgctgatggcaaagagtgaagaaattggtatcccatgttctttcatggtacgactagcgtatactataggataagaaggcatctatggttatagaccattatcaggctgactagtatttgtccatttgtttagtatccgttgttgtaaggggagctttttatactgctgctgtatttagttgatctattacagaggagcataaaaatttctgcagtctttaaatatctaaaatgtattcctgtcaagaagagtctaagatttcagttccttgctttaatgaaccaatatgttctccagttacatttctttatatattctgtagtagcaggctgatttcagttttcaagaaatcaacttgttatctacatgaacataaagctgttgtgcttttggcttgacattatagtacaaaaatgaagagcttctgcttcttcttttccc

SEQ ID NO: 1675 - DNA, 1597 bp, Triticum aestivum
atcgcgggaagtccatccatccacccacccacccagggccgcacaccgccgcctcacctcctttgtccccctcccgccagctccacgagaaaaaggtagaccacgccaccgccgccgccgccgccgctgtcatcgccggctccgcctccttcccgccgccgactgtcccgacaactcccgcaagaatggggagcaccgacgagactgggactccctatggcgagtacacctatgctgagctggagagggagctgtactggccatccgagaagctgaggatctcggttactggagctggtggtttcattggatcccatatcgctcgccgcctgaagagtgaggggcactacatcattgcctctgactggaagaagaacgagcatatgaccgaggacatgttctgccatgagttccaccttgctgacctcagggtcatggacaactgccttaaggttaccaccaacgtcgaccatgtcttcaatctcgctgctgatatgggaggcatgggcttcattcagtccaaccactctgttatcatgtacaacaacaccatgatcagcttcaacatgcttgaggccgggcgtatcaacggcgtgaagaggttcttctatgcctcgagcgcatgcatctaccctgaattcaaacagcttgagacaaatgtgagcttgaaggaagctgatgcctggcctgctgagccacaagatgcctatggcttggagaagctcgcgaccgaggagctgtgcaagcactacaccaaggactttgacatcgagtgccgtattggccgttttcacaacatttacggtccctttggaacatggaaaggcggtcgtgagaaggcaccagctgccttctgtagaaaggctcagacctccaccgaacagttcgagatgtggggtgatggtctccagactcgatcgttcacttttatcgacgagtgcgtcgagggtgttctgagattgacaaagtcagacttctgcgagcccgtgaacatcggaagcgatgaaatggtgagcatgaacgagatggctgagattgttctcggcttcgaggacaagaagctgcccatccaccacatccctggtccagaaggtgtccgtggccgcaactctgacaacacactcatcaaggagaagcttggctgggcccccacaatgaggctcaaggatggcctaaggttcacctacttctggatcaaggagcagatcgagaaggagaggaccgaggggaaggacgtcgccctgtatggatcgtccaaggtggtgtccacacaggcgccggtgcagctcggctccctccgcgcggctgacgggaaggagtaaactatgcagatcaacgccaggcctattatgccactgcctgtcgaacggatccttccatgcgaaaaacattcagagaatagcacagcctgccctacctacctcatgagcgattttagcagattcatgcgcgattatctttgtgtcaccgaattcctgggataccaaacttttgattggatgaagaataagatcccccttttttactttgaagctgagctgtattgtgtgctttgttgtccagatctggccatctggtcaaacaattggtcactaga

SEQ ID NO: 1676 - DNA, 1551 bp, Triticum aestivum
cagggccgcacaccgccgcctcgcctcctttgtccccctcccgccagccccacgagaaaaagggagaccacgccgccgcctccttcccaccgccgacgactgccccgacacctccggcaagaatggggagcaccgacgagactggaactccctatggcgagtacacctatgctgagctggagagggagctgtactggccatctgagaagctgagaatctcggtcactggagctggtggtttcattggatcccatattgctcgccgtctgaagagtgaggggcactacatcattgcctcagactggaagaagaacgagcatatgaccgaggacatgttctgccatgagttccaccttgctgacctcagggtcatggacaactgccttaaggtcaccaccaatgtcgaccatgtcttcaatctcgctgctgatatgggaggcatggggttcattcagtctaaccactctgttatcatgtacaacaacaccatgatcagtttcaacatgcttgaggccgggcgtatcaacggcgtgaagaggttcttctatgcctcgagcgcatgcatctatcctgaattcaaacaacttgagacaaatgtgagcttgaaggaagctgatgcctggcctgctgagccgcaagatgcctatggcttggagaagctcgcgaccgaggagctgtgcaagcactacaccaaggactttgacattgagtgccgtattggccgttttcacaacatttacggtccctttggaacatggaaaggcggtcgtgagaaggcaccagctgccttctgtagaaaggctcagacctccaccgaacagttcgagatgtggggtgatggtctccagactcgatcgttcacttttatcgacgagtgcgtcgagggtgttctgagattgacaaagtcagacttctgcgagcccgtgaacatcggaagcgatgaaatggtgagcatgaacgagatggctgagattgttctcggcttcgaggacaagaagctgcccatccaccacatccctggtccagagggtgtccgtggccgcaactctgacaacaccctcatcaaggagaagcttgggtgggcccccacaatgaggctcaaggatggcctaaggttcacctacttctggatcaaggagcagattgagaaggagaggaccgaggggaaggacgtcgccctgtatggatcgtccaaggtggtgtccacacaggcgcccgtgcagctgggctccctccgcgcggctgacggcaaggagtaaacaagtatgcagatcaacgccaggcctattatgcgccactgcccatcgatcggagccttccttgcaaagacattcagagagaatagcacagcctgtcctacctaccccatgcgcgatttttagcagattctagtgctcctattcattgtcgcccccgtcaattattatctttgtgtcaccgaattcctggtataccgaacttttgattggatgaagaataagatccccttttctatttgaagctgagctgtattgtgtgttttgttgtccagatctggccatctggtcaaac

SEQ ID NO: 1677 - DNA, 1484 bp, Triticum aestivum
acccagggccgcacaccgccgcctcacctcctttgttcccctcccgccagcccgacgagaaaaagggagaccacgccgccgccgccgactgccccgacacctccggcaagaatggggagcaccgacgagactggaactccctatggcgagtacacctatgctgagctggagagggagttgtactggccatctgagaagctgagaatctcggttactggagctggtggtttcattggatcccatattgctcgccgcctgaagagtgaggggcactacatcattgcctctgactggaagaagaacgagcatatgaccgaggacatgttctgccatgagttccaccttgctgacctcagggtcatggacaactgccttaaggtcaccaccaacgtcgaccatgtcttcaatcttgctgcggatatgggaggcatggggttcattcagtccaaccactctgttatcatgtacaacaacaccatgatcagtttcaacatgcttgaggccgggcgtatcaacggtgtgaagaggttcttctatgcctcgagcgcatgcatctaccctgaattcaaacagcttgagacaaatgtgagcttgaaggaagctgatgcctggcctgctgagccacaagatgcctatggcttggagaagctcgcgaccgaggagctgtgcaagcactacactaaggactttgacatcgagtgccgtattggccgttttcacaacatttacggtccctttggaacatggaaaggcggtcgcgagaaggcaccagctgccttctgtagaaaggctcagacctccaccgaacagttcgagatgtggggtgatggtctccagactcgatcgttcacttttatcgacgagtgcgtcgagggtgttctgagattgacaaagtcggacttctgcgagcccgtgaacattggaagcgatgaaatggtgagcatgaacgagatggctgagattgttcttggcttcgaggacaagaagctgcccatccaccacatccctggtccagagggtgtccgcggccgcaactctgacaacaccctcatcaaggagaagcttggctgggcccccacaatgaggctcaaggatggcctaaggttcacctacttctggatcaaggagcagatcgagaaggagaggaccgaggggaaggacgtcgccctgtatggatcatccaaggtggtgtccacacaggcaccggtgcagctgggctccctccgcgcggctgacgggaaggagtaaactatgcagatcaacgcgagatctactatgccactgcccatcgaacggatccttccttgcgaaaaagattcagagaattgcacagcctgccctaactaccccatgcacgatttcagcagattcaagtgctcctattcatcgtcgcccccattaattattatctttgtgtcaccgaattccctgggataccgaacttttgattggatgaagaataagatcccctattttactttgaa

SEQ ID NO: 1678 - DNA, 1586 bp, Vitis vinifera
gtaagatctgtagaaagtttctcctacttcaattttctctcaacttgtctcaatcttgcaagaatgggaagtactgagggaaccacatatggggagtacacctatgagaacctggagagggagccctactggccttcagaaaagctccggatttccattactggagcaggtggattcattgcctcgcatattgcgcggcgattgaagactgagggccattacattattgcgtctgattggaagaaaaatgaacacatgcctgaggacatgttctgtcacgagttccaccttgttgatcttagggtgatggataattgtttgaaggtcacaactggagtagatcatgtgttcaaccttgctgctgatatgggaggtatgggcttcattcagtccaatcactctgttatcatgtataacaacacaatgattagcttcaacatgcttgaggcttcaagaatcaatggggttaagaggtttttctatgcatccagcgcttgtatttatcctgaatttaaacagttggaaactaatgtgagcttgaaggagtctgatgcttggcctgccgagcctcaagatgcctatggcttagagaagctcgcaactgaggagttatgcaagcactacactaaggactttggaattgagtgtcgcattggacggttccataatatatatggaccttttggaacatggaaaggtgggagagagaaggctcctgctgcattctgtaggaaggccatcacatccactgacaagtttgagatgtggggagatgggctgcaaactcggtctttcaccttcattgatgaatgtgtagaaggtgtcctgagattgacaaagtcagacttccgggagccagtgaatattggaagtgatgaaatggttagtatgaatgagatggctgaaattgtcctaagctttgagaataagaatctacccatccatcacattcctggcccagagggtgtacgtggtcgaaactcagacaataatctgatcaaggagaagcttggttgggcccctaccatgagattgaaggatgggctgagaattacatatttctggatcaaggaacaaattgagaaagagaaagttcaaggaattgatttgtcagtctatgggtcatcaaaagtggtgggaacacaagcacctgttcaactgggttctcttcgtgctgctgatggtaaagagtgaagtttgtttcatgcccctttggaagacaaagtcctataatcaattccaccagattttgatgggatggatcacctgggtatggataattttcagattgctagctactatttggcttttatgttaagtacttcatatgtagaaggatgcctccagtctggttgtatcttctaggttcctggagaaagtgacctcttttgtaccattatatatgctttaagaactatatcttgcatctctttaaaataatgtaatatggtcctgtttttctatttttgtgaggccctttcttttatttggataaagccttcctgcaagtcattgtctaggaagcattgtaaccgttaaatgtcaattataataaatggcattcttttttgcctttgtagttgaaa

SEQ ID NO: 1679 - DNA, 1472 bp, Manihot esculenta
tatgggaagcactgatggaaccagctatggggctttcacctatgagaatctggagagggaaccatactggtcatctgagaagctccgaatttccattactggggctggtggttttattgcctcccacattgctcgtcgtttgaagagtgaaggccattacattattgcttctgactggaagaagaatgagcacatgacagaagatatgttctgtcatgagttccatcttgtggatctaagggtcatggataattgcttgaaggtaacaaaggatgtagaccatgtgtttaaccttgctgctgatatgggtggcatgggcttcattcagtccaaccactctgtgattatgtataacaatacaatgatcagcttcaacatgcttgaggctgctaggattaatggagttaagaggttcttctatgcctctagtgcttgtatttatcctgaatttaagcagctggacactaatgtgagcttgaaggaatctgatgcctggcctgcagagcctcaagatgcatatggcttggagaaacttgctacagaggagttgtgcaagcactacacaaaggactttggaattgaatgccgtattggaaggttccataatatttatggtccttttggaacttggaaaggtggcagggagaaggcacctgctgctttttgtagaaaggctatcacttccactgataagtttgagatgtggggagatggacttcaaacccggtcctttacctttattgatgaatgcgtggaaggcgttcttagattgactaagtcagactttcgagagccagtgaacattggaagtgatgaaatggtcagcatgaatgagatggctgagattgttctcagctttgaaaacaagaagcttccaatccatcacattcctggtccagaaggtgtccgaggccgtaactcagacaacactcttatcaaagagaagcttggttgggctcctacaatgaaactgaaggatgggctgagaattacgtacttctggatcaaggaacaaatagaaaaagagaaagctcaaggtattgacttgtccatttatggatcatccaaagtggtgggaactcaagcgccagttcagttgggttcacttcgcgccgctgatggcaaagaatgaagcagttgaagctacaaagccgtaattttctacatgttgtggatatctatggtttggttgtgaagtagtagagggtattcgagtatggatcattatcagcttaaactctttggtttttgtattttgaactgtgctgctgcatttcagggggagttgctttgctcccattttatcatcagatgtttagcaacctgttgtttttggtatttgtatatttggcaaaataatctcagacatgttgaatcttgtgaaatctaatcatgtgggattgttatggagacagctgcaattctgggaataaaatccttcaattagaggctgcaaaattaaattatgcctt

SEQ ID NO: 1680 - DNA, 1668 bp, Cycas rumphii
  misc_feature (1661)..(1662): n is a, c, g, or t
gcagtgttggacgtggatcacgaggcttgttcggcgtctacttactgttctctgaggggtctgttaacttcattgggcatcatgggtagcgccggaaatgatggagtggtctatggggcgtacacctatgagaatctggaaagagaactgtactggccgagtgaaaaacttaggatttccatcaccggagcaggtgggttcattgcctctcatatagccaggagactgaagtctgagggccactacatcattgcctctgattggaagaagaatgagcacatgactgaagatatgttctgtcatgaattccatttggtggatctcagagttatggataattgcttggctgtgactaaaggggttgaccatgtttttaacctggctgctgacatgggtggcatgggatttattcagtccaatcattctgttatcatgtacaacaataccatgatcagctttaatatgctggaagctgccagaatcaatggggtgaagagattcttctatgcttccagtgcttgcatctatccggagttcaaacaattggaaacaaatgtgagcttgaaagagtctgatgcttggccggctgagccccaagatgcctatggcttggaaaagcttgcgactgaagaattgtgcaaacactacaccaaagactttggtattgaatgccggattggtcgtttccacaacatttatggtccttttggcacatggaagggtggacgggagaaagcacctgctgctttttgcaggaaggcaatcacatctactgacaagtttgagatgtggggtgatggggttcaaacacgatccttcacgttcattgacgaatgcgtggagggtgtattgaggttgactaagtcagacttcagagaacctgtaaacattggtagtgatgaaatggtgagcatgaatgagatggctgaaatagtgctgagctttgagaacaagaagctaccaattcatcacattcctgggccagagggtgtacgaggtcggaattcagacaataccctgatcaaggaaaaattgggctgggctccaaccatgaggctgaaggatggcctgaggatcacatacttctggatcaaggaacaaattgaaaaggaaaaggctcagggcattgatctctccatctacggatcttctaaggtggttggtactcaagctcctgttcagctaggttctcttcgtgcagccgatggaaaggagtgaaggaaaccttgatttctcataggatgcaagtaaaggattcaacagttgaaagatctgcttgaagtcttttagggttatgactttgagcatgtaggaatggctgcaatatttcatgattttagaaatgcaatagtttggactgctgtttaggaatcactgtatcttgtttccaagcagctttaccagttctcatttctagctcaataagttgaaacatacatttagtaggagtgttgatggggagggtggtgccattgctgcaatggaatttatgttcaatatgcacatgccatgtctggcacaatttctgattttgtttgatgttttggattgaactctagctgcagaataatcccttgtaatgtgggaaggtgattttagggtatgtgtgttacagagctcatgctgttgtgcaaatattcagccctaatgcttaaggcaannttattt

SEQ ID NO: 1681 - DNA, 1451 bp, Actinidia deliciosa
cgtcttgagagatagagagatttactttgggagagcgaaatttatagctacggcactcgatctctttcagaatgggaagcaccagtgaatctaactacggatcgtacacctatgagaacctcgagagggaaccctactggccggaggcgaagctccgcatctccattactggagccggtgggttcattgcctcgcacattgcaaggcgactgaagggcgaggggcattacatcattgcttctgactggaagaaaaacgagcacatgaccgaggacatgttttgtcacgagttccatctcgttgatctcagggtgatggacaactgcttgaaagtcacgaccggagtcgatcatgtgttcaatcttgctgctgatatgggtggtatgggattcattcagtccaaccactcggtcattatgtataacaacacaatgatcagcttcaacatgcttgaagcagctagggtcaatggtgttaagaggttcttttatgcttctagcgcttgtatttatcctgaatttaagcagttggacactaatgtgagcttgaaggagtctgatgcttggcccgctgagcctcaagatgcttatggtttagagaagcttgcaaccgaggaattatgcaagcactacaccaaggactttggcattgaatgtaggattggaaggtttcataacatttatggaccttttggcacatggaaaggtggaagggagaaagcccctgctgcattctgcagaaagacccttacctccactgataggtttgagatgtggggagacggtctgcaaacccgatctttcaccttcattgatgaatgtgtcgaaggtgtcctaagattgacaaaatcagacttcagagaaccagtgaatataggaagcgatgagatggtcagcatgaatgagatggccgagatcgttctcagcttcgaggacaagaagctgcccatccatcacattcctggcccagagggggtccgtggtcgaaactcggacaacaccctgattaaggagaagcttgggtgggccccaactatgaaactgaaggatgggctgaggttcacatacttctggatcaaggagcaacttgagaaagagaaggctcagggcatcgatctgtcaacttatggatcgtcaaaagttgtgggaacgcaagccccggttcagttgggctctcttcgtgctgctgatggcaaagaatgaagcagataagaatctgtccagtgaaatcgagggcaaggtttaatttatgattgttttagtgggatttatgcatatgggttgtcgtttaaattgcaatctgctgtttctttctgccataattattattgtacgtcgaaagacaccctgctcttggatttcgtatcttctttggagagtagacttctgttgtatgatgatgatttatcgtttgaggaatgtatttcccttcacatggtctaaaaaaaaaaa

SEQ ID NO: 1682 - DNA, 1663 bp, Cucumis sativus
gcaccacgccattcgattcgacccttttcctcttatcaccatttatctctacacatttcatcttcttcccttgttgtacctagttcaaccgtcgatttctgcccttttttgctgataaaaacacccaaattcccaattccattttgtgggtttcctctaccttcttttcttcatttctagattttcttcttttcgttttttgggatttttttggtgttttcccttcagatttagggtttgaattactgggttgttcttgatttcttgttgtctttattggaatggggagcgcaggggaaaccacttatgggtcgtacacttatcaggagcttgaaagagaggcttattggccatcggagaaactgagaatctccatcactggagctggtgggtttattgcttctcacattgccaggcgtttgaagagcgaagggcactacatcattgcttctgactggaagaagaatgaacacatgacagaggatatgttttgccatgaatttcatcttgttgatctcagagtgatggataattgtatgaaggtgactgagaatgttgaccatgtcttcaatctggctgctgatatgggtggtatgggcttcatccagtccaaccactcagttattatgtataacaacaccatgatcagcttcaatatgcttgaagctgcaagaatcaatggggttaagaggtttttctatgcttctagtgcttgcatctatcctgaatttaagcaattggaaactaacgtgagcttgaaggagtcagatgcctggcctgctgagcctcaagatgcctacggtctggagaagcttgctacagaggagttgtgcaaacattatactaaggattttggtattgagtgccgaattgggaggttccataacatttatggcccatttggaacatggaaaggtggaagggaaaaggctcctgctgcattttgcagaaaggccctcacttctgtagacaagtttgagatgtggggagatggtcttcagacaagatctttcactttcattgatgaatgtgtagaaggtgtcctgagattgactaagtcagacttccgtgagccagtgaatattggaagcgatgagatggttagcatgaatgaaatggcagaaatcgtgcttagcttcgacgacaaaaaacttccaattcatcacatccctggtcccgagggtgtccgtggtcgtaactcagacaacacactcattaaagagaaacttgggtgggctcccacgatgaagttgaaggatggattgagaattacctacatgtggatcaaggagcagattgaaaaagagaagtctaaaggcattgacctgacagtttatggatcatcaaaggttgttggtacccaagctccggttcaactcgggtcactccgtgccgctgatggtaaagagtaattagttagttagttccagataatctattcggcctgcatcggacgacccgagctatatagtaaatgttatcaaaagttgttatttacccctccccacctcctttctgtagtattatgatgcttactggatgccctaaatatgcctttctattctattcaattttatcactgccctttcctcccccatcctaatgatcctttaagtaggaaatattatagttctctctttcaccaagtggactataatagttc

SEQ ID NO: 1683 - DNA, 1769 bp, Manihot esculenta
atggaagtgaaattaaagattatattcagccagaaaaatgaaaaaaagataaaatagaaattagtggcccttctcccagtctcttactctgtttcattctgtatccaacctgcctttactctatatatggcatgagagttatggccttctgaatcacaccctctctcactctctatttgagcatctcttcgcttcttccccttctaacattttctccttctcttttgtaaaagtttcaaaaacagaattttgaggcttcacagtatcagtatgggaagcactgagggaaccaactatggggcttttacctatgagaatcttgagagggaaccttactggccatctgagaagctccgaatttccattactggggctggtggttttattgcctcccacattgctcgccgtttgaagagtgagggccattacattattgcttctgattggaagaagaatgagcacatgacagaagatatgttctgccacgaattccatctggtggatctaagggtcatggataattgcttgaaggtgacaaaggatgtagaccatgtgtttaaccttgctgctgatatgggtgggatgggcttcatccagtccaaccactctgtcattatgtataacaacacaatgatcagcttcaacatgcttgaggctgctaggatcagtggagttaagaggtttttctatgcctctagtgcttgtatttaccctgaatttaagcagctggatacaaatgtgagcttgaaggaatctgatgcctggcctgcagagcctcaagatgcatatggcttagagaaacttgctacagaggagttgtgcaagcactacacaaaggactttggaatcgaatgtcgtattggaaggttccataacatttacggtccctttggaacttggaaaggtggcagagagaaggcacctgctgctttttgcagaaaggctatcacttccatcgacaagtttgagatgtggggagatggacttcaaactcgatccttcacctttattgatgaatgtgtggaaggtgtgctgagattgaccaagtcggatttccgagagccagtaaacattggaagtgatgaaatggttagcatgaatgagatggctgatattgttctcagctttgagaacaagaagctccctatccatcacattcctggcccagaaggtgtacggggccgtaactcggacaacactctgatcaaagagaagcttggttgggctcccacaatgaagctgaaggatggcctgagaattacatacttctggattaaggaacagattgagaaagagaaggctcaaggtatagatttgtccatttacggatcatctaaagtggtgggaactcaagcaccagttcaactgggttcacttcgggctgctgatggcaaagaatgaagtagttgaagttacaatgcccgtccagttgtgaataagaagctgaaattttctatatgatatggttatggatatgcagtattgcacttgtaagttgtctatggttgtggagcagtagggtggtatttgagtaagctcccatcattagcttaaattattcggttcttagtttgtctcaggttgctacatttcagcgaagttgtcattctctcatttcatcaaatgtcttgcttttgctttggcaatagttggctaaattctatcgctcatgttgaatattgtgataccaaagagcaaagcctcgcagctattagtggaattgttgggaaggcagctgcaattctgcgaataaaatcctccgatttgag

SEQ ID NO: 1684 - DNA, 1770 bp, Manihot esculenta
gatggaagtgaaattaaagattatattcagccagaaaaatgaaaaaaagataaaatagaaattagtggcccttctcccagtctcttactctgtttcattctgtatccaacctgcctttactctatatatggcatgagagttatggccttctgaatcacaccctctctcactctctatttgagcatctcttcgcttcttccccttctaacattttctccttctcttttgtaaaagtttcaaaaacagaattttgaggcttcacagtatcagtatgggaagcactgagggaaccaactatggggcttttacctatgagaatcttgagagggaaccttactggccatctgagaagctccgaatttccattactggggctggtggttttattgcctcccacattgctcgccgtttgaagagtgagggccattacattattgcttctgattggaagaagaatgagcacatgacagaagatatgttctgccacgaattccatctggtggatctaagggtcatggataattgcttgaaggtgacaaaggatgtagaccatgtgtttaaccttgctgctgatatgggtgggatgggcttcatccagtccaaccactctgtcattatgtataacaacacaatgatcagcttcaacatgcttgaggctgctaggatcagtggagttaagaggtttttctatgcctctagtgcttgtatttaccctgaatttaagcagctggatacaaatgtgagcttgaaggaatctgatgcctggcctgcagagcctcaagatgcatatggcttagagaaacttgctacagaggagttgtgcaagcactacacaaaggactttggaatagaatgtcgtattggaaggttccataacatttacggtccctttggaacttggaaaggtggcagagagaaggcacctgctgctttttgcagaaaggctatcacttccatcgacaagtttgagatgtggggagatggacttcaaactcgatccttcacctttattgatgaatgtgtggaaggtgtgctgagattgaccaagtcggatttccgagagccagtaaacattggaagtgatgaaatggttagcatgaatgagatggctgatattgttctcagctttgagaacaagaagctccctatccatcacattcctggcccagaaggtgtacgaggccgtaactcggacaacactctgatcaaagagaagcttggttgggctcccacaatgaagctgaaggatggcctgagaattacatacttctggattaaggaacagattgagaaagagaaggctcaaggtatagatttgtccatttacggatcatctaaagtggtgggaactcaagcaccagttcaactgggttcacttcgggctgctgatggcaaagaatgaagtagttgaagttacaatgcccgtccagttgtgaataagaagctgaaattttctatatgatatggttatggatatgcagtattgcacttgtaagttgtctatggttgtggagcagtagggtggtatttgagtaagctcccatcattagcttaaattattcggttcttagtttgtctcaggttgctacatttcagcgaagttgtcattctctcatttcatcaaatgtcttgcttttgctttggcaatagttggctaaattctatcgctcatgttgaatattgtgataccaaagagcaaagcctcgcagctattagtggaattgttgggaaggcagctgcaattctgcgaataaaatcctccgatttgag

SEQ ID NO: 1685 - DNA, 1484 bp, Phaseolus coccineus
gatctccttctctccttaacgttatctcaatcccttctcctcttcaacctctctcttttccctctacacagaatgggaagtgctggaaaaactgactatggtgagtacacttatgagaatcttgagagagagccttactggccatcagagaagcttaagatttccatcactggggctgggggttttattgcatcacacatagctcggcgcctcaagagggagggacattacattattgcttctgactggaagaaaaatgagcacatgactgaggacatgttctgtgatgaattccatcttgttgatctccgggtcatggataactgcctgaaggttaccaagggggttgatcatgttttcaatcttgctgcagacatgggtgggatgggctttattcagtctaatcactctgtcattatgtacaacaacacgatgattagcttcaacatgattgaggctgccaggattaacggcattaagaggtttttttatgcctctagtgcttgtatctacccagagtttaaacagttggaaaccaatgtgagcttgaaggagtctgatgcatggccagctgagccacaagatgcatatgggctggagaagcttgcaactgaggagttatgcaagcactataacaaggattttggaattgagtgccgtattgggaggttccataacatttatggcccttttggaacttggaaaggtggaagggagaaggctcctgctgctttttgtcggaaggtaatcacttccactgatagatttgagatgtggggagatggattgcaaacacgatcatttaccttcattgatgagtgtgttgaaggtgtgctaagattgacaaaatctgacttccgtgagccggtaaatattggaagtgatgagatggttagcatgaatgagatggctcagattattcttggctttgagagcaagaatatacctattcatcacattcctggtcctgagggtgttcgaggtcgtaattcagaaaatacactgataaaagaaaaacttggctgggctccaactatgaagttgaaggatgggctgaggatcacatacttctggatcaaggagcagattgagaaggagaagactcaaggtattgatatatcagtgtatgggtcatccaaagtagtgcagactcaggccccagttcaactaggctcacttcgggcagcagatggcaaagaatgaagtggtcaacacatggctgtagtaatcacctaaatgtttcaagtgaagagctgaattatatataagcacttaatagcacagtatctggttatgtttaattagcggccaaggatttgttatgtctatgcatgttgttcacgtgtattttatgtagttctcttaaacgcacttcctggtgcttaaggtggtttactacactagaagctttaaattatttgtttcatgtctaaataattgatttataaagtaaattaaattaatattccttatgtatttggtat

SEQ ID NO: 1686 - DNA, 1471 bp, Arachis hypogaea
ctcactatctcttcctcttagcctcccaatctcaccttcagaatgggaagttctggaacaaccgactatggtgcatacacctaccaggagcttgagagagaaccttactggccatcagagaagctgagaatttccatcactggtgccggtggttttatcgcctctcacatcgcgcggcgcctcaagaccgaggggcattacatcattgcctctgactggaagaagaatgagcacatgactgaggatatgttctgccatgaattccatctggttgatctcagggtcatggataactgcctcactgttaccaagggtgtggaccatgttttcaatcttgctgctgatatgggtggcatgggtttcatccagtccaaccactctgtcattatgtataacaacacaatgattagctttaacatgattgaggctgccaggattaatggtgttaagaggtttttctatgcctctagtgcttgtatctaccctgaattcaaacagttggaaactaatgtcagtttgaaggagtctgatgcctggcctgctgagccacaagatgcatatgggcttgagaagcttgcaacagaagagttatgcaagcactataacaaggattttggaattgagtgtcgcattgggaggttccataatatatatggtccttttgggacatggaaaggtggaagggagaaggctcctgctgcattttgtcgaaaggcaattacttctgcagatagatttgagatgtggggagatggattacaaacacgatcatttacctttattgacgagtgtgttgaaggtgttcttagattgacaaaatcagattttcgggatccagtaaatattggaagtgatgagatggtcagcatgaatgagatggctgagattgttcttagctttgagaacaagaagattcccatacaccacattcctggcccagaaggtgttcgtggtcgtaattcagacaacacactaatcaaagaaaaacttggttgggctccaactatgaaattgaaggatggtctaagaattacatacttttggattaaagagcagcttgagaaggagaaggctcaaggtattgacttatcaagctatggctcatccaaagtggttcagactcaagccccggttcaactgggttcacttcgtgcagcagatggcaaagaataaagttaatataatgcagtgagatgtgataatcatctaaatgtttcatgtgtacttcaggttggaggttcctattgttcagtgtagccttgttaaggcaaaataacaagtaaattaaaaatttgagtattacaataaaccgagtgtagtagatctaataaagcagatattagacacaagttatgtcttaattaagtcagttatcattatgtagcctgttaattgttaatctttcagtttcgttttttggacgaaatctgagtttcttatcaatcgaggttttgttgatattttgttggta

SEQ ID NO: 1687 - DNA, 1587 bp, Populus trichocarpa
ataaatagtataagagttatggccttctgaatctactctcactctctttcgctctctcgcaatcaatccctttactttctctgcatattatcttcattagcaaagctacaaaaccccagatttccaattactcagaatgggaagtgttgatggaagctatggtgcatacacctatgaggccctcgagagggagccttactggccatctgaaaatctcaaaatttccatcactggagccggtggttttattgcctcccacattgctcgccgtttgaagtctgagggtcattatattattgcttctgactggaagaagaatgagcacatgacagaagacatgttctgtcatgaattccatcttgttgatcttagggtcatggataattgcctgaaggttacaaaaggagttgaccatgttttcaacctggctgctgatatgggcgggatgggcttcattcagtccaatcactctgtcattatgtataacaacacaatgatcagcttcaacatgcttgaagcttccaggatcaatggcgttaagaggttattctatgcctctagtgcttgtatttaccctgaatttaagcagctggagactaatgtgagcctcaaggaatctgatgcctggcctgcagagcctcaagatgcttatggcttggagaagcttgcaacggaagagttgtgcaagcattacaccaaagactttggaattgaatgccgcattggaaggttccataacatttatggtccttttggaacatggaaaggtggcagggagaaggcacccgctgctttctgcagaaagactatgacttctattgataaatttgagatgtggggagatggacttcaaacccgatccttcacattcattgatgaatgtgtggaaggtgtgcttagattgacaaagtcagacttccgtgagccagtgaacattggaagtgatgagatggttagcatgaatgagatggctgagattgttctcagcttcgagaacaagaatctccctattcatcacattcctggcccagaaggtgttcgtggacgtaactctgacaacacactaatcaaagagaagcttggttgggctcctacaatgaagctgaaggatggactgagatttacatacttttggatcaaggaacagattgagaaagagaagtcacaaggaatggacttgtctatttatggttcatctaaagtggtgggaacccaagcgcccgttcaattgggctcacttcgtgctgctgatggtaaagaatgaaatgttgaagctatagatgtcttgcagttatacttcagaaagccaggttttcttattatgatatgtcaatgatattgtggtgggaaatcagccatggttctggagtcacagggctgcaatccacattgctctagtttcgggtgtgcaccatgttggtttttccgagggaagcttttatgccctcattcctatcaatctggtttttctagcaacctgctactgtaatattatgttgcaggcgtaatagccttggaacctcattttgttcctgcaataaccatttaccattggtggtctgtgatgaataatatttcttttcacca

SEQ ID NO: 1688 - DNA, 1616 bp, Prunus persica
  misc_feature (941)..(941): n is a, c, g, or t
ctctgaacaactttgcctctcattctcttcttcttagcttctcaagtttcagaggaccaaactttgctcttttaagaatggggagtaccggtggacatgactacggtgcatacacctatgagaacctcgagagggaaccttattggccttcagaaaagcttcgaatttccattactggggcaggtggctttattgcctcacacattgctcggagattgaagaatgagggccattacattattgcttctgattggaagaagaacgagcacatgactgaagacatgttctgtcatgaattccatctcgttgaccttagggttatggataattgcttgaaggttaccaagaatgttgaccatgtgttcaacctcgctgccgatatgggtgggatgggcttcatccagtccaaccattctgtcattttttacaataatactatgattagcttcaacatggtggaagctgctagaatcaatggagtgaagaggtttttctatgcttctagtgcttgcatttaccctgagtttaagcagctggaaaccaatgtgagcttgaaggagtctgatgcctggcctgcagagcctcaagatgcctatggcttagagaagcttgcaactgaggagttgtgcaagcactacacaaaggactttggaattgagtgtcgtattggaaggttccataacatttatggtccttttggaacctggaaaggtgggagggagaaggcacctgctgctttttgcagaaagactctcacttccactgataagtttgagatgtggggagatggacttcagactcgatccttcaccttcatcgatgaatgtgtagaaggtgtacttcggttgacaaagtctgacttccgtgagccagtgaatattggaagtgacgagatggtcagcatgaatgagatggcggagatagttcttagctttgagganaagaagctgcctatccagcacattcctgggccagagggtgtccgtggtcgtaactcagacaacacactgattaaagagaaacttggctgggctcccaccatgaagttgaaggatgggctgagaattacatacttctggatcaaggaacagattgagaaagagaaggcacaaggcactgacctgtcgatttatgggtcatctaaggtggtgggaacccaagccccagttcaacttggttcgctacgtgctgctgatggcaaagaatgaagtgtttgaagacagagaggtctggtaaagccagtatttagtagatttggttatggtattgcggcgcatagtaatgtgtctatgtgcatggacaataagcagggaagctttaattcccccattgtatttctagcctgttagagtaatttgctgccttagaatattcccttttaagttatattttgtttccccatctgacgcattgctcagtattatgtattatttcctttataagattgaattttggttcaatgccatgacctctatcgattgttgagattggtcgctttcaatagacgtggaatctgcaatctgcatgtttgaattttgatggcaaggggttgcctgaatattattggacaactcaaatgtttatgctgttttgtgtttgcaaaatatgatgtggta

SEQ ID NO: 1689 - DNA, 1467 bp, Nicotiana tabacum
cattacggccgggggtctctcaaccgttcacctctctttctaatctctccactgcctcactctttttctcctcctccaaattttttagagaatgggaagctcaggtggcatggactatggtgcttacacctatgagaatcttgagagggaaccttactggccaactgagaagcttcgtatttccattactggggctggaggatttattgcttcccacattgctcgtcgtttgaagagcgagggccactacataattgcctccgattggaagaagaatgagcacatgacagaagatatgttctgtcatgagtttcaccttgtggatcttagggttatggataattgcttgaaggttacaaaagacgttgaccatgtcttcaaccttgccgctgatatgggtggcatgggcttcattcagtctaaccattctgttattttctataacaacactatgatcagcttcaacatgatggaagctgctaggattaatggtgtcaaaaggttcttctatgcatctagcgcttgcatttaccccgagttcaaacagcttgaaactaatgtgagccttaaagaatctgatgcatggccagcagagccccaagatgcttacggcttggagaagcttgcgactgaagaattgtgcaagcattacaacaaggattttggaattgaatgtcgtattggaaggttccataacatctatggtccatttggaacttggaaaggtggaagggaaaaagctcctgccgctttttgtagaaaagcccaaactgcagtagataagtttgaaatgtggggagatggacttcaaacacgttcattcaccttcattgatgagtgtgttgaaggggttctcagattgacaaagtccgacttccgggagccagtgaacattggaagtgatgagatggtgagcatgaatgagatggctgagatggttcttagctttgaggacaagaagcttcccatccaccacattcctggcccagaaggtgtccgtggtcgcaactcagacaacacccttataaaagagaagcttggttgggctccgacaatgagattaaaggatggtttgagaattacatacttctggatcaaggagcagatcgagaaagagaaatctcaaggagttaatattgcaaactatggatcgtctaaggtggtgggcactcaagctccagttgaactcggttcccttcgtgctgctgatggaaaggaataagttcatccctcctattaattggaagccaaatcactgctatgacattgctgctttattaatatggttgtcgtaggtgaatgtgttaaattttaagttaatgttggcttttcttggttttgaatcttgtaatttaagtcccttggcttgtgaggatggtttaatgcttcagctgtatttatcagttgttttaggatatctctatatgataatccaataattggcaatagatctttttcccagttcaa

SEQ ID NO: 1690 - DNA, 1503 bp, Gossypium hirsutum
ggcacgagtttcatctttatttcagaatttgcttcctttccttcttccattattttctctcgtcaaagttctcaacttttaactctttttcaggatgggcagtactgatggaaccagctatggtgcttacacctatgatgctctggagagggagccttactggccatctcagaaactccggatttccatcactggtgccggtgggttcattgcttcccacattgctcgacgtctgaagagtgaaggccattacatcattgcttctgactggaagaagaacgagcacatgacagaagatatgttttgtaatgaattccacctcgttgatcttcgagtcatggagaattgcttgaaagtttccaaaggagtggaccatgtcttcaacctcgctgccgatatgggtgggatgggtttcattcagtcaaaccactctgtcattatgtacaacaacactatgatcagtttcaacatgcttgaggctgctaggattagtggagttaagaggtttttctatgcctcgagtgcttgtatctaccctgaatttaagcagttggacactaatgtgagcctaaaagaatccgatgcctggcctgctgagcctcaagatgcttatggcttggaaaagcttgcaactgaggagttgtgcaagcactacaccaaagattttggaatcgagtgtcgtattggaaggtttcacaacatttatggtccttttggaacatggaaaggtggaagggagaaggctccagctgccttttgcagaaaagctattacttccattgacaagtttgagatgtggggagacggtcttcagacccgatctttcaccttcattgatgaatgtgtcgaaggtgtacttagattgacaaagtcagatttccgcgaacctgtgaacattggaagtgatgagatggtcagcatgaatgagatggcagaaattgttcttagctttgaggataaaaatcttccaatccatcatattcctggcccagagggtgtccgtggtcgtaattcagacaatacgttgatcaaagaaaaacttggttgggctcctacaatgaggttgaaggatgggctgagaattacatacttctggatcaaggaacaaattgagaaagagaaggctcaaggcatagacctatctgtctatgggtcatccaaggtcgtgggaactcaagcaccagtccagctgggctcacttcgtgcagccgatggcaaagaatgaagaagtaaaggtcttgtagttgctttaaagccaagttttattggcagatggggggaatgcataaaccagtttcaggtttagtatttaattttggtattgtagtgtgtgtactgttgtttaaaggggattgtattcgaagttagctttccatgatatgcaaggcttaaataaatgccatttcgattcctaatgtcttctcaccttcgtatgaaccgatgggtatataccaaactgatctgttatctaaatgccagtgcaagttgcttttccttttgttc

SEQ ID NO: 1691 - DNA, 1459 bp, Vigna unguiculata
ggatctcattctctccataaacttttctcaatcccttcaagctctctcttttccctctacacagaatgggaagtgctggaaaaactgactatggtgagtacacttatgagagtcttgagagagagccttactggccagcagagaagcttaagatttccatcactggggctgggggttttattgcatcacacatagctcggcgcctcaagacggaggggcattacattattgcttctgactggaagaaaaatgagcacatgactgaggacatgttctgtgatgaattccatcttgttgatctcagggtcatggataactgcttgaaggttactaaaggggttgatcatgttttcaatcttgctgcagacatgggtgggatggggtttattcagtctaatcactctgtcattatgtacaacaacacgatgattagcttcaacatgattgaggctgccaggattaacggcattaagaggtttttttatgcctctagtgcttgtatctacccagagtttaaacagttggaaaccaatgtgagcttgaaggagtctgatgcatggccagctgagccacaagatgcatatgggctggagaagcttgcaactgaggagttatgcaagcactataacaaggattttggaattgagtgccgtattgggaggttccataacatctatggcccttttggaacttggaaaggtggaagggagaaggctcctgctgctttttgtcggaaggtaatcacttccactgatagatttgagatgtggggagatggactgcaaacacgatcatttaccttcattgatgagtgtgttgaaggtgtgctaagattgacaaaatctgacttccgtgagccggtaaatattggaagtgatgagatggttagcatgaatgagatggctgagattattcttggctttgagaacaagaatattcctattcatcacattcccggtcccgagggtgttcgaggtcgtaattcagacaacacactgataaaagaaaagcttggctgggctccaactatgaagttgaaggatgggctgaggatcacatacttctggattaaggagcagattgagaaggagaagggtgaaggtattgatatatcagtgtatgggtcttccaaagtggtgcagactcaggccccagttcaactaggttcacttcgggctgcagatggcaaagaatgaagtgttcaacacatggctgtagtgatcacctaaatgtttcaagtgaagagctggattatatatatataggcaggcactaaatagcgcagtatctgtttgtttaattagggctaaggatttgttatgtctctgcattttgtttacgtgtattttatgtagttctcttaaggcacttcctggtgcttaaggtggttcactacactaaataattgatttataagcaaataaaattttcttccttgtgaacaaaaaaagaaaaaaaa

SEQ ID NO: 1692 - DNA, 1658 bp, Capsicum annuum
tggggaaaaataaataaactagtggtatggtttgtgtctactgacatcactgcacgttctccttgtctatatatagagatttatagccaaattcttgtaatcacaattgtttctctcaaccattcaactctgcccattgcctccctcttttcctccttcaaacttttacagaatgggaagctctggtattgactatggttcttacacttatgagaatcttgagagggagccttactggccatctgagaagctccgtatttccattactggggctggaggatttatcgcttcccatattgctcgtcgtttgaagagcgagggccactacataattgcttccgattggaagaagaatgagcacatgacggaggatatgttctgtcatgagtttcatcttgtggatcttagggttatggctaattgcttgaaggtaacaaaaggagttgaccacgtcttcaacctcgctgctgatatgggtggcatgggtttcattcagtccaaccactcagttattttctataacaacactatgatcagtttcaacatgatggaagctgctaggattaacggtatcaaaaggttcttctatgcatctagcgcttgcatttatcccgagttcaaacaacttgaaacaaatgtcagcctgaaagaagctgatgcttggcctgcagagcctcaagatgcttacggcttggagaagcttgccactgaagaattgtgcaaacattataacaaggattttggaattgaatgtcgcattggaaggttccataatatctatggaccttttggaacttggaaaggtggaagggaaaaagcccctgccgctttttgtagaaaagcccaaaccgcaactgataagtttgaaatgtggggagacggacttcaaacacgttcattcaccttcattgatgagtgtgttgaaggagttctcagattgacaaaatctgacttccgggagccagtgaacattggaagtgatgagatggtcagtatgaatgagatggctgagatggttctcagctttgaggacaagaagcttcccgtccaccacattcctggcccagaaggtgtccgtggtcgcaactcagacaatatgctgataaaagagaagcttggttgggctccgacaatgaaattgaaggatggtctgagaattacttacttctggatcaaggagcagatcgagaaagagaaatctcaaggagttgacacagcaacctatggatcctccaaggtggtaggcacccaagctccagttgagcttggttcccttcgtgctgctgatggcaaggaataagtccatcccttctgttaccgtttcaattggaagccaatccctgctatagtatttgctacattatgtcatatggcatcgtagaagaacgtgttacattctgataattgttggcttttcttggatttgaacatgtcgatgtaatctaaaccccctcagccttgttgagggtatagtttaatgcgtcggctatatttatcagttgttcgagaagatctatatgagaattgaataactggcagtggatcctccctctctttttacctagttcaggatcttgctgttatgctgttggtcatgtaatcaaaactttaacctggataaggttatcagatatatgtgatatttcaatgcaaatttc

SEQ ID NO: 1693 - DNA, 1926 bp, Pinus taeda
ggggtgtgcgttcttccgagatttgcactctgataagcttgagggagctcttcaaatcaaggcttgttttatattttcctttctttgaacatcatgggaagcactggagctgatggactggcctatggggcatacacctatgaagacctggagagagagccatactggcctagtgaaaaagtgagaatttccattactggagctgggggtttcattgcctcccatattgccaggagattgaagtctgaaggccattacatcattgcctctgattggaagaagaacgagcacatgactgaggatatgttctgccatgaattccatcttgtggatctcagagttatggacaattgtttggctgttaccaaaggggttgaccatgtttttaacttggctgcagacatgggcggtatgggattcattcagtctaatcattctgttatcatgtacaacaacacaatgatcagcttcaacatgattgaagctgccagaatcaatggtgttaagaggtttttctatgcttctagcgcatgtatttatcccgaattcaaacaattggagaccaacgtgagcttgaaggagtctgatgcctggccagctgagcctcaagatgcctatggcttggaaaaacttgccacagaagaattgtgcaagcactacaataaggactttggtatagaatgccggatagggcgtttccacaacatttatggtccttttggcacatggaagggtggacgtgagaaggcacctgctgccttttgcaggaagacactcacatccaccgataggtttgaaatgtggggcgatggcaagcaaacacgatcttttacattcattgatgaatgtgtggagggtgtcctgagattgactaaatcagactttagagagccagtgaatattggcagtgatgaaatggttagcatgaatgagatggctgaaatggtgctgagctttgagaacaagaagttgccaatacatcacatccctgggccagagggtgtacgtggtcggaattctgataatacattgatcaaggaaaagctaggctgggcaccaaccatgaagctgaaggatggcttgaggattacttatttctggatcaaggaacaaattgagaaagaaatggtgcagggaattgatctctccatctatggatcttctaaggtggttggcacgcaagcccctgttcaacttggatctctccgtgctgcggatggaaaggaatgaggacaaattccttgatctctagtagaataaataaatcaatgttaactcagtttattataagctggttagcggctacatgcttctttatttggtatccaaaattattttgcctgctattgaagtatctctcaagggtactttctgttaattcatgggaattttcggaaaaaaccacatagagtattggtcgactgcttctggttagaagcagtcattttctttttagttcaaaagttcatcaccctgtggtgctgatggcgaggatcatctaatgctcaaaagtctatgaaaatgcaaccatgaggatttcataggaggaggtcactgcaaaagaatcttttgagatgtcaaagatgattatacatttataaggatctctgcagtgtgtatccaactttgcacaaacttctatatctgatgtgcaatgctacttaacaatttgagccatatcggtgcttgtttagttgtgatatttggtttttaacttaatgtcctatatctaaaatcttagttgctgaaggaacatttgcaaagtttatgtacgtattttatctctgggcagaatttctgttgaggaatttgtttggcttgtccccattcaagtcatggttgctaactggtatttgagtccacaatggtccggatattcagagtttgccatctttcttatgagaaaaatttatagaacagtttcta

SEQ ID NO: 1694 - DNA, 1950 bp, Pinus taeda
  misc_feature (75)..(75): n is a, c, g, or t
  misc_feature (387)..(387): n is a, c, g, or t
  misc_feature (1796)..(1796): n is a, c, g, or t
gggtgataaggggtgtgcgttcttccgaggtttgcactctgataagcttgagggagctcttcaaatcaaggcttnttttatattttcctttctttgaacatcatgggaagcactggagctgatggactggcctatggggcatacacctatgaagacctggagagagagccatactggcctagtgaaaaagtgagaatttccattactggagctgggggtttcattgcctcccatattgccaggagattgaagtctgaaggccattacatcattgcctctgattggaagaagaacgagcacatgactgaggatatgttctgccatgaattccatcttgtggatctcagagttatggacaattgtttggctgttaccaaaggggttgancatgtttttaacttggctgcagacatgggcggtatgggattcattcagtctaatcattctgttatcatgtacaacaacacaatgatcagcttcaacatgattgaagctgccagaatcaatggtgttaagaggtttttctatgcttctagcgcatgtatttatcccgaattcaaacaattggagaccaacgtgagcttgaaggagtctgatgcctggccagctgagcctcaagatgcctatggcttggaaaaacttgccacagaagaattgtgcaagcactacaataaggactttggtatagaatgccggatagggcgtttccacaacatttatggtccttttggcacatggaagggtggacgtgagaaggcacctgctgccttttgcaggaagacactcacatccaccgataggtttgaaatgtggggcgatggcaagcaaacacgatcttttacattcattgatgaatgtgtggagggtgtcctgagattgactaaatcagactttagagagccagtgaatattggcagtgatgaaatggttagcatgaatgagatggctgaaatggtgctgagctttgagaacaagaagttgccaatacatcacatccctgggccagagggtgtacgtggtcggaattctgataatacattgatcaaggaaaagctaggctgggcaccaacaatgaagctgaaggatggcttgaggattacttatttctggatcaaggaacaaattgagaaagaaatggtgcagggaattgatctctccatctatggatcttctaaggtggttggcacgcaagcccctgttcaacttggatctctccgtgctgcggatggaaaggaatgaggacaaattccttgatctctagtagaataaataaatcaatgttaactcagtttattataagctggttagcggctacatgcttctttatttggtatccaaaattattttgcctgctattgaagtatctctcaagggtactttctgttaattcatgggaattttcggaaaaaaccacatagagtattggtcgactgcttctggttagaagcagtcattttctttttagttcaaaagttcatcaccctgtggtgctgatggcgaggatcatctaatgctcaaaagtctatgaaaatgcaaccatgaggatttcataggaggaggtcactgcaaaagaatcttttgagatgtcaaagatgattatacatttataaggatctctgcagtgtgtatccaactttgcacaaacttctatatctgatgtgcaatgctacttaacaatttgagccatatcggtgcttgtttagttgtgatatttggtttttaacttaatgtcctatatctaaaatcttagttgctgaaggaacatttgcaaagtttatgtacgtattttatctctnggcagaatttctgttgaggaatttgtttggcttgtccccattcaagtcatggttgctaactggtatttgagtccacaatggtccggatattcagagtttgccatctttcttatgagaaaaatttatagaacagtttctaggaaggaattttctt

SEQ ID NO: 1695 - DNA, 1581 bp, Populus trichocarpa
gaatctactctcactctctttcgctctctcgcaatcattccctttactttctctgcatattatcttcattagcgaagctacaaaactccagatttccaattactcagaatgggaagtgctgatggaagctatggtgcatacacctatgaggccctcgagagggagccttactggccatctgaaaatctcaaaatttccatcactggagcaggtggttttattgcctcccacattgctcgccgtttgaagtctgagggtcattatattattgcttctgactggaagaagaatgagcacatgacagaagacatgttctgtcatgaattccatcttgttgatcttagggtcatggataattgcctgaaggttacaaaaggagttgaccatgttttcaacctggctgctgatatgggcgggatgggcttcattcagtccaaccactctgtcattatgtataacaacacaatgatcagcttcaacatgcttgaagcttccaggatcaatggcgttaagaggttattctatgcctctagtgcttgtatttaccctgaatttaagcagctggagactaatgtgagcctcaaggaatctgatgcctggcctgcagagcctcaagatgcttatggcttggagaagcttgcaacggaagagttgtgcaagcattacaccaaagactttggaattgaatgccgcattggaaggttccataacatttatggtccttttggaacatggaaaggtggcagggagaaggcacccgctgctttctgcagaaagactatgacttctattgataaatttgagatgtggggagatggacttcaaacccgatcattcacattcattgatgaatgtgtggaaggtgtgcttagattgacaaagtcagacttccgcgagccagtgaacattggaagtgatgagatggttagcatgaatgagatggctgagattgttctcagcttcgagaacaagaatctccctattcatcacattcctggcccagaaggtgtgcgtggacgtaactctgacaacacactaatcaaagagaagcttggttgggctcctacaatgaagctgaaggatgggctgagaattacatacttttggatcaaggaacagattgagaaagagaagtcacaaggaatggacttgtctatttatggttcatctaaagtggtgggaacccaagcacccgttcaattgggctcacttcgtgctgctgatggtaaagaatgaaatgttgaagctatagatgtcttgcagttatacttcagaaagccaggttttcttattatgatgtgtcaatgatattgtggtgggaaatcagccatggttctggagtcacagggctgcaatccacattgctctagtttcgggtgtgcaccatgttggtttttccgagggaagcttttatgccctcattcctatcaatctggttttttctagcaacctgctactgtaatattatgttgcaggcgtaatagccttggaacctcattttgttcctgcaataaccatttaccattggtggtctgtgatgaataatatttcttttcaccattgttgtttagattccaatgc

SEQ ID NO: 1696 - DNA, 1468 bp, Fragaria vesca
  misc_feature (1225)..(1225): n is a, c, g, or t
  misc_feature (1305)..(1305): n is a, c, g, or t
  misc_feature (1316)..(1318): n is a, c, g, or t
  misc_feature (1333)..(1333): n is a, c, g, or t
cctttctctcggaaccctttacctctcatcttcttctcttcaaccttaaagctccaaactttacgcattccagtatgggaagtgctggtgagagtggctatggcgcatacacctatgaggcccttgagagggagccttattggccctcggaaaaactccgaatttcaattactggggctggtggctttatcgcctcccacattgcccgccgattgaagaatgagggtcactacattattgcttctgactggaagaagaatgagcacatgactgaagacatgttctgcgatgaattccatcttgtggatctcagggtcatggataactgcttgaaggttaccaaggacgttgatcatgtgttcaaccttgctgctgatatgggcggcatgggattcattcagtccaatcactctgtcattatgtacaacaataccatgatcagctttaacatgctggaagctgctaggatcactggagtgaaaaggtttttctatgcttccagtgcttgtatttatcctgagtttaagcagctggaaactaatgtgagcttgaaggaggcggatgcctggccggcagagcctcaagatgcttatggcttagagaaacttgcaactgaggagttgtgcaagcactacaccaaagactttggaatcgaatgtcgtattggaaggttccacaatatttatggtccttttggaacctggaaagggggcagggaaaaggcacctgctgctttctgcagaaaggctctcacatccactgataagtttgagatgtggggagatggacttcagacccgatccttcacctttattgatgaatgtgttgaaggtgtactccggttgacaaagtccgacttccgtgagccagtgaatattggaagtgacgagatggtcagcatgaatgagatggctgagattgttcttagctttgagaacaagaagctgcctattcagcacattcctggaccagagggtgtccgtggtcgtaactctgacaacactctgatcaaagagaaacttggctgggctcctaccatgaggctgaaggatggactgaggtttacatacttctggatcaaggaacagattgagaaagagaaagcacaaggtactgacctgtcggtttatgggtcatctaaggtggtgggaactcaagccccagttcaacttggttcacttcgtgccgctgatggcaaagagtgatgtgtttgaaggcttctagntacacttgggaaaagccagtatttagtatatccggttacgatattgtggcgcatagtcaagtatctatgtgatgatgcanggacaataagnnngttattttgcttctntcctcccattgtatatctagccttccaggagctatttgctgcttagattgccttcaaattcttctttctgcaactgaacaatagttcagttatgagttgtatctgtacttatttctatgagttgcatcagtattc

SEQ ID NO: 1697 - DNA, 1535 bp, Nicotiana tabacum
ggccattacggccgggggtctctcaaccgttcaactctctttctaatctctccgctgcctcacttttctcctccaaatttttagagaatgggaagctcaggtggcatggactatggtgcttacacctatgagaatcttgagagggaaccttactggccaaccgagaagctccgtatttccattactggggccggaggatttattgcttcccacattgctcgtcgtttgaagagcgagggccactacataattgcctccgattggaagaagaatgagcacatgacagaagatatgttctgtcatgagtttcatcttgtggatcttagggttatggataattgcttgaaggttacaaaagatgttgatcatgtcttcaaccttgctgctgatatgggtggcatgggcttcattcagtctaaccattctgttattttctataacaacactatgatcagtttcaacatgatggaagctgctcggattaatggtgtcaaaaggttcttctatgcatctagcgcttgcatttaccccgagttcaaacaacttgaaacaaatgtcagtttgaaagaatctgatgcatggccagcagagcctcaagatgcttacggcttggagaagcttgcgaccgaagagttgtgcaagcattacaacaaagattttggaattgaatgtcgtattggaaggttccataacatctatggtccatttggaacttggaaaggtggaagggaaaaagctcctgccgcgttttgtagaaaagcccaaactgcagtagataagtttgaaatgtggggagatggacttcaaacacgttcattcaccttcattgatgagtgtgttgaaggggttctcagattgacaaagtctgacttccgggagccagtgaatattggaagtgatgagatggtgagcatgaatgagatggctgagatggttcttagctttgaggacaagaagcttcctgtccaccacattcctggcccagaaggtgttcgtggtcgcaactcagacaacacccttataaaagagaagcttggttgggctccgacaatgagattgaaggatggtttgagaattacatacttctggatcaaggagcagatcgagaaagagaaatctcaaggagttaatattgcaaattatggatcgtctaaggtggtgggcactcaagctccagttgaactcggttcccttcgtgctgctgatggcaaggaataagttcatcccttctattaattggaagccaaatcactgctatgacattgctgctttattaatatggttgtcgtaggtgaatgtgttaaattttcagtaattgttggcttttcttggttttgaatcttgtaatttaagccccttggcttgtgaaggggatggtttaatgcttcagctgtatttatcagttgtttgagaagatctatatatgataatccaataattggcaatacatctttttcccagttcaaggtcttgctgttccccttttggtgatcatgtctattatttaatcagattgttacatgaataaagtattt

SEQ ID NO: 1698 - DNA, 1510 bp, Nicotiana tabacum
  misc_feature (19)..(20): n is a, c, g, or t
  misc_feature (378)..(378): n is a, c, g, or t
  misc_feature (423)..(423): n is a, c, g, or t
  misc_feature (426)..(426): n is a, c, g, or t
  misc_feature (840)..(840): n is a, c, g, or t
gagatctgttacaaaaaannatagccccttatcattgagcttcgccatctccttcaacacctcacaagtccaattgcttcaagaatgggaagttccggtggaaccagttatggagaatacacatatgaaaaccttgagagggaaccctactggccttcagagaagctccgaatttctattacgggagctggtggattcattgcctcacacattgcaaggcgtctgaaaactgaagggcattacgttattgcttctgactggaagaagaatgagcatatgtctgaggacatgttctgtcatgagttccatctcgttgatctcagggttatggataactgtttgaaagtcacaaaaggagttgatcatgtgttcaatctngctgccgatatgggaggtatgggcttcattcagtccaaccactcngtnatcatgtataacaacactatgataagctttaacatgatggaggcttcaagaatcactggtgttaagaggttcttttatgcatccagtgcttgcatctatcctgaatttaagcagttggaaactaacgtcagcttaaaggagtctgatgcttggcctgcagagcctcaagatgcttatggcttagaaaagttggcaacggaggagttatgcaaacattacaacaaggacttcggaattgagtgtcgcattggacgtttccataacatttatggcccatttgggacatggaaaggtggacgcgagaaggcaccagcagctttttgtagaaaagcccaaacttccactgataaattcgagatgtggggagatggaaagcaaactcgatctttcaccttcattgatgaatgtgttganggcgttctgaggttaacaaaatcagactttagagagccagtgaacatcggaagcgatgagatggtaagcatgaatgagatggcggagatggtcctcagctttgagcagaagatgcttcctattcatcacatccccggaccagagggtgtgcgtggtcgaaactccgacaacactctcgtcaaggaaaagcttggttgggctcctactatgaaactgaaggatgggttgagaattacatatttctggatcaaggaacaaatcgagaaagagaaagtacagggtgcagatgtgtctgtttatgggtcatcaaaagttgtgggaacacaagctccggttcaactgggatccctacgtgctgctgatggaaaagagtaaagtagatgaagccaggtgactgaatcattccgtatgcacaacagccatctttgttacttccaccatgttttcgtcgggtggaatgtcgacctattgatatatttttatgttctgtgccaaagcttttatttcacttcaccctccttgcacctaaaaaataacaccgggagatgtagtagatgcttccgttctgtgttttgttttcactgtctcaatggatttatggtattgtcctagtttgtacgggacaccagtttgctatttgctatcaatctatcattttcttgctcctttc

SEQ ID NO: 1699 - DNA, 1416 bp, Ipomoea nil
gatatattctgttatcaactctcaaccattcaactctctctccctctcttccttgcctctctcgttgccaacactacaaccttagaggatgggaagttctggaggaattgattatggtgcttacacctatgagaacctcgagagggagccttactggccatctgagaagctccgaatctccattaccggagctggagggtttattgcttcccacatcgctcgccggctgaagagtgagggccactacgttattgcttctgactggaagaaaaacgagcacatgacggaggacatgttctgtcatgagttccatctcgctgatctgagggttatggacaattgtcttaaggtcactcaaggagttgaccatgtcttcaaccttgctgctgatatgggtggaatggggttcattcagtctaatcactctgttattatgtacaataacacgatgatcagcttcaacatgatggaagcttccaggattaatggcgttaaaaggttcttctatgcctctagtgcttgcatttacccggaattcaagcaactagagactaatgtgagtttgaaggaatctgatgcatggcctgctgagcctcaagatgcgtatggattagagaaacttgcaaccgaggaattgtgcaagcattacaacaaagattttggaattgaatgccgtattggaaggttccacaacatttatggtccatttggaacatggaaaggtggaagggaaaaagctcctgctgctttctgtagaaaagcgttaacttcgactgataaattcgaaatgtggggagatggacttcaaactcgttcgtttactttcatcgatgagtgtgttgaaggtgttctcaggttaacaaagtcagactttcgggagcctgttaacattggaagtgatgagatggttagcatgaatgagatggctgagatggttcttagctttgatgagaagaggctgccgattcaccacattcccgggccagaaggtgtccgtggtcgaaactctgacaacactctcataaaggagaaacttggttgggctccaacgatgagattgaaggacgggttgagaatcacctacttctggatcaaggaacagctcgagaaggagaaagctcaaggcgttgatctctccacatatggatcttccaaggtggtgggaacccaagctccggtgcaacttggatcgctccgtgctgctgatggcaaggaatgagtggtgtttgaagctgatgtacttgtaccctataaaaatgttgaagaaaagttgctttgtttggagggcatatttatcttcctgtttttcctatcttagctgatgaaaaactattctgcctttgaacccaataaggtcttggccaagtttatgtacaatcatggtttggatggttttcttatttgaatcaatgctca

SEQ ID NO: 1700 - DNA, 1543 bp, Glycine max
tgatcaaaataaggtgacattcaaataagaagtgataaatgagtggctctgccttcccacttcggcactctattctatatatagcaatggcatccaccacacatgcattccaaacccaaccgtatccttcattcttctcctaaatcctaatccttcttcactttcagttctcagcatgggaagttctggaacaaccgactatggagcatacacataccaaaaccttgagagggaaccttactggccctctgaaaagctcagaatttccatcactggggctggtggtttcattgcctcacacattgctcgccgcctcaagactgaggggcattacatcattgcttctgattggaagaaaaatgagcacatgactgaagacatgttctgccatgagttccatcttgttgatcttagggtcatggataactgcttgacagttaccaagggtgtggatcatgttttcaatcttgctgctgatatgggtgggatgggttttatccagtccaaccactctgtcattatgtacaacaacaccatgattagcttcaacatgattgaggctgccaggatcaatggtgttaagaggtttttttatgcctctagtgcttgtatctaccctgaattcaaacagttggaaacaaatgtgagtttgaaggaggctgatgcctggcctgctgagccacaagatgcatatgggctggagaagcttgcaacagaagagttatgcaagcattataacaaggattttggaattgagtgccgcattgggagattccataacatatatggtccttatgggacatggaaaggtggaagggagaaggctcctgctgctttttgtcgcaagacacttacttccaaagatcgatttgagatgtggggagatggattgcaaacaagatccttcaccttcattgatgagtgtgttgaaggtgtactgagattgactaaatcagacttccgggagccagtgaatattggaagtgatgaaatggtcagtatgaatgagatggcagagattgttcttagctttgaggataagaatataccaatataccatattcctggcccagaaggtgttcggggccgtaattcagacaatacattaatcaaagagaaacttggctgggctccaactatgaagttgaaggatgggctgagaattacatacttttggatcaaagagcagcttgagaaagagaaggcagaaggtgttgatttatcaggctatggatcatccaaagtggttcagactcaagccccagttcaacttggctcgctacgtgctgcagatggcaaagaataaagctgctagtgcaagggatgttcggcagttgcagcagatggcaaagaataagagtgaacaatgcatttccaagtgaagggcaggcttttatgttgctattttgtagagatctatggttacagattagctattgaagttagttttggaacttgttcatgtatttgtaacggatggtgttatgttcttgttttgtttgaggtaataataataactgctgcttaaggtgatgttactgct

SEQ ID NO: 1701 - DNA, 1600 bp, Solanum lycopersicum
tctttctctatatatacccaaattgttgttatcataattgtctctcaaccattcaactctctttctaatatctcaatctttttctcctccatacttttacagaatgggaagctctggtggtattgactatggttcttacacttatgagaatcttgagagggaaccttactggccgtctgagaagctccgtatttccattactggggctggagggtttatcgcttctcacattgctcgccgtttgaagagcgagggccactacataattgcctctgattggaagaagaatgagcacatgacagaggatatgttctgtcatgagtttcatcttgcggatcttagggttatggataattgcttgaaggtaacaaaaggtgttgaccatgtcttcaaccttgctgctgatatgggtggcatgggtttcattcagtccaaccactctgttatcttctataacaacactatgatcagcttcaatatgatggaagctgctaggattaacagtgtcaaaaggttcttctatgcatctagcgcttgcatataccctgagttcaaacaacttgaaacaaatgtcagcctgaaagaagctgatgcatggcctgcagagcctcaagatgcatatggtttggagaagcttgccacagaagaattgtgcaaacattacaacaaggattttggaattgaatgtcgtattggaaggttccataacatctatggaccttttggaacctggaaaggtggaagggaaaaagctcctgccgctttttgtagaaaagcacaaactgcaacggataagtttgaaatgtggggagatggacttcaaacacgttcattcaccttcattgatgagtgtgttgaaggggttcttagattgacaaaatccgacttccgtgagccagtaaacattggaagtgatgagatggtcagcatgaatgagatggctgagatggtcctcagctttgaggacaagaagcttcctgtccaacacattcctggcccagaaggcgtccgtggtcgcaactcagacaacacgctgattaaagagaagcttggttgggctccaacaatgagattgaaggatggtctgagaattacatacttctggatcaaggagcagatcgagaaagagaaatctcaaggagttgatactgcaacctatggatcttccaaggttgtgggcacccaagctccagttgagctaggttccctccgtgctgctgatggcaaggaataagttgattccttctgtcatcatttcaattggaagccaatccatctgctatgacattgctgcattatgtattatggcgtcgtagaagatgtgttagattctggtaattgttggcgtttcttggttttagtttgaacatgtcaatgtaatctattaccccatggtcttgtgaaggggatagtttaatagttcatctatatttatcagtcgttcgagaagatctcaatgtgagaactgaataactgccagtggatcctctcttgttttttttacctagttcaggatcttgctgttgtgctgttggtgatcatgtaatcaaaattttaaccttgataaggtttaaagatatgtgagatttcattgcataga

SEQ ID NO: 1702 - DNA, 1553 bp, Solanum lycopersicum
accattcaactctctttctaatatctcaatctttttctcctccatacttttacagaatgggaagctctggtggtattgactatggttcttacacttatgagaatcttgagagggaaccttactggccgtctgagaagctccgtatttccattactggggctggagggtttatcgcttctcacattgctcgccgtttgaagagcgagggccactacataattgcctctgattggaagaagaatgagcacatgacagaggatatgttctgtcatgagtttcatcttgcggatcttagggttatggataattgcttgaaggtaacaaaaggtgttgaccatgtcttcaaccttgctgctgatatgggtggcatgggtttcattcagtccaaccactctgttatcttctataacaacactatgatcagcttcaatatgatggaagctgctaggattaacagtgtcaaaaggttcttctatgcatctagcgcttgcatataccctgagttcaaacaacttgaaacaaatgtcagcctgaaagaagctgatgcatggcctgcagagcctcaagatgcatatggtttggagaagcttgccacagaagaattgtgcaaacattacaacaaggattttggaattgaatgtcgtattggaaggttccataacatctatggaccttttggaacctggaaaggtggaagggaaaaagctcctgccgctttttgtagaaaagcacaaactgcaacggataagtttgaaatgtggggagatggacttcaaacacgttcattcaccttcattgatgagtgtgttgaaggggttcttagattgacaaaatccgacttccgtgagccagtaaacattggaagtgatgagatggtcagcatgaatgagatggctgagatggtcctcagctttgaggacaagaagcttcctgtccaacacattcctggcccagaaggcgtccgtggtcgcaactcagacaacacgctgattaaagagaagcttggttgggctccaacaatgagattgaaggatggtctgagaattacatacttctggatcaaggagcagatcgagaaagagaaatctcaaggagttgatactgcaacctatggatcttccaaggttgtgggcacccaagctccagttgagctaggttccctccgtgctgctgatggcaaggaataagttgattccttctgtcatcatttcaattggaagccaatccatctgctatgacattgctgcattatgtattatggcgtcgtagaagatgtgttagattctggtaattgttggcgtttcttggttttagtttgaacatgtcaatgtaatctattaccccatggtcttgtgaaggggatagtttaatagttcatctatatttatcagtcgttcgagaagatctcaatgtgagaactgaataactgccagtggatcctctcttgttttttttacctagttcaggatcttgctgttgtgctgttggtgatcatgtaatcaaaattttaaccttgataaggtttaaagatatgtgagatttcattgcataga

SEQ ID NO: 1703 - DNA, 1404 bp, Triphysaria pusilla
  misc_feature (695)..(695): n is a, c, g, or t
attcacaagaaggagagagttctatttatctacatcgaattaaaaatccaatcttttttagaatgggaagcactggcgaaccggtttatggggcctacacatacgaaagcctcgagagggaaccctattggccctcggaaaagcttcgaatctcgattactggagccggtggttttattgcctctcacatcgcgaggcgtctgaagagtgagggccattacataatcgcctccgactggaagaaaaacgagcacatgacagaggatatgttctgtcatgaattccatctggtcgatctgagggtgatggataactgtttgaaagtcactgacggtgttgatcatgtctttaatctggctgctgatatggggggcatgggcttcattcagtcgaaccactctgttatcatgtacaacaatacgatgatcagttttaacatgatcgaggctgccagaattaatgccgttaagaggttcttttatgcttccagtgcttgtatctatcccgagtttaagcagctggaaaccaatgtgagcagcttgaaagaatccgatgcctggcccgccgagcctcaagatgcttatgggctagagaagcttgcaacggaggagttgtgtaagcactacaacaaagactttggaatcgagtgccggatcggaaggttccataacatttatggcccctttgggacatgnaaaggtggaagggagaaagcgccagctgccttctgtaggaaagcgctgacttcgacggataagtttgagatgtggggagacggcctgcaaactcgctcatttacttttatcgatgaatgtgtcgagggtgttttaagattgactaaatcggactttagagagccagtaaacatcggaagtgatgagatggtgagcatgaacgagatggccgagattgtccttagcttcgacaacaagaaactccccatccaccacatcccgggcccagaaggcgtgcgtggccgaaattcagacaacactttaatcaaggaaaagcttgggtgggccccaacaatgaaactaaaggatgggctgagaatcacttatttctggattaaagaacagcttgaaaaggaaaaaacgaagggtgtcgatttgtctaattatgggtcgtcaaaggttgtcgggactcaagcaccggttcaactcggttctcttcgagctgctgatgggaaagaatgaaggaccaagaaaatgggtttcattttttatgctccacctcatgctgctggagtaaaatatatgcttttagtatttattatttttagttatgaatgtgctttatagttacaaaatgcaattatgaatttactacattcagttgctgtgacaattctgcattatttgatttacatttaaaggaatgtgatttcagtggttattttttgga

SEQ ID NO: 1704 - DNA, 1571 bp, Pennisetum glaucum
gaaggaggggggcgaagctgcacctacctccttcctcccgctccggaatctcgctgcgccgccgctgcccccgtcatttgccaggatggcgctcaacaaggagtacacttacgcggagctggagaaggagccatactggccgtttgagaagctgcggatctccatcacgggcgctggcgggttcatcgcctcccacatcgctaggcgcctcaagagcgagggccactacatcattgcctctgactggaagaagaatgagcacatgaccgaggacatgttctgccatgagttccacctcgtcgacctcagggtcatggacaactgcctcaaggtgaccacgggggttgaccatgtgttcaaccttgctgctgatatgggagggatggggttcatccagtccaaccactctgtcatcatgtacaacaacaccatgatcagctttaacatgcttgaggctgctagaatcaatggtgtcaagaggttcttttatgcatcaagcgcctgtatctaccctgaatttaagcagttggagactgtagttagcttgaaggagtcagatgcctggcctgcagagcctcaagatgcatatgggttggagaaacttgctactgaggaactctgcaagcactacacaaaggattttggcattgagtgcaggatcggtcgctttcacaacatatatggtccctttgggacatggaaaggtgggagggagaaggcacctgctgctttctgcagaaaggctttaacctccactgggcgctttgagatgtggggcgatggtctgcaaacaagatctttcacatttattgatgaatgtgtcgagggtgtccttaggttaacaaagtctgatttccgtgagcctgtaaacattggaagtgatgaaatggtcagcatgaacgagatggctgagatagtcctcagctttgagaacaagcagctgcccatccaccacattcctggaccagagggtgtgcgtgggcgcaactcagataacacgctcataaaggagaagcttggctgggctccgaccatgaagctgaaggatggactaaggatcacatacttctggatcaaggagcagcttgagaaggagaaggctgagggcatggatctgtcggtctatggttcatccaaggtcgtccagacacaggcccctgttcagctcggttccctccgtgctgctgatggcaaggagtgaccttgccactgccagtcagcccactcaaggcctgggcagagagcatgatataccaagcatacccccaatggtttcagttgtcacggttcttgtcatcacctacaccatttcttgattcactttgaactcccaactgtctggatggtggttatcttatcagaaagttatgggatttatccaaatttggagtagatacaaaatattctgacaaaataccccctccatacacttgtagtaatttccatgttttttttttctgttgtgtctatacttcatactatacgtgttgtatagggactagggacaacacatgtaaaccggtgtatttcacaacagcaatgaataaaaggaaggctaactatttccatct

SEQ ID NO: 1705 - DNA, 1569 bp, Tropaeolum majus
tggcctcgtttcttcttccccacctctctctctatatataccgctgaagctcgcttcgttgttcgccattagccttatcagaattcccttttggtttccttttgtctttttgaattcgaaaacctcaattttcaggtcaaatcacaactgggaatggaaaggactgatggaactgattatggcgaatacacttacaaggaactcgagagagagccttactggccatctgaaaagctccgaatttctataacgggggcaggtggtttcattgcttctcacattgctcgtcgtttgaagaacgagggtcactatatcattgcatcggactggaagaagaacgagcacatgacggaggatatgttctgccatgaattccaccttgcagatcttagggtcatgaataattgcttgaaagttactaaggatgttgaccatgtgtttaaccttgcagctgatatgggtggaatgggcttcattcagtctaaccattccgttatcatgtataacaacacaatgattagcttcaacatgctcgaggcggctagaattaacggagttaagagatttttctatgcgtctagcgcatgtatctaccctgaatttaagcagctcgaaacaaatgtgagtttgaaggaggcagacgcctggcctgcagagcctcaagatgcttatggattggaaaagcttgcgacggaggagttatgcaagcactacacgaaagattttggaatcgagtgtcgtattggaaggttccataacatatatggtcctttcggaacatggaaaggtgggagagagaaagctccggctgctttttgtagaaaggctctcacttctacccataagtttgagatgtggggcgatggacttcagactcgatcttttaccttcatcgatgaatgcgttgaaggtgtgctcagattgacaaaatcggatttccgagagccggttaacattggaagcgatgagatggttagcatgaatgagatggctgagatcgtgctcggtttcgacaacaaaaagcttccgatcgaacacattccgggcccagagggtgtccgtggtcgtaactcggataatacacttatcaaagaaaagcttgggtgggcccctacgatgaagttgaaggacggtctgagatttacctacttttggatcaaagaacaaatcgagaaagagaaggttcagggcattgacctgtcggtttatggatcgtctaaagtggtcggaacacaagcgcccgttcaactcggctcacttcgtgctgctgatggcaaagaataaaagctcttactaagttaaagttattggtatcgtattggttcgaccgggtatttgtttggttggcatttcgggattggtttgtgccgtattgtcgtgctgttgtgtactaagggaatatatatatatatgttcgttgtgttttatgtattgcatatttcttcaaaccaagcgtaattcgtgtcgtgtgtgttacgagggtaagtcggatgggtcggttggattttgagattttaaaaacctgatttatgtcggattcttttgatatttgcgttggtgttggatttt

SEQ ID NO: 1706 - DNA, 1669 bp, Solanum phureja
gagagtatggtttatgtgtcatctttctctctctctatatatacccaaattcttgttatcataattgtctctcaaccgttcaattctctttctaatatctctccattgcctcaatctttttctcctgcatacttttagagaatgggaagctctggtggtattaactatggttcttacacttatgagaatcttgagagggaaccttactggccatctgagaaactccgtatttccattactggggctggaggatttatcgcttctcacattgctcgtcgtttgaagagcgagggccactacataattgcctccgattggaagaagaatgagcacatgacagaggatatgttctgtcatgagtttcatcttgcggatcttagggttatggataattgcttgaaggtaacaaaaggtgttgaccatgtcttcaatctcgctgctgatatgggtggcatgggtttcattcagtccaaccactcggttatcttctataacaacactatgatcagcttcaatatgatggaagctgctaggattaacagtgtcaaaaggttcttctatgcatctagtgcttgcatataccccgagttcaaacaactcgaaacaaatgtcagcctgaaagaagctgatgcttggcctgcagagcctcaagatgcatacggcttggaaaagcttgccacagaagaactgtgcaaacattacaacaaggattttggaattgaatgtcgtattggaaggttccataacatctatggaccttttggaacttggaaaggtggaagggaaaaagctcctgccgctttttgtagaaaagcacaaactgcaacggataagtttgaaatgtggggagatggacttcaaacacgttcattcaccttcattgatgagtgtgttgaaggggttcttagattgacaaaatccgacttccgagagccagtgaacataggaagtgatgagatggtcagcatgaatgagatggctgagatggttctcagctttgaggacaagaagcttgctgtccaacacattccaggcccagaaggcgtccgtggtcgcaactcagacaacacactgataaaagagaagcttggttgggctccaacaatgagattgaaggatggtctgagaattacatacttctggatcaaggagcagatcgagaaagagaaatctcaaggagttgatactgcaacctatggatcttccaaggtggtgggcacccaagctccagttgagctaggttcccttcgtgctgctgatggcaaggaataagttcattccttctgtcatcatttcaactggaagccaatccctctgctatgacattgctgcattatgtattatggcgtcgtagaagatgtgttaagttctggtaattgttggcttttcttggttttagtttgaacatgtcaatgtaatctattaccccttggtcttgtgaaggggatgatagtttaatagtatatttatcagtcgttcgagaagatctcaatgtgagaattgaataactgccagtggatcctctcttgttttttttacctagttcaggatcttgctgttgatgatcatgtaatcaaaattttaatcttgttaaggtttatatgtaagatttcattgcaaagttattattatctcttcatatagtaatgagattgaaattttcttagaa

SEQ ID NO: 1707 - DNA, 2530 bp, Pinus taeda
cggccggggggtgtgagttcatagatttgaggtgagcattaactcatcttccattctaagaagcttaagagagagccttttgcatcaagacttcttgtatatcctcctttcactgagcaccatgggaagcattggagctgatggaatgacctatggagaatacacctatgagaatctggatagagagctatactggccaagtgaaaaattgaaaatttccatcactggagctggtgggttcattgcctcccatattgcccggagattgaaatctgaagggcattacattattgcctctgattggaagaagaacgagcacatgactgaggatatgttctgcaatgaattccatctcgtcgatctgagagttatggacaattgcttggctgttacgaaaggagtcgaccatgttttcaacttggccgcagacatgggtggtatgggattcatacagtctaatcactctgttatcatgtacaacaacaccatgatcagtttcaacatgcttgaagctgggcgaatcaatggtgttaaaaggcttttctatgcttctagtgcatgcatttatcccgaattcaaacaattggagaccaatgtaagcttgaaggagtctgatgcttggccagcagagcctcaagatgcatatggcttggaaaagcttgccacagaagaattgtgcaaacactacaccaaggactttggtatagaatgccggatagggcgtttccacaacatttatggtccttttggcacatggaagggtggacgtgagaaggctcctgctgccttttgtaggaagacaatcacatctactgataggtttgaaatgtggggagatggtgagcaaacacgatcctttacattcattgatgaatgtgtggagggtgtcttaaggttgactaagtcagactttagagagccagtgaatattggcagtgatgaaatggtcagcatgaacgagatggctgaaatggtgtcaagcttcgagaataaaaagttgccgatacatcacattcctgggccagagggtgtacgcggtcggaattctgacaatacattgattaaggaaaagctaggctgggcaccaaccatgaagttgaaggatggtttgagaattacttatttctggatcaaggaacaaattgagaaggaaaaggctcagggaattgatctctccatctatgggtcttccaaggtggttggcacgcaagcccctgttcaacttggttctcttcgtgctgctgatggaaaggaatgaaaaccagaacctagatctctggttaagggaataaatgataagtcagttttcatcaatgctcgtgagatggttagcagatggaggccaaaattactttttctgctactatcagcgctttgagaattttaatttagttattaataattattagatagattggtaggaatttaacttccacagaatattgttagtagtagtcaaaatagaaggttgagatttatctgaaaggtacttatgtcatttttactttacaattcaatttgaaaaaaaatcacatgtttacaaagtgtcagattcaatttttattcatgacattggacttttattacttattagttattactgctctaccatgttttttaaaatgtatatatgtttaactcatatattaattcatttttataattaataatataataataacttaaaataaagttataatttagttaacttttacgatttttttatttttttatttttctcatttaataaaattttggcaatgtgagatgtattatgagataagtttcttgatgcttactatggactaatatctatcagtattttccagtcatttaatttatatggctgagctagtctaaatcagtgttttaaaaaatggccagctcggtatttaacccggccagctcggccgagtccgtatcaacctggccgggttacgtacagcagcccaggaaccaaaaaaactgcgatttgtttattaattgctgacaccaaatctcaacagacaaaaatacttcaggataaatctcaggaagatagaaggccttgggactaatgatagaaggtcaagtaaatgactttagaaaacccaaaatatcatggtcaatacaatttttggtgtataatcttttttgtaatttgattgatgttttagaaggcaaaatcatgggagcatatattgtttacaaggagaagtccttagcataaacctgttttatttgtagcctctatgactaaggccaaggagtctcatcaagcaccctaaaagaagcttcataataattctgtctaaagatatgtctggaaggcactaaaatggactaatgacaagtttaacaaaaagcactgatgtcttagtggcatggttgaagtgttggagatctaggcaagcatttgttgctattcaagcactacagtgatgagttagacaaagagacgagcaaagctagaaaccggtggttcatactattggatagtgcactgggtgccattttgatataatggatatattcatgagcctacttgatc

SEQ ID NO: 1708 - DNA, 2531 bp, Pinus taeda
cggccggggaggtgtgagttcatagatttgaggtgagcattaactcatcttccattctaagaagcttaagagagagccttttgcatcaagacttcttgtatatcctcctttcactgagcaccatgggaagcattggagctgatggaatgacctatggagaatacacctatgagaatctggatagagagctatactggccaagtgaaaaattgaaaatttccatcactggagctggtgggttcattgcctcccatattgcccggagattgaaatctgaagggcattacattattgcctctgattggaagaagaacgagcacatgactgaggatatgttctgcaatgaattccatctcgtcgatctgagagttatggacaattgcttggctgttacgaaaggagtcgaccatgttttcaacttggccgcagacatgggtggtatgggattcatacagtctaatcactctgttatcatgtacaacaacaccatgatcagtttcaacatgcttgaagctgggcgaatcaatggtgttaaaaggcttttctatgcttctagtgcatgcatttatcccgaattcaaacaattggagaccaatgtaagcttgaaggagtctgatgcttggccagcagagcctcaagatgcatatggcttggaaaagcttgccacagaagaattgtgcaaacactacaccaaggactttggtatagaatgccggatagggcgtttccacaacatttatggtccttttggcacatggaagggtggacgtgagaaggctcctgctgccttttgtaggaagacaatcacatctactgataggtttgaaatgtggggagatggtgagcaaacacgatcctttacattcattgatgaatgtgtggagggtgtcttaaggttgactaagtcagactttagagagccagtgaatattggcagtgatgaaatggtcagcatgaacgagatggctgaaatggtgtcaagcttcgagaataaaaagttgccgatacatcacattcctgggccagagggtgtacgcggtcggaattctgacaatacattgattaaggaaaagctaggctgggcaccaaccatgaagttgaaggatggtttgagaattacttatttctggatcaaggaacaaattgagaaggaaaaggctcagggaattgatctctccatctatgggtcttccaaggtggttggcacgcaagcccctgttcaacttggttctcttcgtgctgctgatggaaaggaatgaaaaccagaacctagatctctggttaagggaataaatgataagtcagttttcatcaatgctcgtgagatggttagcagatagaggccaaaattactttttctgctactatcagcgctttgagaattttaatttagttattaataattattagatagattggtaggaatttaacttccacagaatattgttagtagtagtcaaaatagaaggttgagatttatctgaaaggtacttatgtcatttttactttacaattcaatttgaaaaaaaatcacatgtttacaaagtgtcagattcaatttttattcatgacattggacttttattacttattagttattactgctctaccatgttttttaaaatgtatatatgtttaactcatatattaattcatttttataattaataatataataataacttaaaataaagttataatttagttaacttttacgatttttttatttttttatttttctcattaaataaaattttggcaatgtgagatgtattatgagataagtttcttgatgcttactatggactaatatctatcagtattttccagtcatttaatttatatggctgagctagtctaaatcagtgttttaaaaaatggccagctcggtatttaacccggccagctcggccgagtccgtatcaacctggccgggttacgtacagcagcccaggaaccaaaaaaactgcgatttgtttattaattgctgacaccaaatctcaacagacaaaaatacttcaggataaatctcaggaagatagaaggccttgggactaatgatagaaggtcaagtaaatgactttagaaaacccaaaatatcatggtcaatacaatttttggtgtataatcttttttgtaatttgattgatgttttagaaggcaaaatcatgggagcatatattgtttacaaggagaagtccttagcataaacctgttttatttgtagcctctatgactaaggccaaggagtctcatcaagcaccctaaaagaagcttcataataattctgtctaaagatatgtctggaaggcactaaaatggactaatgacaagtttaacaaaaagcactgatgtcttagtggcatggttgaagtgttggagatctaggcaagcatttgttgctattcaagcactacagtgatgagttagacaaagagacgagcaaagctagaaaccggtggttcatactattggatagtgcactgggtgccattttgatataatggatatattcatgagcctacttgatc

SEQ ID NO: 1709 - DNA, 1567 bp, Populus trichocarpa
aatcataccctttcattctctctcagccaaactcctttctttctccccacattatcttaattagcaaagcgacgaagcctcaaatttccaagaactcagaatggggactgctgacggaagctatggttcttacacctatgaggccctcgagagggagccttactggccatctgaaaagctcagaatttccatcactggggcagggggttttattgcctcccacattgctcgccgtttgaaggctgagggtcattacattattgcttctgactggaagaagaatgagcacatgacagaagacatgttttgtcatgaattccatcttgttgatctgagagtcatggataattgcttgaaggttacaaaagatgtagaccatgttttcaaccttgctgctgatatgggcgggatgggcttcattcagtccaaccactctgtcattatgtataacaacacaatgatcagcttcaacatgcttgaagcctccaggatcaatggggttaagaggttgttttatgcctctagtgcttgtatttaccctgaatttaagcagctggagactaatgtgagcctgaaggaatctgatgcctggcctgcagagcctcaagatgcttatggattggagaagcttgcaacggaagagttgtgcaagcattacaccaaagactttggaattgaatgccgtattggaagattccataacatttatggtccttttggaacatggaaaggtggcagggagaaggcacccgctgctttctgcagaaaggctatcacttccattgataaattcgagatgtggggagatggacttcaaacccgatctttcacattcattgatgagtgtgtggaaggtgtgcttagattgacaaagtcagacttccgtgagccagtgaacattggaagtgatgagatggttagcatgaatgagatggctgagattgttctcagctttgagaacaagaatctccccattcatcacattcctggcccagaaggtgtgcgtgggcgtaactctgacaacacactaatcaaagagaagcttggttgggctcctacaatgaggctgaaggatgggctgagaattacttacttttggatcaaggaacagattgagaaagagaaatccaaaggaattgacctgtctatttatggttcatcgaaagtggtgggaactcaagcacctgttcaattgggctcgctccgcgctgctgatggtaaagaatgaaatggttaaagctatggatgttttgcagttatccttcagaaacccaacttttctcattacgatatgggaatgatatggtggtgggaaattagctatggttctggagttacaaggcaataatccgcattgtttttaggttgaagcactattctagttttcgggtgtgtaccatgttggtatttccgagggaagcttttataccctcattttatcaatctggcttttctagcaacctgctactctgatattatgttgcaggcataatagccgtggaccttgcttttgttcctactatatttacctttgggctgtaatgaataataaatatatttttcttca

SEQ ID NO: 1710 - DNA, 1638 bp, Populus trichocarpa
aatcataccctttcattctctctcagccaaacccctttctttctccccacattatcttaattagcaaagcgacgaagcctcaaatttccaagaactcagaatggggactgctgacggaagctatggttcttacacctatgaggccctcgagagggagccttactggccatctgaaaagctcagaatttccatcactggggcagggggttttattgcctcccacattgctcgccgtttgaaggctgagggtcattacattattgcttctgactggaagaagaatgagcacatgacagaagacatgttttgtcatgaattccatcttgttgatctgagagtcatggataattgcttgaaggttacaaaagatgtagaccatgttttcaaccttgctgctgatatgggcgggatgggcttcattcagtccaaccactctgtcattatgtataacaacacaatgatcagcttcaacatgcttgaagcctccaggatcaatggggttaagaggttgttttatgcctctagtgcttgtatttaccctgaatttaagcagctggagactaatgtgagcctgaaggaatctgatgcctggcctgcagagcctcaagatgcttatggattggagaagcttgcaacggaagagttgtgcaagcattacaccaaagactttggaattgaatgccgtattggaagattccataacatttatggtccttttggaacatggaaaggtggcagggagaaggcacccgctgctttctgcagaaaggctatcacttccattgataaattcgagatgtggggagatggacttcaaacccgatctttcacattcattgatgagtgtgtggaaggtgtgcttagattgacaaagtcagacttccgtgagccagtgaacattggaagtgatgagatggttagcatgaatgagatggctgagattgttctcagctttgagaacaagaatctccccattcatcacattcctggcccagaaggtgtgcgtgggcgtaactccgacaacacactaatcaaagagaagcttggttgggctcctacaatgaggctgaaggatgggctgagaattacttacttttggattaaggaacagattgagaaagagaaatccaaaggaattgacctgtctatttatggttcatcgaaagtggtgggaactcaagcacctgttcaattgggctcgctccgcgctgctgatggtaaagaatgaaatggttgaagctatggatgttttgcagttatccttcagaaacccaacttttctcattacgatatgggaatgatatggtggtgggaaattagctatggttctggagttacaaggcaataatccgcattgtttttaggttgaagcactattctagttttcgggtgtgtaccatgttggtatttccgagggaagcttttataccctcattttatcaatctggcttttctagcaacctgctactctgatattatgttgcaggcataatagccctggaccttgcttttgttcctactatatttacctttgggctgtaatgaataataaatatatttttcttcatccatgcatcttgtaatttcttagtttaagcttctacgcagtcatctgggaataaataaccttttctcgta

SEQ ID NO: 1711 - DNA, 1794 bp, Solanum tuberosum
gagagtatggtttatgtgtcatctttctctctctctatatatacccaaattcttgttatcataattgtctctcaaccgttcaattctctttctaatatctctccattgcctcaatctttttctcctgcatacttttagagaatgggaagctctggtggtattaactatggttcttacacttatgagaatcttgagagggaaccttactggccatctgagaaactccgtatttccattactggggctggaggatttatcgcttctcacattgctcgtcgtttgaagagcgagggccactacataattgcctccgattggaagaagaatgagcacatgacagaggatatgttctgtcatgagtttcatcttgcggatcttagggttatggataattgcttgaaggtaacaaaaggtgttgaccatgtcttcaatctcgctgctgatatgggtggcatgggtttcattcagtccaaccactcggttatcttctataacaacactatgatcagcttcaatatgatggaagctgctaggattaacagtgtcaaaaggttcttctatgcatctagtgcttgcatataccccgagttcaaacaactcgaaacaaatgtcagcctgaaagaagctgatgcttggcctgcagagcctcaagatgcatacggcttggaaaagcttgccacagaagaactgtgcaaacattacaacaaggattttggaattgaatgtcgtattggaaggttccataacatctatggaccttttggaacttggaaaggtggaagggaaaaagctcctgccgctttttgtagaaaagcacaaactgcaacggataagtttgaaatgtggggagatggacttcaaacacgttcattcaccttcattgatgagtgtgttgaaggggttcttagattgacaaaatccgacttccgagagccagtgaacataggaagtgatgagatggtcagcatgaatgagatggctgagatggttctcagctttgaggacaagaagcttgctgtccaacacattccaggcccagaaggcgtccgtggtcgcaactcagacaacacactgataaaagagaagcttggttgggctccaacaatgagattgaaggatggtctgagaattacatacttctggatcaaggagcagatcgagaaagagaaatctcaaggagttgatactgcaacctatggatcttccaaggtggtgggcacccaagctccagttgagctaggttcccttcgtgctgctgatggcaaggaataagttcattccttctgtcatcatttcaactggaagccaatccctctgctatgacattgctgcattatgtattatggcgtcgtagaagatgtgttaagttctggtaattgttggcttttcttggttttagtttgaacatgtcaatgtaatctattaccccttggtcttgtgaaggggatgatagtttaatagtatatttatcagtcgttcgagaagatctcaatgtgagaattgaataactgccagtggatcctctcttgttttttttacctagttcaggatcttgctgttgatgatcatgtaatcaaaattttaatcttgttaaggtttatatgtaagatttcattgcaaagttattattatctcttcatatagtaatgagattgaaattttcttaggaaaaaagcgtaagcgacagaaactcggggaggggacacggtacccaaattcggacctaatagtggagtcggtattaacgcgggcgcttcacatgggcccgtacgtttttacaacacgttccgtgac

SEQ ID NO: 1712 - DNA, 1794 bp, Solanum tuberosum
gagagtatggtttatgtgtcatctttctctctctctatatatacccaaattcttgttatcataattgtctctcaaccgttcaattctctttctaatatctctccattgcctcaatctttttctcctgcatacttttagagaatgggaagctctggtggtattaactatggttcttacacttatgagaatcttgagagggaaccttactggccatctgagaaactccgtatttccattactggggctggaggatttatcgcttctcacattgctcgtcgtttgaagagcgagggccactacataattgcctccgattggaagaagaatgagcacatgacagaggatatgttctgtcatgagtttcatcttgcggatcttagggttatggataattgcttgaaggtaacaaaaggtgttgaccatgtcttcaatctcgctgctgatatgggtggcatgggtttcattcagtccaaccactcggttatcttctataacaacactatgatcagcttcaatatgatggaagctgctaggattaacagtgtcaaaaggttcttctatgcatctagtgcttgcatataccccgagttcaaacaactcgaaacaaatgtcagcctgaaagaagctgatgcttggcctgcagagcctcaagatgcatacggcttggaaaagcttgccacagaagaactgtgcaaacattacaacaaggattttggaattgaatgtcgtattggaaggttccataacatctatggaccttttggaacttggaaaggtggaagggaaaaagctcctgccgctttttgtagaaaagcacaaactgcaacggataagtttgaaatgtggggagatggacttcaaacacgttcattcaccttcattgatgagtgtgttgaaggggttcttagattgacaaaatccgacttccgagagccagtgaacataggaagtgatgagatggtcagcatgaatgagatggctgagatggttctcagctttgaggacaagaagcttgctgtccaacacattccaggcccagaaggcgtccgtggtcgcaactcagacaacacactgataaaagagaagcttggttgggctccaacaatgagattgaaggatggtctgagaattacatacttctggatcaaggagcagatcgagaaagagaaatctcaaggagttgatactgcaacctatggatcttccaaggtggtgggcacccaagctccagttgagctaggttcccttcgtgctgctgatggcaaggaataagttcattccttctgtcatcatttcaactggaagccaatccctctgctatgacattgctgcattatgtattatggcgtcgtagaagatgtgttaagttctggtaattgttggcttttcttggttttagtttgaacatgtcaatgtaatctattaccccttggtcttgtgaaggggatgatagtttaatagtatatttatcagtcgttcgagaagatctcaatgtgagaattgaataactgccagtggatcctctcttgttttttttacctagttcaggatcttgctgttgatgatcatgtaatcaaaattttaatcttgttaaggtttatatgtaagatttcattgcaaagttattattatctcttcatatagtaatgagattgaaattttcttagaaaaaaagcgtaagcgacagaaactcggggaggggacacggtacccaaattcggacctaatagtggagtcggtattaacgcgggcgcttcacatgggcccgtacgtttttacaacacgttccgtgac

SEQ ID NO: 1713 - DNA, 1671 bp, Oryza sativa
gatcctgtgggggtgtgcaagaatctacctcccctccccaaatctcgctcccacgcctcttccttccgacttgtgacagaatggcgctcaatgaggagtacacatacgtggagctggagaaggagccttactggccatttgagaagctgcggatctcgattacgggagctggcgggttcatcgcatcccacatcgcgaggcgcctcaagagcgagggccactacatcattgcttctgactggaagaaaaatgagcacatgactgaggatatgttctgccatgagttccatcttgttgatttgagggtgatggacaactgcctcaaggtgaccaccggggttgaccatgttttcaaccttgccgctgatatgggagggatgggattcattcaatccaatcactctgttatcatgtacaacaacaccatgatcagctttaacatgcttgaggccgctaggattaatggtgtcaaaaggttcttttatgcttcaagtgcttgtatctaccctgaatttaagcagctggacactgtagttagcttgaaggagtcagatgcttggcctgcagagcctcaagatgcctatggcttggaaaaacttgctactgaggaactgtgcaagcattacacaaaggattttggcattgaatgtcgggttggccgctttcataatatctatggtccctttggaacatggaagggtggaagggagaaggcgcctgctgctttctgcagaaaagctctaacctccactgaccgttttgagatgtggggagatggtcttcagactagatccttcacgtttattgatgaatgtgtggagggtgtcctcaggttgacaaagtccgatttccgtgagcctgtaaacattggaagtgatgaaatggtcagcatgaatgagatggctgagatagtcctcagctttgagaacaagcagctgcccatccaccacatccccgggccagagggtgtccgtggtcgcaactccgacaacacgctcatcaaagagaagcttggctgggctccaaccatgaggctgaaggatggtctgaggatcacatacttctggatcaaggagcagctcgagaaggagaaggccgagggcgtcgacttgtcggcctacgggtcatccaaggtagtgcagactcaggcgccggtgcagcttggctccctccgtgctgctgatggaaaggagtgagctctcaccctgggcaggaaacaggcatcatcatgatatagtgctactggtttcagaatttttcagatgccatatgatggttgccagccaccaccatctatacaatttcttgattctgttttggacttcacttcctgaaagatcaaagtttactagtctgcaattttcacttctttgtgttgtaaacgagggtaaaccgcttttatatatatacaagagggtgataatggtatagcattacaggggggaaaaacttcacaagaacaatggaattaagaatgaattcaagatatatgtggcctgagctgtgttaagcattcttaggctgtgtttagttggtggaaaaagtgggaattttgaagaaagttggtagtttgaaaaaaaagttagaagtttatgtgtgtaggaaagtttttgatgtgatggaaagttggaagtttgaagttggtggaggggaactaaacacggccttagg

SEQ ID NO: 1714 - DNA, 1634 bp, Picea glauca
actcatcttccattctaagaagtttcagagagtttttcgcatcaagacttgttgtatattctcctttcattgagcaccatgggaagcattggagctgacggagtaacctttggggaatacacctatgagaatctggacagagagctatactggccaagtgaaaaattgaaaatttccatcactggagctggtgggttcattgcctcccatattgcccggagattgaaatctgaagggcactacattattgcctctgattggaagaagaacgagcacatgaccgaggatatgttctgcaatgaattccatctcgtggatctgagagttatggacaattgcttggctgttaccaaaggagttgaccatgttttcaacttggccgcagacatgggtggtatgggattcattcagtctaatcactctgttatcatgtacaacaacaccatgatcagcttcaacatgcttgaagctgcccgaatcaatggtgttaaaaggtttttctatgcttctagtgcatgcatttatcccgaattcaaacaattggagaccaacgtgagcttgaaggagtctgatgcttggccagctgagcctcaagatgcctatggcttggaaaagcttgccacagaagaattgtgcaaacactacaccaaggactttggtatagaatgcaggatagggcgtttccacaacatttatggtccttttggcacatggaagggtggacgtgagaaagcacctgctgctttttgtaggaagacaatcacatccactgacaggtttgaaatgtggggcgatggcgagcaaacgcgatcctttacattcattgatgaatgtgtggagggtgtccttaggttgactaaatcagactttagagagccagtgaatattggcagtgatgaaatggtcagcatgaacgagatggctgaaatggtgtcaagctttgagaacaaaaagttgccgatacatcacatccctgggccagagggtgtacgtggtcggaattctgaaaatacattgattaaggaaaagctaggctgggcaccaaccatgaagttgaaggatggcttgaggattacttatttctggatcaaggaacaaattgagaaggaaaaggctcagggaattgatctctctatctatgggtcttccaaggtggttggcactcaagcccctgttcaacttggttctcttcgtgctgctgatggaaaggaatgaagaccaaaacctagatctctggttaaagggataaataataagtcagttttctatgaggctcgcgagatggttagcagctggggaccaaaattattttgtctgctattctcatttttctcttcggtttagtaagttcatttagatggtgagatcatgtgatctgtattattacaggagatctattctcatttttctctttggtttagtaagttcatttagatggtgagatcatgtgatctgtattattacaagagaggaaggaaacttctttttatacaaagagagggaagctttgttccaatctaattttatagggtcattatttttttttaaaagctaaacattttaattaagggtttcttaatttaaaggactaaaaaatgataattacaatattgcaatgacttggtactaaaaaa

SEQ ID NO: 1715 - DNA, 1611 bp, Panicum virgatum
ggtatttaagagcggccggaggtgaagggggagatccggcgagctgcttcccctgtcaggaatccccctccgccgctcccgaatcttgctccggcgccggcaccccatcgcttgccagaatggcgctcaacaaggagtacacgtacgcggagctggagaaggagccctactggccatttgagaagctgcggatctccatcacgggcgccggtgggttcatcgcgtcccacatcgcgaggcgcctcaagagcgagggccactacatcatcgcctctgactggaagaagaatgagcacatgaccgaggacatgttctgccatgagttccatcttgtcgacctgagggtcatggacaactgcctcaaggtgaccacgggggttgaccatgtgttcaaccttgctgctgatatgggtgggatggggttcatccagtccaaccactctgtgatcatgtacaacaacaccatgatcagctttaacatgcttgaggctgctagaattaacggcgtcaagaggttcttttatgcatcaagcgcctgtatttatcctgaatttaagcagttggagactgtagttagcttgaaggagtcagatgcctggcctgcagagcctcaagatgcctatggcttggagaaacttgctactgaggaactgtgcaagcactacacaaaggattttggcattgagtgccggatcggtcgctttcacaacatatatggtccctttggaacatggaaaggtggaagggagaaggcacctgctgctttctgcagaaaggctttaacctccacagggcgctttgagatgtggggagatggtctgcaaaccagatccttcacatttattgatgaatgtgttgagggtgtccttaggttaacaaagtctgatttccgtgagcctgtaaacattggaagtgacgaaatggtcagtatgaatgagatggctgagatagtcctcagctttgagaacaagcagctgcccatccaccacattcctgggccggagggtgtgcgggggcgcaactcagacaacacactcatcaaggagaagctcggctgggctccgaccatgaagctgaaggatggactgaggataacatacttctggatcaaggagcagcttgagaaggagaaggctgagggcatggacctatcggtctacggatcatccaaggtcgtgcagactcaggcccctgttcagctcggttccctccgcgctgccgatggcaaggagtgaccgcaccgcggtgccagtcggtcacttgaggcctcagcagagagcataatataccaactatacccggtggttgcagttgccacgattctcgtcaccacctacaccatttcttgattcacttcggactctacaaggggactgtttggatggcggatattttatcggaaagttatgggattcagtccagatttggagaatacaaaacattctgacaaaatatcctgtccaaacacttacagtattttccatgttttttctcttctttgtctctttcatacaataggatattacagggacaacacatatgtaaaccggcgtcagtttatttatttcacaatagcaatgaatgaataaaataaggtttgagcttttccat

SEQ ID NO: 1716 - DNA, 1476 bp, Triphysaria pusilla
attcacaagaaggagagagttctatttatctacatcgaattaaaaatccaatctttttgagaatgggaagcactggcgaaccggtttacggggcctacacttacgaaagcctcgagagggaaccctattggccctcggaaaagctccgaatctcgattactggagctggtggttttatcgcttctcacatcgcgaggcgtctgaagagcgagggccattacataattgcctccgactggaagaaaaacgagcacatgtcagaggatatgttctgtcatgaattccatctggtcgatctgagggtgatggataactgtttgaaagtcactgaaagtgttgatcatgtctttaatctggcagctgatatgggcggcatgggcttcattcagtcgaaccactctgttatcatgtataacaatacgatgatcagttttaatatgatcgaggctgctagaattaatgccgttaagaggttcttttatgcttccagtgcttgtatctatcctgaatttaagcagctggaaaccaatgttagcagcttgaaagaatccgatgcctggcccgccgagcctcaagatgcttatgggctagagaagcttgcaactgaggagttgtgtaagcactacaacaaagactttggaattgagtgccggatcggaaggttccataacatttatggcccctttggaacatggaaaggtggaagggagaaagcgccagctgccttctgtaggaaagcactaacttcgacggataagtttgagatgtggggagatggcctgcaaactcgttcgtttacttttatcgatgaatgtgtcgagggtgttttaagattgactaaatcggactttagagagccagtaaacatcggaagtgatgagatggtgagcatgaacgagatggccgagattgtccttagcttcgacaacaagaaactccccatccaccacatcccgggcccagaaggcgtgcgtggccgaaattcagacaacactttaatcaaggaaaagcttgggtgggccccgacaatgaaactaaaggatgggctgagaatcacttatttctggatcaaagaacagcttgaaaaggagaaaacgaagggtgtcgatttgtctaattatgggtcgtcaaaggttgtcgggactcaagctccggttcaactcggttctcttcgagctgctgatggcaaagaatgaaggatgaagaaaatgggtttcattttttatgctccaccttatgctgctggagtaaaatatatgcttttagtatttattaattttagttctgaatatgcttttatagttacaaaatgcaattatgaataactacattcagttgctgtgaaaattctgcattatttgaattatattttaaaggaatgcgatttcagtagttattttttggaagtttggaccttgtttgtgatgaccatgtaacttcactacacaaaaaaaaaaacttgtggatgcctatgaa

SEQ ID NO: 1717 - DNA, 1457 bp, Aquilegia formosa
gagattttctgaagaacttgtttcaaccaataacactttctccttcttttctcttacccgattcaaagtcattttccccgcaacactctctaaagagaatggggagtactgatgccgccaccaagtatggggagtacacttacgagcaattggagagggagctttactggccatctgagaagctccgcatctctattactggtgctggtgggttcatagcatcccacattgctcgaagactgaagaccgaaggacactacatcattgcttctgactggaagaagaatgagcatatgcccgaggacatgttttgtcatgagtttcaccttgcagatcttagggtcatggataactgtatgaaggtcacctctggggtggatcatgtttttaaccttgctgctgatatgggtggaatggggtttatccaatcgaaccactcagtcatcatgtataacaacactatgatcagtttcaacatgcttgaggctgctaggattaatggtgtcaagaggtttttctatgcatccagtgcgtgtatctaccctgaattcaagcaattggaaacctctaatgttagtttgaaggaggctgacgcttggccagcagagcctcaagatgcatatggtctcgaaaagcttgcaacagaggaattatgtaagcactacaccaaagactttggaattgagtgtcgtattggacgattccacaacatttatggcccctttgggacatggaaaggtggaagggagaaagcccctgctgctttttgtaggaaggccctcactgccattgacaagtttgagatgtggggggatggactgcagaccaggtccttcacttttattgatgaatgcgttgaaggtgtgctgagattaacaaagtcagacttccgggagcctgtgaatattggaagtgatgagatggtcagtatgaatgagatggctgagattgtgctcggctttgaggacaagaagcttcctatccaacatattcctggtcccgagggtgtgcgaggtcgcaactctgacaacactttgataaaagagaagcttggttgggccccaactatgagattgaaggatggactgaggatcacatacttttggatcaaggaacaaattgaaaaagaaaagactcgtggcattgatctctcagtttatggatcttcaaaagttgttggaacgcaggcacctgtccagctgggctcacttcgtgcggctgatggcaaagagtgaaccaggtgaagccagtacttcttgatccacaactttattgttttggagggcaagatgttttaataacttataattcaagctagtatgtgggtcttctgtcattacatatcttcatttatgggagggatgcttattttttcactgtatttcctttggcttttagtgtgaacttgatgctaggatgtaataaccattatatatatatttcaatctctttcctat

SEQ ID NO: 1718 - DNA, 1459 bp, Aquilegia formosa
gagattttctgaagaacttgtttcaaccaataacactttctccttcttttctcttacccgattcaaagtcattttccccgcaacactctctaaagagaatggggagtactgatgccgccaccaagtatggggagtacacttacgagcaattggagagggagctttactggccatctgagaagctccgcatctctattactggtgctggtgggttcatagcatcccacattgctcgaagactgaagaccgaaggacactacatcattgcttctgactggaagaagaatgagcatatgcccgaggacatgttttgtcatgagtttcaccttgcagatcttagggtcatggataactgtatgaaggtcacctctggggtggatcatgtttttaaccttgctgctgatatgggtggaatggggtttatccaatcgaaccactcagtcatcatgtataacaacactatgatcagtttcaacatgcttgaggctgctaggattaatggtgtcaagaggtttttctatgcatccagtgcgtgtatctaccctgaattcaagcaattggaaacctctaatgttagtttgaaggaggctgacgcttggccagcagagcctcaagatgcatatggtctcgaaaagcttgcaacagaggaattatgtaagcactacaccaaagactttggaattgagtgtcgtattggacgattccacaacatttatggcccctttgggacatggaaaggtggaagggagaaagcccctgctgctttttgtaggaaggccctcactgccattgacaagtttgagatgtggggggatggactgcagaccaggtccttcacttttattgatgaatgcgttgaaggtgtgctgagattaacaaagtcagacttccgggagcctgtgaatattggaagtgatgagatggtcagtatgaatgagatggctgagattgtgctcggctttgaggacaagaagcttcctatccaacatattcctggtcccgagggtgtgcgaggtcgcaactctgacaacactttgataaaagagaagcttggttgggccccaactatgagattgaaggatggactgaggatcacatacttttggatcaaggaacaaattgaaaaagaaaagactcgtggcattgatctctcagtttatggatcttcaaaagttgttggaacgcaggcacctgtccagctgggctcacttcgtgcggctgatggcaaagagtgaaccaggtgaagccagtacttcttgatccacaactttattgttttggagggcaagatgttttaataacttataattcaagctagtatgtgggtcttctgtcattacatatcttcatttatgggagggatgcttattttttcactgtatttcctttggcttttagtgtgaacttgatgctaggatgtaataaccattatatatatatatttcaatctctttcctat

SEQ ID NO: 1719 - DNA, 1620 bp, Saccharum officinarum
atcgctgctactcctatttaagagctgccagaggtgggggagatccggcaagccgtttcccctgtcaagattcaggaaccagactcctcgggtcctccctcccgtctcgctccagccgccggcccgccgcgccaccgtttgccattgccagaatggcgctcaacaaggagtatacgtacgcggagctggagaaggagccatactggccgttcgagaagctgcggatctccatcactggggctggtgggttcattgcctcccacatcgcgcgccgcctcaagagtgagggccactacatcatcgcctctgactggaagaagaacgagcacatgtccgaggacatgttctgccacgagttccacctcgtcgacctgagggtgatggacaactgcctcaaggtcaccacaggggttgaccatgtgttcaacctcgcggctgatatgggtgggatgggcttcatccagtccaaccactctgtgatcatgtacaacaacaccatgatcagctttaacatgcttgaggctgctagaattaatggtgtcaagaggttcttttatgcatcaagtgcctgcatctaccctgaatttaagcagttggaaactgtagttagcttaaaggagtcagatgcttggcctgctgagcctcaagatgcctatggcttggaaaaacttgctactgaggaactgtgcaagcactatacaaaggattttggcattgagtgccgggtcggtcgctttcacaacatatatggtccctttggaacatggaaaggtggaagggagaaggcgcctgctgctttctgcagaaaggctttaacctccactgggcgctttgagatgtggggcgatggcctgcaaaccagatccttcacatttattgatgaatgtgttgaaggtgtccttaggttaacaaagtctgatttccgtgagcctgtaaacattgggagtgacgaaatggtgagcatgaacgagatggctgaaatagtcctgagctttgagaacaagcagctgcccatccaccacattcctgggccggagggtgtgcgtgggcgcaactcagacaacacactcattaaggagaagcttggctgggctccgactatgaggctgaaggacggactgaggatcacctacttctggatcaaggagcagcttgagaaggagaaggctgacggcatggatctgtcggtctacggatcatccaaggttgtgcagacacaggccccggttcagctcggctccctccgcgctgctgatggcaaggagtgaactttggctgcgccggtcagtcgcccgagacctgggcagagagcatgatatactaatatacacagtggtttcagtttccatgatctgtagtcaccacctatacaccatttcttgattcacttttgactccacaagaggatgatttggatgatggatattttgttggcagttatgagatttagttcaaatttgaactaaataaatacaaaaaattctgacaaaatacccatcgtccaaacacttataataatttccatgtttagcatattacaagaggtacaacacttctgtaaactggtgtcactttatttcacaaaaatagcaatgaataaattgaggttcagcatttccc

SEQ ID NO: 1720 - DNA, 1561 bp, Saccharum officinarum
  misc_feature (900)..(900): n is a, c, g, or t
  misc_feature (1149)..(1149): n is a, c, g, or t
  misc_feature (1265)..(1265): n is a, c, g, or t
  misc_feature (1420)..(1420): n is a, c, g, or t
ccctgtcaagattcaggaaccagactcctcgggtcctccctcccgtctcgctccagccgccggcccgccgcgccaccgtttgccattgccagaatggcgctcaacaaggagtatacgtacgcggagctggagaaggagccatactggccgttcgagaagctgcggatctccatcactggggctggtgggttcattgcctcccacatcgcgcgccgcctcaagagtgagggccactacatcatcgcctctgactggaagaagaacgagcacatgtccgaggacatgttctgccacgagttccacctcgtcgacctgagggtgatggacaactgcctcaaggtcaccacaggggttgaccatgtgttcaacctcgcggctgatatgggtgggatgggcttcatccagtccaaccactctgtgatcatgtacaacaacaccatgatcagctttaacatgcttgaggctgctagaattaatggtgtcaagaggttcttttatgcatcaagtgcctgcatctaccctgaatttaagcagttggaaactgtagttagcttaaaggagtcagatgcttggcctgctgagcctcaagatgcctatggcttggaaaaacttgctactgaggaactgtgcaagcactatacaaaggattttggcattgagtgccgggtcggtcgctttcacaacatatatggtccctttggaacatggaaaggtggaagggagaaggcgcctgctgctttctgcagaaaggctttaacctccactgggcgctttgagatgtggggcgatggcctgcaaaccagatccttcacatttattgatgaatgtgttgaaggtgtccttaggttaacaaagtctgatttccgtgagcctgtaaacattgggagtgacgaaatggtnagcatgaacgagatggctgaaatagtcctgagctttgagaacaagcagctgcccatccaccacattcctgggccggagggtgtgcgtgggcgcaactcagacaacacactcattaaggagaagcttggctgggctccgactatgaggctgaaggacggactgaggatcacctacttctggatcaaggagcagcttgagaaggagaaggctgacggcatggatctgtcggtctacggatcatccaaggtngtgcagacacaggccccggttcagctcggctccctccgcgctgctgatggcaaggagtgaactttggctgcgccggtcagtcgcccgagacctgggcagagagcatgatatactantatacacagtggtttcagtttccatgatctgtagtcaccacctatacaccatttcttgattcacttttgactccacaagaggatgatttggatgatggatattttgttggcagttatgagatttagttcaaatttgaactaaataaatacaaaanattctgacaaaatacccatcgtccaaacacttataataatttccatgtttagcatattacaagaggtacaacacttctgtaaactggtgtcactttatttcacaaaaatagcaatgaataaattgaggttcagcatttccc

SEQ ID NO: 1721 - DNA, 1655 bp, Solanum melongena
caaccattttctgttttccataaattctggtccacataaatatattgcgcaccattgtaatcttgaaccaagaaaccctgcaacttaggtaattattgaagagctctctctatatataaaaaatatattaaaagatagagatctataaccccccaaaaagaaacataaaaaaagacatagccccttatcattgttgagttctccatttctttcaagacctcaaaagtccaaatttttcaagaatgggaacttctgttgaaaccacttatggagaatacacatatgaaaaccttgagagggaaccctactggccttcagagaagcttcggatctctattacaggagctggtggattcattgcctcacacattgcaaggcgtctgaagaccgaggggcattacattattgcttctgactggaagaagaatgagcacatgtctgaagacatgttttgtcatgagttccatcttgttgatctcagggttatggataactgtttgaaagttacaaaaggagttgatcatgtgttcaatctcgctgccgatatgggaggtatgggcttcattcagtccaaccactcagtgatcatgtataacaacactatgatcagctttaacatgatggaggcttcaagaataaacggtattaagaggttcttttatgcatcaagtgcttgcatctaccctgaatttaagcagttggaaactaacgtgagcttaaaggagtctgatgcttggcctgcagagcctcaagatgcttatggcttagaaaagcttgcaactgaggagttgtgtaagcattacaacaaggacttcggaattgaatgtcgcattggacgtttccataacatttatggcccatttggaacatggaaaggcggacgcgagaaagcaccagcagctttttgtagaaaagccctcacttccactgacaaatttgagatgtggggagatggaaagcaaactcgatctttcacattcatcgacgagtgtgttgaaggtgttttgaggttaacaaaatcagactttagagagcctgtgaacatcggaagtgatgagatggtaagcatgaatgagatggcagagatagtcctcagctttgatggaaagaaccttcctatccatcacatccctggaccagagggtgtgcgtggtcgaaactctgacaacactctcatcaaggaaaagcttggctgggctcctacaatgaagttgaaggacgggttgagatttacatatttatggatcaaggaacaaattgagaaagagaaggtaaagggtgctgatgtgtccatttatgggtcatccaaagttgtgggaacacaagctccagttgaattgggctcccttcgcgctgctgatggcaaagagtgaaccaagttattctcgttcattatgcacaatggccatcggttagttccaccatgttttgtttgcgtggaatgtttacctattgatatctttatactatgtgctaaagcagttggttctttttctttttcacgtcaactcattgttgcacctataccaaataatgctcaagacaatgtactagtccagttatgcttgcattttgtgatttctttttgccattgatggcattttctgagtttgtatggaacatagccatttgctatcaatctgtcattttcttgc

SEQ ID NO: 1722 - DNA, 1505 bp, Mimulus guttatus
acagaagaagcagagagatctactcgaaaaacatttccatatctgcatctctgaaactcaagctttttcgagaaaatgggaagcaccggtgaaaacttgtacaaggcctacacgtacgagaatctcgagacggagccctattggccctcggaaaagctccggatctccataactggtgctggaggattcatcgcgtctcacattgcgaggcgtttgaagagcgaaggtcattacatcatcgcatcggactggaagaaaaacgagcacatgcccgaggacatgttttgtcatgaattccacctcgttgatctgagggtcatggataactgtctgaaagtaaccgaaggtgtggatcatgtctttaatcttgctgctgatatgggagggatgggcttcattcagtcgaaccactccgtcattatgtacaacaatactatgatcagttttaatatgatcgaggctggcagaattaacggagttaagaggtttttctacgcctcaagtgcgtgtatttatcccgaatttaagcaactggagaccaatgtgagcttgaaagaatctgatgcatggcccgccgagcctcaagatgcttacggtctagagaagctggcgacagaggaattatgtaagcactacaacaaggactttggaatcgagtgcagaatcggaaggttccataatatctacggtccctttggaacatggaaaggtggaagggaaaaagcaccagctgctttctgtaggaaaactctcacttctaccgataaattcgaaatgtggggagatggcctccaaactcgatctttcacattcatcgatgaatgcgttgagggtgttttaagattaactaaatcggacttccgagagcctgtgaatattggaagtgacgaggaggtgagcatgaacgggatggccgaaattatctcgagcttcgaggataagaagcttccgatccaccacattccgggacccgagggtgtacgtggtcgaaattccgataataccctaattaaggaaaagctcggatgggccccgtctatgaaactaaaggatggattgagaatcacgtatttctggattaaggaacaactcgagaaagagaaaaccctaggggtagatttgtcaaattacggctcgtcgaaagtcgtgggaactcaagccccggttcaactcggctctcttcgtgctgctgatggcaaagaatgaagaaattatctaagaaaaaaaaaacagctctttttaatcgtttttctttcgccgcaacgttatgtttgatctctaaattttactacaatgtgttttgttctttgttttttctaatcttgatttgtatgaaatcttcaacaaatttgaaagttgtatttggtttatcctttatttttaaaatacctatttgcaaggttgatttgtggcagttatatgtcaccgtctaataaaattgcaacttgttttcgagcttttttgttgatagtttgattgaaaaagaaattgcactttctttattt

SEQ ID NO: 1723 - DNA, 1353 bp, Mimulus guttatus
agagatctatcatcagaggaagcatttcgaagaacccaagctttctgagaatggcaagcagtgacgaaaccaactatggatcatacacatacgaaaccctcgaaagggaaccctactggccatctgaaaagcttcggatttccattacgggagcaggtggatttatcgcttcccatattgccaggcgtttgaagagtgagggccattacatcatcgcttcggattggaagaaaaacgagcacatgacggaggatatgttctgtaatgaattccatctcgttgatctgagggttatggacaactgtctgaaagtaaccgacggtgtggatcacgtcttcaatcttgctgccgatatgggaggcatgggcttcattcaatccaaccactccgtcattatgtacaacaatacaatgatcagctttaacatgattgaagctgcaagaatcaacggtgttaagaggtttttttatgcatcgagtgcttgtatctatccggaatttaaacagttggagactaatgtgagcttgaaggaatctgatgcatggcctgctgagcctcaagatgcttatgggttagagaagctggcaaccgaagaattatgtaagcactacaataaggacttcgggattgaatgccggattggaaggtttcataacatttatggtccctttgggacatggaaaggtggcagggagaaagcaccagctgccttctgtaggaaatcacttacttcaaccgataagtttgaaatgtggggtgacggtttgcaaactcgatctttcacctttattgatgaatgtgttgaaggtgttctcagattgactaagtccgacttccgagagccggtgaatattgggagtgatgagatggtgagcatgaatgaaatggcagagattgtacttggcttcgagaacaagaaactgcccatttatcacattccagggcctgaaggtgttcgtggccgaaattcagacaatactttgattaaggaaaagcttgggtgggccccttctatgaaacttaaggacgggctgagaataacgtatttctggataaaggagcaacttgaaaaggagaaagctcatggaacggacttgtctgcttacggctcttcgaaagttgtcggaacacaggctcccgttcaactcggttctctccgagctgctgatggcaaggaatgaacataacaacagcttatatatgtatgtatgtatgtatactgctagagtcgatcatctgctattcgagcttttcgaatgtgtttgtatgttcgaatttgattatgaaatcatgaattctattcccatctatattgttttaaagtttaacaaagtacatccagtttgagcttgc

SEQ ID NO: 1724 - DNA, 1455 bp, Phaseolus coccineus
caaatccttttcactttcatttatcagcatgggaagttccggagccaacgactatggagcatacacttaccaaaaccttgagagggaaccttactggccctctgaaaagctcagaatttccatcaccggggctggtggtttcattgcctcacacattgcacgccgtctcaagactgaggggcattacatcattgcttctgattggaagaaaaatgagcacatgactgaagacatgttctgccatgagttccatcttgttgatcttagggtcatggataactgcttggcagttaccaagggtgtggatcatgttttcaatcttgctgctgatatgggtggaatgggttttatccagtcaaatcactcagtcattatgtacaacaacaccatgattagcttcaacatgattgaggctgctaggatcaatggtgttaagaggtttttttatgcttccagtgcttgtatctaccctgagtttaaacagttggaaacaaatgtgagtttgaaggaggctgatgcctggcctgctgagccacaagatgcatatgggctagagaagcttgcaactgaagagttatgcaagcattataacaaggactttggaattgagtgccgcattgggagattccataatatatatggtccttatgggacatggaaagggggaagggaaaaggctcctgctgcattttgccggaagactcttacttccaaagaccaatttgagatgtggggagatggattgcaaacaaggtccttcaccttcattgatgagtgtgttgaaggtgtactcagattgacaaaatcagatttccgggagccagtgaatattggaagtgatgaaatggtcagcatgaatgagatggctgagattgttcttagctttgaggacaagactataccaatataccacattcctggtccagaaggtgttcgaggacgtaattcagacaatacattaatcaaagaaaaacttggttgggctccaactatgaagttgaaggatggactgagaatcacatacttttggatcaaagagcagcttgagaaagagaaggcagctggtgttgatttatcagtgtatggatcatccaaagtggtgcaaactcaggctcctgttcaactgggctcccttagggctgcagatggcaaagaataaagtcactaatgtatggatttcataataaagtaataagggagtgttggaagtgaagggttagtttatattactagtttacaatcactttgatcagcagatgataaagagtagattgaatagtgcatcagttaaatgtttcaagtatgttgctattaggtagaaatagcaacattttggaatttgatatgtatttgagacatatgttgctatgctctctatgttatgtagtagttggtctgaactaataactgctgtttaaggggatgttattgcattcaaaattttactttatgttt

SEQ ID NO: 1725 - DNA, 1469 bp, Petunia hybrida
gcggggatcattattcagttttctccatctccttcaacactccattttcttcaaggcacaaaatgggaagttcaggtgaaaccaaatatggagaatacacatatgaaaaccttgagagggaaccctactggccttcggagaaactccgaatttcaattacaggagctggtggattcattgcctcacacattgcaaggcgtttgaagaccgagggccattacgttattgcttctgactggaagaagaatgagcacatgactgaggacatgttctgtcatgagttccatcttgttgatctcagggttatggataactgtttgaaagtcacaaaagaagttgatcatgtgttcaatctcgctgccgatatgggaggcatggggttcattcagtcgaaccactcagtcatcatgtataacaacactatgatcagctttaacatgatggaggcttcaagaatcaatggtgttaagaggttcttttatgcatccagtgcttgcatctatcctgaatttaagcagttggaaactaacgtgagcttaaaggagtctgatgcttggcctgcagagcctcaagatgcttatggcctggaaaagctggcaacagaggagttatgtaagcattacaataaggacttcggaattgagtgtcgcattggacgtttccataacatttatggcccatttgggacatggaaaggtggacgcgaaaaagcaccagcagcattttgtagaaaagccctcacttccactgataaattcgagatgtggggagatggaatgcaaactcgatctttcaccttcattgatgaatgtgttgaaggtgttctgaggttaacaaaatcagactttagagagccagtgaacatcggaagtgatgaaatggtaagcatgaatgagatggcagagatggtcctcagcttcgacgaaaagaagcttcctattcagcacatccctggaccagagggtgtgcgtggtagaaattctgacaacactctcatcaaggaaaagcttggctgggctccaactatgagattgaaggatggattgagaattacatatttttggatcaaggaacaaattgaaaaagagaaggtgcaaggtgccgatgtctctgcttatgggtcatccaaagtggtgggaacacaagctccagttcaattgggctcccttcgtgctgccgatggcaaagagtgaagtagatgaagccaggtgactgaatcattcagtatgcatgaaagccatctttgttgttccaccatgttttggtcgtgtggaatgtcatacctactgatatattttatactctgtgccaaagctgttacttcacctccttgcgcctaccaaataatgctaagagatgtaatagatgcttcttcttttctgtgatttctttttacttcctcaaagcatttgtggtattttccttgtttgaatgagagccatttgctatcaatctatcattctcctttc

SEQ ID NO: 1726 - DNA, 1555 bp, Glycine max
gtaccctccattcttctcctaaatcctaatcctttttcactttcagttctcagcatgggaatttctggaacaacagactatggatcattcacataccaaaaccttgagagggaaccctactggccctcagaaaagctcagaatttccatcactggggctggtggtttcattgcctcacacattgctcgccgcctcaagacggagggacattacatcattgcttctgattggaagaagaatgagcacatgactgagggcatgttctgccatgaattccatcttgttgaccttagggtcatggataactgcttgacagttaccaagggtgtggaccatgttttcaatcttgctgctgatatgggtgggatgggtttcatccagtccaaccactcggtcattatgtacaacaacaccatgattagcttcaacatgattgaggctgccaggatcaatggtgttaagaggtttttttatgcctctagtgcttgtatctatcctgaattcaagcagttggagacaaatgtgagtttgaaggagtctgatgcctggcctgctgagccacaagatgcatatgggctggagaagcttgcaacagaagagttatgcaagcattataacaaggattttggaattgagtgccgcattgggagattccataacatatatggtccttatgggacatggaagggtgggagggagaaggctcctgctgctttttgtcgcaagacacttacttccaaagaccgatttgagatgtggggagatggattgcaaacaagatccttcaccttcattgatgagtgtgttgaaggtgtactgagattgactaaatcagacttccgggagccggtgaatattggaagtgatgaaatggtcagcatgaatgagatggctgagattgttcttagctttgaggataagaatataccaatataccatattcctggccctgaaggtgttcggggtcgtaattcagacaatacattaatcaaagagaaacttggctgggctccaactatgaagttgaaggatgggctgagaattacatacttttggatcaaagagcagcttgagaaagagaaggcagaaggtgttgatttatcaggctatggatcatccaaagtggttcagactcaagccccagttcaacttggttcccttcgggctgcagatggcaaagaataaagccactagttcgggcagttgctgcagatagcaaataataagggtgaataatgcattaccaaacgaagggctggcttttatgttgctatttgttagaggtctttggttacacattagttattgaagttagttttggaactttttcatgtatttgaaacggatggtgttatgtctttgttttatttgaggtaataataactgctgcttaaggtcatgttagagcatttacaatgccttgtttattataattttgtgggattttataatttcacataaatttaaacattacatgaaattcacataaggaatgttgcttaaagttaagcaacttatataagcactttcattgaaaatgttcttagtgcttgac

SEQ ID NO: 1727 - DNA, 1770 bp, Picea glauca
aaattttgtacttctctgtcacgattggaaggcctatattaatggttgcaatcttgtgataaggggtgtgagttctccacagatttgcactcatcttctactctaggaagtttcagggagctcttcaaatcaaggcttgttgtatattctcctttcattgggcatcatgggaagcactggagctgatggagtggcctatggggcatacacatatgaagatctggagagagagccatactggcctagtgaaaaagtgataatttctatcactggagctgggggtttcattgcctcccatattgcccggagattgaagtctgaagggcattacatcattgcctctgattggaagaagaatgagcacatgactgaggatatgttctgcaatgaattccatcttgtggatctcagagttatggaaaattgcttggctgttaccaaaggggttgaccatgtttttaacttggccgctgacatgggtggtatgggattcattcaatctaatcattctgttatcatgtacaacaacacaatgatcagcttcaacatgattgaagctgccagaatcaatggtgttaaaaggtttttctatgcttctagcgcatgcatttatcccgaattcaaacaattggagaccaacgtgagcttgaaggagtctgacgcttggccagctgagcctcaagatgcctatggcttggaaaaacttgccacagaagaattgtgcaagcactacaacaaggactttggtatagaatgccggatagggcgcttccacaacatctatggtccttttggcacatggaagggtggacgtgagaaggcacctgctgccttttgcaggaagacaatcacatccaccgataggtttgaaatgtggggcgatggcaagcaaacacgatcctttacattcattgatgaatgtgtggaaggtgtcctgagattgactaaatcagactttagagagccagtgaatattgggagtgatgaaatggttagcatgaatgagatggctgaaatggtgctgagctttgagaacaaaaagttgccaatacatcacatccctgggccagagggtgtacgtggtcggaattctgataatacattgatcaaggaaaagctaggctgggcgccaaccatgaggctgaaggatggcttgaggattacttatttctggattaaggaacaaattgagaaagaaaaggttcagggaattgatctctccatctatggatcttctaaggtggttggcactcaagcccctgttcaacttggttctctccgtgctgctgatggaaaggaatgaagacaaaaaccttgatctctagtagaatagagaaattaatattaactcagtttataataaagttcatgagctggttagcagctacatgcttcttgatttggaatccaaaattattttgtctgctatttaagtatctctgaagggtacatcctggttagaagcaatcattttctttttagttcaaaagttcatcaccctgtagtgctgatggcgaggatcatctaatgctcaagagtctttaaaaatgctacaatggtggtttcataggagttcgctgcagaaaaatcttttgagatgtggaagatgattatatgatctctgcattgtttatccaattcttttgcacaaatttccatatctgatgtgcaatgctacttcagagtttcagccatattggtgcttgtttagttgtgatactcggtttttaatttaatgtccatatctctaaaatcttagtagttgaatta

SEQ ID NO: 1728 - DNA, 1612 bp, Tropaeolum majus
ggggagtctttttcatttcctcactctctgttttctctttgcgttatcttcatttccttctcgcgcttttgcattcaaaacagtcttatattcagaatgggaaccactgactatggcgcctacacttacaaggaactcgaaagggaactttactggccatctgaaaaactcagaatttccattactggagctggtggtttcattgcttctcacattgctcgtcgcttgaagaacgaaggacactacatcattgcttcggactggaaaaagaacgaacacatgaccgaggatatgttctgccatgaattccaccttgctgatcttagagtaatggataactgcttgaaagttacaaaggaagttgaccatgtgtttaaccttgctgctgatatgggtggaatgggttttattcagtctaatcactccgttatcatgtataacaacacaatgattagtttcaacatgcttgaagcttcgagaattagtggagttaagaggtttttctatgcatcgagtgcgtgcatctaccctgagtttaagcagttggaaactaatgtgagcttgaaggaggctgacgcctggcctgcagagccccaagatgcttatggcttggaaaagcttgccactgaggagctgtgcaagcactacaccaaggattttggaatcgagtgtcgtatcgggaggtttcataacatttatggtccattcggaacgtggaaaggtgggagggagaaggctccggctgctttttgtagaaaggctctcaccgcgaccgacaagtttgagatgtggggagatggacttcagacccgttcgtttactttcattgacgaatgtgttgaaggtgtgctgagattgaccaagtcagatttccgcgaaccagtaaatatcggaagtgatgaaatggttagcatgaacgagatggctgagattgttcttggttttgacgacaaaaagcttcctatccaccacattcctggccctgaaggtgtgcgaggtcgcaactcggataatacacttatcaaagagaagctgggttgggctccaacgatgaaactaaaggatggcctgaggtttacctacttctggatcaaagaggaaatcgagaaagagaaggctaagggtgttgacctgtcggtatatggatcatcgaaggtggtgggaactcaagctccggttcaattgggctcacttcgtgctgctgatggaaaagaatgaaaggaatataagcaacaaagttatggctttttcagttattttatcggataagaaggtagcgatgatggtaaatctgtattatttcagttcgtatttcgtaatttgttttgtgcccatgttgttctgtgaagggatagcttccatgctctcccgatgcagctggtccaccaagctataacgtgaatttctgctttttgcgagaatataaatgcggttgtatcctctaaataatgaaaaaaaatctcttcccttcgtctgagacgacgtcgttaaaatttatctctctgtatcatttcatgatcatgtatttaagtgatgtaaggatggatccgaagaaccagtttttcctttagtaattgaatctcgttcttgatttatacatcttcttgaacct

SEQ ID NO: 1729 - DNA, 1252 bp, Salvia sclarea
ctactagaccttggctgtcactcaaaaatttaaagagaattatttccatcaattctcctttatctgcatctatagtccaatcatcttcagaatgggaacttccggtgaaaccacttatggggaatacacctaccaagagctggagagggagccctactggccctcggagaagctccggatttccataacaggagctggcgggtttattgcctctcatattgccaggcgtttgaagagcgagggtcattacatcattgcttccgactggaagaaaaatgagcatatgcccgaggacatgttctgtcatgagttccatctcgttgacctgagggtgatggataactgtttgaaagttactgaaggagttgatcatgtgttcaatcttgctgctgatatgggcgggatgggcttcatccagtcgaaccactcggtcatcatgtacaacaatacgatgatcagctttaacatgattgaggctgctaggattaacgggatcaagaggtttttctatgcctccagcgcttgtatctatcctgagttcaagcagttggagaccaatgtgagcttgaaagaggctgatgcttggcctgcagagcctcaagatgcttatgggctagagaagctggctacggaggagttgtgtaaacactacaacaaggactttgggattgagtgccggataggaaggttccataatatctatggtccattcgggacatggaaaggtgggagggagaaagcaccagcagctttctgtaggaaagcccttaccgctactgacaaatttgagatgtggggtgacggcaagcaaacacgatcatttacctttattgatgaatgtgttgagggtgttttaagattaacaaaatccgacttccgtgagcctgtaaatatcggaagcgatgagatggtgagcatgaatgaaatggctgagattgtcctgagcttcgataacaagaagctccccatccaccacattccagggccagagggtgtgcgtggtcggaattcagacaacactctaattaaggaaaaactcggttgggcaccttccatgaggctcaaggatggattgagaatcacttacttctggatcaaggagcagctcgagaaagagaaagctaagggaatcgacctcaccacctacggctcgtccaaagtggtggggacacaagctcctgtccagctcggttccctccgtgctgctgatggcaaagaatgaagcaaaacatctcgtttcgtatgttgtatt

SEQ ID NO: 1730 - DNA, 1605 bp, Sorghum bicolor
cctgtcaagattcaggaaccagactcctccggtcctccctcccgtctcgttcaagccgtcggcccgccgcgccaccgtttgccattgccagaatggcactcaacaaggagtacacctacgcggagctggagaaggagccatactggccgttcgagaagctgcggatctccatcactggtgctggtgggttcattgcctcccacatcgcgcgccgcctcaagagcgagggccactacatcatcgcctctgactggaagaagaacgagcacatgtccgaggacatgttctgccacgagttccacctcgtcgacctaagggtgatggacaactgcctcaaggtcaccacgggggttgaccatgtgttcaacctcgcggctgatatgggtgggatggggttcatccagtccaaccactctgtgatcatgtacaacaacaccatgatcagctttaacatgcttgaggctgctagaattaacggtgtcaagaggttcttttatgcatcaagtgcctgcatctaccctgaatttaagcagttggaaactgtagttagcttaaaggagtcagatgcttggcctgctgagcctcaagatgcttatggcttggaaaaacttgctactgaggaactgtgcaagcactatacaaaggattttggcattgagtgccgggtcggtcgctttcacaacatatatggtccctttggaacatggaagggtggaagggagaaggcgcctgctgctttctgcagaaaggctttaacctccactgggcactttgagatgtggggcgatggcctgcaaaccagatccttcacatttattgatgaatgtgttgaaggtgtccttaggttaacaaagtctgacttccgtgagcctgtaaacattggaagtgacgaaatggtgagcatgaacgagatggcagaaatagtcctgagctttgagaacaagcagctgcccatccaccacattcctgggccggagggtgtgcgtgggcgcaactcagacaacacactcattaaggagaagcttggctgggctccgactatgaggctgaaggatgggctgaggatcacctacttctggatcaaggagcagcttgagaaggagaaggctgagggcatggatctgtcggtatacggatcatccaaggtcgtgcagacccaggccccggttcagcttggctcccttcgtgccgctgatggcaaggagtgaacttcgactgcgcgccagtcagttgcctgaggctcagacaacatgatataccagtatacacagtggtttcagtttccatgatttgtagtcaccacctatacaccatttcttgattcacttttgactccacaagaggatggtttggatgatggatattttgttggcaattaggagattcagttcaaatttgaactaaatacaaaaaaattctgacaaaatagccatcgtccaaacacataataatttccatgtttctttttctcttctgtgtctgtacaatagcgtattaaagaggtacaacgcttctgtaaactggtgtcattttatttcacaaaaatagcaatgaataaattaaggttcagcatttctttgttatattttgtgaaaataactcaaa

SEQ ID NO: 1731 - DNA, 1459 bp, Malus domestica
atcccctcgaacccaacttttgtctatcattttcttcttcccaactcctcaaaagcttcaaagctccaaacttttgctcttttcagaatgggaagtacaggcgaaattaagtatggtgcgtatacctatgagaaccttgagagggagccttattggccttctgaaaagctccgaatttccattaccggggcaggtggttttatcgcctcccacattgcccggagattgaagaatgagggtcattacattattgcttccgattggaagaagaatgagcacatgactgaagacatgttctgccatgaattccatcttgccgacctcagggtcatggataattgcttgaaggttaccaagaatgttgaccatgtgttcaacctcgcagctgatatgggcggaatgggcttcattcagtccaaccattctgtcatattttataacaataccatgattagtttcaacatggtcgaagctgctaggatcaatgacgtgaagaggtttttctatgcttctagtgcgtgtatttaccctgagtttaagcagctggaaaccaatgtcagcttgaaggagtctgatgcctggcctgcagagcctcaagatgcttatggcctggagaagcttgcaactgaggaattgtgcaagcactacaccaaagactttggaatcgagtgccgtattggaaggttccacaacatttatggcccttttggaacctggaaaggtggaagggagaaggctcctgctgcattttgcagaaagactctcactgccactgataagtttgagatgtggggagatggacttcagacccgatccttcacttttattgatgaatgtgtagaaggtgtacttcggttgacgaagtcagacttccgtgagccagtgaatattggaagtgatgagatggttagcatgaatgaaatggctgagatcgttcttagctttgaggacaagaagctgcctatccagcacattcctgggccagagggtgtccgtggtcgtaactcagacaacacactgatcaaagagaaacttggttgggctcctaccatgaggttgaaggatggtctgagaattacctacttctggatcaaggaacagattgagaaagagaaggcacaaggcgctgacctctcggtgtatggctcatctaaggttgtgggaacccaagccccagttcaacttggttcgctgcgtgctgctgatggcaaagaatgaagggtccgacaaatctgcaccagaaaatatggtattcagtagttctggttatgatagcgcggcacattctatgtgcgtggacaataaggagggaagcttttgttccgctcccgttgtatatctagcttgttggttaaatctgccaccttaggattgcctttgtattttgtttccctacccttagcattattcagtttatgagttcagttgatcgtttataagattttttttcgggttcaaa

SEQ ID NO: 1732 - DNA, 1632 bp, Vigna unguiculata
ggatgcacaccattttctcttcttctccttctctcaatccttttcactttcattctcagttctcagcatggggagttccggaaccaccgactatggagcatacacttaccaaaaccttgagagggaaccttactggcccactgaaaagctcagaatttccatcaccggcgctggtggtttcattgcctcacacattgcgcgccgcctcaagactgaggggcattacatcattgcttctgattggaagaaaaatgagcacatgactgaagacatgttctgccatgagttccaccttgttgatcttagggttatggataactgcttgacagtaaccaagggtgtggatcatgttttcaatcttgctgctgatatgggtggaatgggtttcatccagtcaaatcactctgtcattatgtacaacaacaccatgattagtttcaacatgattgaagctgccaggatcaatggtgttaagaggtttttttatgcttctagtgcttgtatctaccctgaatttaaacagttggaaacaaatgtgagtttgaaggaggctgatgcctggcctgctgagccacaagatgcatatgggcttgagaagcttgcaactgaagagttatgcaagcattacaacaaggactttggaattgagtgccgcattgggagattccataacatatatggtccttatgggacatggaaagggggaagggagaaggctcctgcagcattttgtcggaagactcttacttccaaagaccaatttgagatgtggggagatggattgcaaacaagatccttcacctttatcgatgagtgtgttgaaggtgtactcagattgacaaaatcagatttccgggaaccagtgaatattggaagtgatgaaatggtgagcatgaatgagatggctgagattgttcttagctttgagaacaagactataccaatacaccacattcctggccctgaaggtgttagaggacgtaattcagacaacacattaattaaagaaaaacttggttgggcaccaactatgaaattgaaggatgggctaagaatcacatacttttggatcaaagagcagcttgagaaagagaaggcatctggtgttgatttatcagtgtatggatcatccaaagtggtgcaaactcaggctcctgttcaactgggttctctgagggctgcagatggcaaagaataaagccactaacgtatgaatttcacaataaaataatatctggtgttgcaagtgaagggttagtttatgttaccattttacatatatcactcagatcagcagatcacagataacagagtgactaaagattactgaagtgtttcaagtgcaggggttgatttcatgttggtattaagtagaaatctttggtcacatattagctattgttgaagttagtttcatgtgtttgagacggatcctgttatgtagctatagcttctgtgaagttaataactgctgtttaaggtgttgttgttctattgggaattttagtttgtgttaaagtctaagtatttatagtcttgcatacaatcccttcttgaagtactagtttaattgtattcaatgtttttctctgatcaaaatgtgaatttattttgataaataaaaagaaaaaa

SEQ ID NO: 1733 - DNA, 1610 bp, Lotus japonicus
gggaaacaacttctcaatatcttctcttcacacgttatcttccactcttctcttccccaatctccttcttttccttctgcacagaatgggaagtactggaaaaactgactatggtgaatacacctatgagaaccttgagagggagctttactggccatcggaaaagcttaagatttccatcactggagctgggggttttatcgcatcgcacattgcgcggcgcctcaagactgaggggcactacattattgcctcggactggaaaaaaaatgagcacatgagtgaggacatgttttgtgatgaatttcatcttgttgatctcagggtcatggataactgcctcaaggtcactaagggggttgatcatgttttcaatctcgctgctgatatgggtgggatgggttttattcagtccaaccactctgtgattatgtacaacaacacaatgattagtttcaacatgattgaggctgccaggattaatggcattaagaggtttttttatgcttctagtgcttgtatctatcctgaattcaaacagttggaaactaatgtgagcttgaaggaggctgatgcatggccagctgagccacaagatgcatatggactagagaagctcgcaacagaggagttatgcaagcactataacaaagattttggaattgaatgtcgcattgggaggttccataacatatatggcccttttggaacatggaaaggtggaagggagaaggctcctgctgctttttgtcgaaagacaatcacttctactgacagatttgagatgtggggagatggtttgcaaacgcgatcattcaccttcattgatgaatgtgttgaaggtgttcttagattgactaaatccgacttccgtgagccagtaaatattggaagtgatgagatggtcagcatgaatgagatggctgagattgttctcagctttgagaacaagaatattcctatacatcacattcctggaccagagggtgttcgtggtcgtaactcagataatacactgataaaagagaaacttggctgggctccaacaatgaaattgaaggatgggctgaggattacatatttctggattaaggagcagcttgacaaggagaaggctaaaggtattgatttagcagtttatggaacatccaaggtggtgcaaacccaagccccagttcaactaggatcacttcgtgctgcagacggaaaagaatgaaggggttagttcatggtcttagcactcatctaaatgtttcaagtgaagggttggattttattattgccacttaagaggtcactggttatcgttatttagctgtcaatgttttgtaatgttggtggttcatgtgtagagtggtagtttggtgctcctgttgtattttggtataagcctttttgaggcactggtttgtgcttactgcactagaagttccaaattatgagttcaagtctgagattaataagtatcccattgttttcttccttgtgaagttcaatgtaattgataattcatggttaggcacttttggtgtcattcttccctttgttttatgtttagcttcttaatgaagtaaaggctataaactcagcacattattttgttgatggct

SEQ ID NO: 1734 - DNA, 1590 bp, Lotus japonicus
cttctcttcacacgttatcttccactcttctcttccccaatctccttcttttccttctgcacagaatgggaagtactggaaaaactgactatggtgaatacacctatgagaaccttgagagggagctttactggccatcggaaaagcttaagatttccatcactggagctgggggttttatcgcatcgcacattgcgcggcgcctcaagactgaggggcactacattattgcctcggactggaaaaaaaatgagcacatgagtgaggacatgttttgtgatgaatttcatcttgttgatctcagggtcatggataactgcctcaaggtcactaagggggttgatcatgttttcaatctcgctgctgatatgggtgggatgggttttattcagtccaaccactctgtgattatgtacaacaacacaatgattagtttcaacatgattgaggctgccaggattaatggcattaagaggtttttttatgcttctagtgcttgtatctatcctgaattcaaacagttggaaactaatgtgagcttgaaggaggctgatgcatggccagctgagccacaagatgcatatggactagagaagctcgcaacagaggagttatgcaagcactataacaaagattttggaattgaatgtcgcattgggaggttccataacatatatggcccttttggaacatggaaaggtggaagggagaaggctcctgctgctttttgtcgaaagacaatcacttctactgacagatttgagatgtggggagatggtttgcaaacgcgatcattcaccttcattgatgaatgtgttgaaggtgttcttagattgactaaatccgacttccgtgagccagtaaatattggaagtgatgagatggtcagcatgaatgagatggctgagattgttctcagctttgagaacaagaatattcctatacatcacattcctggaccagagggtgttcgtggtcgtaactcagataatacactgataaaagagaaacttggctgggctccaacaatgaaattgaaggatgggctgaggattacatatttctggattaaggagcagcttgacaaggagaaggctaaaggtattgatttagcagtttatggaacatccaaggtggtgcaaacccaagccccagttcaactaggatcacttcgtgctgcagacggaaaagaatgaaggggttagttcatggtcttagcactcatctaaatgtttcaagtgaagggttggattttattattgccacttaagaggtcactggttatcgttatttagctgtcaatgttttgtaatgttggtggttcatgtgtagagtggtagtttggtgctcctgttgtattttggtataagcctttttgaggcactggtttgtgcttactgcactagaagttccaaattatgagttcaagtctgagattaataagtatcccattgttttcttccttgtgaagttcaatgtaattgataattcatggttaggcacttttggtgtcattcttccctttgttttatgtttagcttcttaatgaagtaaaggctataaactcagcacattattttgttgatggct

SEQ ID NO: 1735 - DNA, 1467 bp, Medicago truncatula
agtcatattttattctaaaacccaatcaaatctcaattcttctttcactcctctcttcatcagaatgggaagttctggaataaacaacgactatggtgcattcacataccaaaaccttgagagagaaccatattggccaacagaaaagctaagaatttccattaccggtgctggtgggtttattgcctcccacattgctcgccgtcttaagaccgagggccattacattattgcctctgattggaagaagaatgagcacatgactgaggacatgttctgtcatgagttccatcttgttgatcttagggttatggataattgcctcaaagttactaaggatgtggatcatgttttcaatcttgctgctgatatgggtgggatgggttttatccaatccaatcactctgtcattatgtataacaacacaatgattagcttcaatatgattgaagctgctaggattaatggtgttaagaggtttttttatgcctctagtgcttgtatctaccctgaattcaaacagttggaaacaaatgtgagcttgaaggaggctgatgcctggcctgctgagccacaagatgcatatgggctggagaagcttgcaacagaagagttatgcaagcattataacaaagattttggaattgagtgccgcattgggcggttccataacatatacggcccttttggtacatggaaaggtggaagggaaaaggctcctgctgctttttgccgaaagacacttacttccacagataaatttgagatgtggggagatggattacagacacgatccttcaccttcattgacgagtgtgttgaaggcgtgcttagattgactaaatcagactttcgggagccagtgaatattggaagtgacgaaatggttagcatgaatgagatggctgagattgttcttagctttgagaacaaaagcatacccatccaacacattcctggtccagagggtgttcgtggccgcaattcagacaatacacttatcaaagagaaacttggctgggctccaacaatgaagttgaaggatgggctgagaattacatacttctggattaaagagcagcttgagaaagagaaggctggaggtgttgatgtaacatcctatggatcgtctaaagtggtatcgactcaagcccctgttcaactaggttcacttcgggctgcagatggcaatgaatgaggaactaaagcatagctgttagtgttctcttaaatgtttcaagtgaatggttaggttttatattgctattttgaagagaactttggttatagttaataagttatcttaaggttaattttggaagatgtaatgcgcttattttgttttatgtagcctgtctgaggcagtacttggtgcttatgttcgtgtcactgcagtagaaattataattctgtgttttttaaagtctgaatgattgaaacttttagtacaaagtcgttttcttcctt

SEQ ID NO: 1736 - DNA, 1438 bp, Medicago truncatula
tatggtcgactgcaggccattatggcggggatctaaaacccaatcaaatctcaattcttctttcactcctctcttcatcagaatgggaagttctggaataaacaacgactatggtgcattcacataccaaaaccttgagagagaaccatattggccaacagaaaagctaagaatttccattaccggtgctggtgggtttattgcctcccacattgctcgccgtcttaagaccgagggccattacattattgcctctgattggaagaagaatgagcacatgactgaggacatgttctgtcatgagttccatcttgttgatcttagggttatggataattgcctcaaagttactaaggatgtggatcatgttttcaatcttgctgctgatatgggtgggatgggttttatccaatccaatcactctgtcattatgtataacaacacaatgattagcttcaatatgattgaagctgctaggattaatggtgttaagaggtttttttatgcctctagtgcttgtatctaccctgaattcaaacagttggaaacaaatgtgagcttgaaggaggctgatgcctggcctgctgagccacaagatgcatatgggctggagaagcttgcaacagaagagttatgcaagcattataacaaagattttggaattgagtgccgcattgggcggttccataacatatacggcccttttggtacatggaaaggtggaagggaaaaggctcctgctgctttttgccgaaagacacttacttccacagataaatttgagatgtggggagatggattacagacacgatccttcaccttcattgacgagtgtgttgaaggcgtgcttagattgactaaatcagactttcgggagccagtgaatattggaagtgacgaaatggttagcatgaatgagatggctgagattgttcttagctttgagaacaaaagcatacccatccaacacattcctggtccagagggtgttcgtggccgcaattcagacaatacacttatcaaagagaaacttggctgggctccaacaatgaagttgaaggatgggctgagaattacatacttctggattaaagagcagcttgagaaagagaaggctggaggtgttgatgtaacatcctatggatcgtctaaagtggtatcgactcaagcccctgttcaactaggttcacttcgggctgcagatggcaatgaatgaggaactaaagcatagctgttagtgttctcttaaatgtttcaagtgaatggttaggttttatattgctattttgaagagaactttggttatagttaataagttatcttaaggttaattttggaagatgtaatgcgcttattttgttttatgtagcctgtctgaggcagtacttggtgcttatgttcgtgtcactgcagtagaaattataattctgtgtttttt

SEQ ID NO: 1737 - DNA, 1528 bp, Capsicum annuum
ttcggcacgaggccttctagctctataaagatagagatcccccacccacccctccccttcccaaaaaagaagacatagccccttatcgttattgagttttgccatttccttcaagacctcaaaagtccaattttttcaagaatgggaacttctgttgaaactaagtacggggaatacacatatgaaaaccttgagcgggaaccttactggccttcagaaaagcttcggatatctattacaggagctggtggattcattgcctcacacattgcaaggcgtctgaagaccgaggggcattacattattgcttctgactggaagaagaatgagcacatgtctgaggacatgttttgtcatgagttccatcttgttgatctcagggttatggataactgtttaaaagtcacaaaaggagttgatcacgtgttcaatcttgctgccgatatgggaggtatgggcttcattcagtctaaccactcggtgatcatgtataacaatactatgatcagctttaacatgatggaggcttcaagaataaatggtattaagaggttcttttatgcatccagtgcttgcatttaccctgaatttaagcagttggaaactaacgtgagcttaaaggagtctgatgcttggcctgcagagcctcaagatgcttatggcttagaaaagctagcaacagaggagctatgtaagcactacaacaaggacttcggaattgaatgtcgcattggacgtttccataacatttatggcccctttggaacatggaaaggtggacgcgagaaagctccagcagctttttgtagaaaagccctcacttccactgacaaattcgagatgtggggagatggaaagcaaactcgatctttcaccttcattgatgagtgtgttgaaggtgttctgaggttaacgaaatcagactttagagagcctgtgaacatcggaagtgatgagatggtaagcatgaatgagatggcagagatagtcctcggctttgatggcaagaaccttcctatccatcacatcccgggaccagaaggtgtgcgtggtcgaaactctgacaacacactcataaaagagaggcttgggtgggctcctacgatgaagttgaaggatgggttgagaattacatatttctggatcaaggaacaaattgagaaagagaaagtgcagggttccgatgtgtccgcttatgggtcatccaaagttgtgggaacacaagctccagttgaattgggctccctgcgtgctgccgatggcaaagagtgaagtagataaagccaagtgactatcattcagtatgcatgaaagccatcttgttagttccaccatgttttgtcgcgtggaatgtttacctattgatatatttaatattatgtgctaaagcagttttattttttcgctacaccatattgcacctgccaaataatgcctagagatgtagtcagcatatgcttgcatttatggtattttctgagtttgtatgagacagccattttctatcaatctatcgttttcttgctcc

SEQ ID NO: 1738 - DNA, 1565 bp, Glycine max
tgttgtgagcaaagcaaataaccaataagtggctttcccttcttctcaattctcatcctatatattgcattcccatcactcccaacgccctctcaattcacttcctatccccttcttctctctcaaacagaatgggaagtgctggaagaactgattatggtgcatacacctatgagaatcttgagagagagccttactggccatcagagaagcttaagatttccatcaccggtgctgggggttttatcgcatcacacatagctcggcgcctcaagacagaggggcattacgttattgcttcggattggaagaaaaatgagcacatgactgagaacatgttctgtgatgaattccatcttgttgatctcagggtcatggataactgcctcaaggttacaaagggggttgatcatgttttcaatcttgctgcagacatgggtgggatgggttttattcagtctaaccactctgtcattatgtacaacaacacaatgattagcttcaacatgattgaggctgccaggattaacggcattaagaggtttttttatgcctctagtgcttgtatctaccctgaatttaaacagttggaaactaatgtgagcttgaaggagtccgatgcatggccagctgagcctcaagatgcatatgggctagagaaacttgcaacagaggaattatgcaagcactataacaaggattttggaattgagtgccgcattgggaggttccacaacatatacggtccttttgggacatggaaaggcatgtggaagggagaaggctcctgctgctttttgtcgtaaagtaatcacttccactgatagatttgagatgtggggagatggattgcaaacacgatcatttaccttcattgatgagtgtgttgaaggtgtgcttagattgactaaatctgacttccgagagccagtaaatattggaagcgatgagatggttagcatgaatgagatggctgagattattcttggctttgagaacaagaatattcctattcaccacattcctggccctgagggtgttcgaggtcgtaattcagacaatacactgataaaagaaaaacttggttgggctccaactatgaggttgaaggatgggttgagaatcacatacttctggattaaggagcagatcgagaaggagaaggctcaaggtattgatatatctgtgtatgggtcttccaaagtggtgcagactcaagccccagttcaactaggctcacttcgagctgcagatggcaaagaatgaggtggtcaacatatggctgtagtaggattcaccttaatgtttcaagtgaagagttggattatattatatatagcaactaaatagcggtatctggttatgtttaattagctgctaaggatttcttatgtctctgctggtagttcatgtctggaacggaagccttgatgtattttaatagttttttaaggcacttcgtggtgcttaagatggtttactgcactagaagttctaaattatttgttttgaattttgatgtctaaataattgattactaagcaaataattttttattccttgtg

SEQ ID NO: 1739 - DNA, 1685 bp, Sorghum bicolor
gctctatcttcctcgcagccccgctcaggctcggtcctcagcgcagatcttcttccgcacgtcggcggctccccctcgacggcgtccagcgacggaggggcagtcccagtctcggcggcggcgtcggcggctccccctccctcctctcgccagtcgcctcgcgccttcgcctccgtcctccgcgcaccggccggcgaccctgcaatggcactcaacaaggagtacacctacgcggagctggagaaggagccatactggccgttcgagaagctgcggatctccatcactggtgctggtgggttcattgcctcccacatcgcgcgccgcctcaagagcgagggccactacatcatcgcctctgactggaagaagaacgagcacatgtccgaggacatgttctgccacgagttccacctcgtcgacctaagggtgatggacaactgcctcaaggtcaccacgggggttgaccatgtgttcaacctcgcggctgatatgggtgggatggggttcatccagtccaaccactctgtgatcatgtacaacaacaccatgatcagctttaacatgcttgaggctgctagaattaacggtgtcaagaggttcttttatgcatcaagtgcctgcatctaccctgaatttaagcagttggaaactgtagttagcttaaaggagtcagatgcttggcctgctgagcctcaagatgcttatggcttggaaaaacttgctactgaggaactgtgcaagcactatacaaaggattttggcattgagtgccgggtcggtcgctttcacaacatatatggtccctttggaacatggaagggtggaagggagaaggcgcctgctgctttctgcagaaaggctttaacctccactgggcactttgagatgtggggcgatggcctgcaaaccagatccttcacatttattgatgaatgtgttgaaggtgtccttaggttaacaaagtctgacttccgtgagcctgtaaacattggaagtgacgaaatggtgagcatgaacgagatggcagaaatagtcctgagctttgagaacaagcagctgcccatccaccacattcctgggccggagggtgtgcgtgggcgcaactcggacaacacactcattaaggagaagcttggctgggctccgactatgaggctgaaggatgggctgaggatcacctacttctggatcaaggagcagcttgagaaggagaaggctgagggcatggatctgtcggtatacggatcatccaaggtcgtgcagacccaggccccggttcagcttggctcccttcgtgccgctgatggcaaggagtgaacttcgactgcgcgccagtcagttgcctgaggctcagacaacatgatataccagtatacacagtggtttcagtttccatgatttgtagtcaccacctatacaccatttcttgattcacttttgactccacaagaggatggtttggatgatggatattttgttggcaattaggagattcagttcaaatttgaactaaatacaaaaaaattctgacaaaatagccatcgtccaaacacataataatttccatgtttctttttcttttctgtgtctgtacaatagcgtattaaagaggtacaacgcttctgtaaactggtgtcattttatttcacaaaaatagcaatgaataaattaaggttcagcat

SEQ ID NO: 1740 - DNA, 1579 bp, Medicago truncatula
agatagcataccattttccaccaattgcctctctcaactcatacctcttctctccgtacattatcgtcatatcaatcaatcagaatgggaagcactgaaaaaactaactatggagaatacacctatgagaatctcgagagagagccttactggccatcagaaaagcttaaaatttccatcactggtgctgggggttttatcgcgtcacacttagcgcggcgtctcaagaaggagggacattacattattgcttctgactggaagaaaaatgagcacatgactgaggacatgttctgtgatgaattccatcttgttgatctcagggtcatggataactgcttaaccgttactaaaggggttgaccatgttttcaatcttgccgctgatatgggtggaatgggttttattcagtccaatcattctgttattatgtataacaacacaatgattagtttcaatatgattgaagctgctaggattaatggcattaagaggttcttttatgcctcaagtgcttgtatctaccctgaatttaaacagttagaaactactaatgtgagcttgaaggagtctgatgcatggcctgctgagccacaagatgcgtatgggctagagaagcttgcaacagaggagatttgcaagcactataacaaagatttcggaattgagtgccgcattgggaggttccataacatatatggtccttttggaacatggaaaggtggaagggagaaggctcctgctgctttttgtcggaaagcaatcacatccacagacaaatttgagatgtggggagatggtttgcaaacacgatcattcaccttcatcgatgagtgtgttgaaggtgtacttagactgactaaatccgatttccgcgagccggtaaatattggaagtgatgagatggtcagcatgaatgagatggctgagattgttcttggttttgaggacaagaagactcctatacatcacattcctggcccagagggtgttcgtggtcgtaactcagacaatacactaataaaagagaaacttggctgggctccaacaatgaagttgaaggatgggctgaggattacatatgtctggattaaggaacaacttgaaaaggagaaggctcaaggtcttgatacatcagggtacggctcatcaaaagtggtttcaacccaagcaccagtccaattaggctcacttcgggcagctgacggcaaagaggggagtagttaattcatggcagtagcagtcaagtaaatgtttccggagaagagtgtgctttatattgcagcttaatagggtcgatgtcatggttattaattgtttgcacgttatttatgcgtagatcggaatccttattgctcaatgtatttcatattgcctttttttaaagcacttgtcggtgcttggggtggttttctgcactagaagttctaaatgacttgtttttagtctcaatctgtggttaataagcaaacaattgttttcttcctcgtgatttacgaagttcaatgtaattggttcatgttgtttctgaatgttttatgatatcagtatatgtagtgccagatatatttactatttc

SEQ ID NO: 1741 - DNA, 1739 bp, Medicago truncatula
gtttcatgagagaggagtgacaaaatgaaaacattgtcttgtcttggtgtggatagtagatagatacactacaccagccagccaatcatgctatctatatatgtgtgctagcaaaataacgaacaagtggccttcccttctcatcctatatatattgattagatagcataccattttccaccaattgcctctctcaactcatacctcttctctccgtacattatcgtcatatcaatcaatcagaatgggaagcactgaaaaaactaactatggagaatacacctatgagaatctcgagagagagccttactggccatcagaaaagcttaaaatttccatcactggtgctgggggttttatcgcgtcacacttagcgcggcgtctcaagaaggagggacattacattattgcttctgactggaagaaaaatgagcacatgactgaggacatgttctgtgatgaattccatcttgttgatctcagggtcatggataactgcttaaccgttactaaaggggttgaccatgttttcaatcttgccgctgatatgggtggaatgggttttattcagtccaatcattctgttattatgtataacaacacaatgattagtttcaatatgattgaagctgctaggattaatggcattaagaggttcttttatgcctcaagtgcttgtatctaccctgaatttaaacagttagaaactactaatgtgagcttgaaggagtctgatgcatggcctgctgagccacaagatgcgtatgggctagagaagcttgcaacagaggagatttgcaagcactataacaaagatttcggaattgagtgccgcattgggaggttccataacatatatggtccttttggaacatggaaaggtggaagggagaaggctcctgctgctttttgtcggaaagcaatcacatccacagacaaatttgagatgtggggagatggtttgcaaacacgatcattcaccttcatcgatgagtgtgttgaaggtgtacttagactgactaaatccgatttccgcgagccggtaaatattggaagtgatgagatggtcagcatgaatgagatggctgagattgttcttggttttgaggacaagaagactcctatacatcacattcctggcccagagggtgttcgtggtcgtaactcagacaatacactaataaaagagaaacttggctgggctccaacaatgaagttgaaggatgggctgaggattacatatgtctggattaaggaacaacttgaaaaggagaaggctcaaggtcttgatacatcagggtacggctcatcaaaagtggtttcaacccaagcaccagtccaattaggctcacttcgggcagctgacggcaaagaggggagtagttaattcatggcagtagcagtcaagtaaatgtttccggagaagagtgtgctttatattgcagcttaatagggtcgatgtcatggttattaattgtttgcacgttatttatgcgtagatcggaatccttattgctcaatgtatttcatattgcctttttttaaagcacttgtcggtgcttggggtggttttctgcactagaagttctaaatgacttgtttttagtctcaatctgtggttaataagcaaacaattgttttcttcctcgtgatttacgaagttcaatgtaattggttcatgttgtttctgaatgttttatgatatcagtatatgtagtgccagatatatttactatttc

SEQ ID NO: 1742 - DNA, 1478 bp, Malus domestica
cccatatcatatcccctttcatcccttccgagcccaacattttgcttctcattttcttatcccaacttctcaaagcttcaaactttgctctgtccagaatgggaactgctggtgaaactaagtatggtgcgtacacttatgaaaacctcgagagggaaccttattggccttctgaaaagctccgaatttccatcaccggggcaggtggctttatcgcctcccacattgcccgtagattgaagaatgagggtcattacatcattgcttctgactggaagaagaatgagcacatgactgaagatatgttctgccatgaattccatcttgctgacctcagggtcatggataactgcttgaaggttactaagaatgttgaccatgtgttcaacctcgcagctgatatgggcggaatgggcttcattcagtccaaccattctgtcatcttttataataataccatgattagcttcaacatggttgaagcttctcggatcaatgatgtgaagaggtttttctatgcttcaagtgcttgtatttatcctgaatttaagcagctggaaaccaatgtgagcctaaaggagtctgatgcttggcctgcggagcctcaagatgcttatggcttggagaagcttgcaactgaggaattgtgcaagcactacacaaaagactttggaattgagtgccgtattggaaggttccacaacatttatggtccttttggaacctggaaaggtggaagggagaaggctcctgctgctttttgcagaaaggcactcactgccactgataagtttgagatgtggggagatggacttcagacccgatccttcacttttattgatgaatgtgtagaaggtgttcttcggttgacgaagtcagacttccgtgagccagtgaatattggaagtgatgagatggttagcatgaatgagatggctgagatggttcttagctttgaggacaagaagctgcctatccagcacattcctgggccagagggtgtccgtggtcgtaactcggacaacacgctgatcaaagagaaacttggctgggctcctaccatgaggttgaaggatggtctgagaattacatacttctggatcaaggaacagattgagaaagagaaggcacaaggtgctgacctctcggtgtatggctcatctaaggttgtcggaacccaagccccagttcaacttggttcgctgcgtgctgctgatggtaaagaatgaagtgttcggaacagccttgaaactgcactggaaaaatatagtattcagcagatctggttatgacattgccgcgcgtatctatgtgcacggacaataagcagggaagcttttattcccctttacattgtacatctagtttcttagattaaatcttctaccttaggagtgcctttatattttgtttccctttctgaatcatttttcggtttatgtgttgtactctatttcctgaataagattttgtttcgg

SEQ ID NO: 1743 - DNA, 1612 bp, Arabidopsis thaliana
aaataccaataggagttggaaaactaaaacaacgagtggtgttgctctctccatcttcctcttcatcttcttctgttctctctctataaatacaagtttactcttcctcttcctcaaatctctgactcttctctgcattatctcttcgatctctccaactctccaaaaccttcctcagaatgggaactaccaatggaacagactatggagcatacacatacaaggagctagaaagagagcaatattggccatctgagaatctcaagatatcaataacaggagctggaggtttcattgcatctcacattgctcgtcgtttgaagcacgaaggtcattacgtgattgcttctgactggaaaaagaatgaacacatgactgaagacatgttctgtgatgagttccatcttgttgatcttagggttatggagaattgtctcaaagttactgaaggagttgatcatgtttttaacttagctgctgatatgggtggtatgggttttatccagagtaatcactctgtgattatgtataataatactatgattagtttcaatatgattgaggctgctaggatcaatgggattaagaggttcttttatgcttcgagtgcttgtatctatccagagtttaagcagttggagactactaatgtgagcttgaaggagtcagatgcttggcctgcagagcctcaagatgcttatggtttggagaagcttgctacggaggagttgtgtaagcattacaacaaagattttggtattgagtgtcgaattggaaggttccataacatttatggtccttttggaacatggaaaggtggaagggagaaggctccagctgctttctgtaggaaggctcagacttccactgataggtttgagatgtggggagatgggcttcagacccgttcttttacctttatcgatgagtgtgttgaaggtgtactcaggttgacaaaatcagatttccgtgagccggtgaacatcggaagcgatgagatggtgagcatgaatgagatggctgagatggttctcagctttgaggaaaagaagcttccaattcaccacattcctggcccggaaggtgttcgtggtcgtaactcagacaacaatctgatcaaagaaaagcttggttgggctcctaatatgagattgaaggaggggcttagaataacctacttctggataaaggaacagatcgagaaagagaaagcaaagggaagcgatgtgtcgctttacgggtcatcaaaggtggttggaactcaagcaccggttcagctaggctcactccgcgcggctgatggaaaagagtgaagttcaccaaagtataagtcaagctcaaatatggccttttaagttcagcaaaatgtttagatatatttttaggtagcttcctattaaaaaagcaataataagtgttttggattttggttccttctattctgctaatccttgtttatgtttagttgaaaaagtttgcttgcattgttaagtctgttatcatattattgtggtcctttcattcacagtatgtatgtttatcatcatagtcaagttgatgtcgtggtcctctcacggaccagtacaagtaagtggcttgtgttttttcttgc

SEQ ID NO: 1744 - DNA, 1526 bp, Artemisia annua
atcagacacgaagcaatggtatcaacgcaggactccgcgggggagaccataaagtagaaggataagtgaagtgtacgggtgaactttttcatcgaaacttcgtaaagggatcaactttgcaaacagcatatccttctaatatttctgaaaatattttcagaatgggaaccaccggtgaaacgaagtatggttcttacacctacgaggcccttgagagagaaccctattggccaacagagaagcttcgtgtttccataacaggggctggaggattcattgcttcgcacattgctcgtcgtttgaaaaccgagggtcattacatcattgcttctgactggaagaaaaatgagcatatgccagaagacatgttttgtcacgagttccatcttgttgatcttcgtgtgatggataattgtttgaaagttacagaaaaagttgatcatgtcttcaacttggctgctgatatgggtggtatgggattcattcagtcgaatcactctgttatcatgtataacaatactatgattagttttaacatgctcgaggctgccaggatcagtggagtcaagaggttcttctatgcatcaagtgcttgcatttaccctgagtttaaacagttggagaccaatgtgagcttgaaggaagctgacgcatggcctgctgagcctcaagatgcttacggtttggagaaactagctactgaggagttgtgcaggcactataccaaagactttggaatcgagtgcagaattggtcgttttcacaacatctatggaccttttggcacatggaaaggtggaagggagaaagcacccgctgctttctgcagaaaagcccttacggccactgataagtttgaaatgtggggagatgggcttcaaactcgatcttttaccttcattgatgaatgtgttgaaggtgtcttaagattgacaaaatccgacttccgtgaacctgtgaatattggaagtgatgagatggtaagcatgaatgaaatggctgaaattgttttgagctttgaggacaagaagctcccaattcaccacatcccgggtccagaaggtgtacgtggtagaaactcggacaacactttgatcaaagagaagcttggatgggctcctaccatgagattaaaggatggattgagatttacatatttctggatcaaggaacaaattgagaaagaaagaggtgaaggttttgacctttcggtttacggatcctctaaagttgtcggaacccaagcacctgttcaacttggatcactcagggcagccgatggaaaagagtaaaggcgtcacatccagtttccgccgtcttctgttcaaaattcttccttgtgttttgttgatgcatttattatttatcttggtatgtaaaaatcctgggtgatgctactttgcacgacctcttatcatttattattgtgctctattattgttaatgaattcaaggcatttcttgtgtcgtttttatcgtaagcttcttattgtacccacgaattttatggtataagcggctggatc

SEQ ID NO: 1745 - DNA, 1503 bp, Solanum tuberosum
aaaaaaaaaaaacatagccccttatcattattgagtttcgccatcttcttcaagacctttaaagttcaaatttttcaagaatgggaacttctgttgaaaccacttatggagaatacacatatgaaaaccttgagagggagccctactggccttcagagaagcttcgggtctctattacaggtgctggtggatttattgcctcacacattgcaaggcgtctgaagaacgaggggcattacattattgcttctgactggaagaagaatgagcacatgtctgaggacatgttttgtcatgagttccatcttgttgatctcagggttatggataactgtttgaaagtcacaaaaggagttgatcatgtgttcaatctcgctgccgatatgggaggtatgggcttcattcagtcgaaccactcggtgatcatgtataacaacactatgatcagctttaacatgatggaggcttcaagaataaatagtgttaagaggttcttttatgcatccagtgcttgcatctaccctgaatttaagcagttggaaactaacgtgagcttaaaggagtctgatgcttggcctgcagagcctcaagatgcttatggcttagaaaagctagcaacagaggagttgtgtaagcactacaacaaggactttggaattgaatgtcgcattggccgtttccataacatttatggcccatttggaacatggaaaggcggacgtgagaaagcaccagcagctttttgtagaaaagccctcacttccactgacaaattcgagatgtggggagatggaaagcaaactcgatctttcaccttcattgatgagtgtgttgaaggtgttctgaggttaacaaaatcagactttagagagcctgtgaacatcggaagtgatgagatggtaagcatgaatgagatggcggagatagtcctcagctttgatggcaagaaccttccaatccatcacatcccgggaccagagggtgtgcgtggtcgaaactctgacaacactctcatcaaggaaaagcttggctgggctcctaatatgaagttgaaggatgggttgagaattacatatttctggatcaaggaacaaattgagaaagagaaggtgaagggtgccgatgtgtccgcttatggatcatccaaagttgtgggaacacaagctccagttgaattgggctccctccgtgctgccgatggcaaagagtgaagtagatgaagccaagtgattatcattcggtatgcacaatggccatctgttagttccaccatgttttgttcgcgtggaatgtttacttattgatatatctatattatgcgctaaagcagtttttttttccccacatcccctcattgcacctaccaaataatactcagagatgtggtagtccagtattgcttgcattttgtgatttctttttgctacctcaatgcatttgtggtattttctgagtttgtatgagacatatccatttgctatcaatctatcattttcttgctcc

SEQ ID NO: 1746 - DNA, 1535 bp, Solanum tuberosum
aaaaaaaaaaaacatagccccttatcattattgagtttcgccatcttcttcaagacctttaaagttcaaatttttcaagaatgggaacttctgttgaaaccacttatggagaatacacatatgaaaaccttgagagggagccctactggccttcagagaagcttcgggtctctattacaggtgctggtggatttattgcctcacacattgcaaggcgtctgaagaacgaggggcattacattattgcttctgactggaagaagaatgagcacatgtctgaggacatgttttgtcatgagttccatcttgttgatctcagggttatggataactgtttgaaagtcacaaaaggagttgatcatgtgttcaatctcgctgccgatatgggaggtatgggcttcattcagtcgaaccactcggtgatcatgtataacaacactatgatcagctttaacatgatggaggcttcaagaataaatagtgttaagaggttcttttatgcatccagtgcttgcatctaccctgaatttaagcagttggaaactaacgtgagcttaaaggagtctgatgcttggcctgcagagcctcaagatgcttatggcttagaaaagctagcaacagaggagttgtgtaagcactacaacaaggactttggaattgaatgtcgcattggccgtttccataacatttatggcccatttggaacatggaaaggcggacgtgagaaagcaccagcagctttttgtagaaaagccctcacttccactgacaaattcgagatgtggggagatggaaagcaaactcgatctttcaccttcattgatgagtgtgttgaaggtgttctgaggttaacaaaatcagactttagagagcctgtgaacatcggaagtgatgagatggtaagcatgaatgagatggcggagatagtcctcagctttgatggcaagaaccttccaatccatcacatcccgggaccagagggtgtgcgtggtcgaaactctgacaacactctcatcaaggaaaagcttggctgggctcctaatatgaagttgaaggatgggttgagaattacatatttctggatcaaggaacaaattgagaaagagaaggtgaagggtgccgatgtgtccgcttatggatcatccaaagttgtgggaacacaagctccagttgaattgggctccctccgtgctgccgatggcaaagagtgaagtagatgaagccaagtgattatcattcggtatgcacaatggccatctgttagttccaccatgttttgttcgcgtggaatgtttacttattgatataactatattatgcgctaaagcagttttttttccccacatcccctcattgcacctaccaaataatactcagagatgtggtagtccagtaatgcttgcattttgtgatttctttttgctacctcaatgcatttgtggtattttctgagtttgtatgagacatatccatttgctatcaatctatcattttcttgctccgttgaaaaaaaaaggacaggagagaaaaaaaaa

SEQ ID NO: 1747 - DNA, 1470 bp, Helianthus annuus
  misc_feature (5)..(5): n is a, c, g, or t
  misc_feature (701)..(701): n is a, c, g, or t
  misc_feature (1289)..(1289): n is a, c, g, or t
ggagngtattccccacagagagagtaagatacgactggcgcccaaactatctcgctaaaacaaatctaacccacttcaaaagagatcattttggatacaacccttcaacaatttcgattttcatcagaatgggaacagccggtgaaacaaaatacggttcattcacctacgaaaacctcgagagggaaccgtattggccatcagaaaaacttagggtttccataaccggagcgggtgggttcatcgcatcacacatcgctaggcgtttgaaaactgagggccactacatcattgcttctgattggaagaaaaatgagcacatgtcagaagacatgttttgtcatgagttccatctcgttgatcttcgggtgatggataactgcttgaaagtgacggaaaacgttgatcatgtgtttaacttggctgctgatatgggtggtatggggttcattcagtcgaatcactctgttattatgtataataatacgatgattagctttaacatgcttgaggctgcgaggatcagtggagtcaagaggtttttctatgcctctagtgcttgcatttaccctgagtttaagcagttggaaaccaatgtgagcttgaaggaatccgacgcatggcctgccgagcctcaagatgcttacggtctggagaagctagcaaccgaggagttgtgcaggcactacactaaggacttnggaatcgagtgtcgtatcggacgttttcataacatctatggaccattcggcacatggaaaggcgggagggagaaagcacccgctgcgttctgcagaaaagcgcttacggcgactgataagtttgaaatgtggggtgacgggttacaaactcgttcttttactttcattgatgaatgtgttgaaggtgttttgagattgacaaaatctgactttcgtgaaccggtgaacatcggaagtgacgagatggtgagcatgaatgaaatggctgaaattgttctcagtttcgaggataagaagcttccgattcaccacattccgggcccggaaggtgtgcgtggtagaaactcggataacactttgatcaaagagaagcttgggtgggcccccactatgagattaaaggatggattgagaatcacatatttctggatcaaggaacaaattgagaaagaaagaggtgaaggttttgacctctcggtttacgggtcatctaaagtcgttgggacccaggcaccggttcaactcgggtcgctccgggccgctgatggaaaagagtgaagtgtgatattctgatgtcttaaattcaanattctggttttcatgttgtgttgatgcatgcatatttatttggatgtgtaatgattttagctatttaagagctctgctacttctgtgtgaactatgaatgtttgtttattactgtgatctggtttctatttatgatgttgtcctggaaactgttaataccataaaaacaaatattatagtt

SEQ ID NO: 1748 - DNA, 1864 bp, Solanum lycopersicum
gtatttactataattatcttcaaccaagaaaccccttcaacttggaaattattgagtagctctataaagatagagatctattaccaaaaaaaaacatcaaaaaaataaataaaaagcatagcctcttggcccttatcatttttgagtttctccatcttcgagacctttaaagttcaagtttttcaagaatgggaacttctgttgaaaccacttatggagaatacacatatgaaaaccttgagagggagccctactggccttcagagaagcttcgggtctctattacaggtgctggtggatttattgcctcacacattgcgaggcgtctgaagactgaggggcattacattattgcttccgactggaagaagaatgagcacatgtctgaggacatgttttgtcatgagttccatcttgttgatctcagggtgatggataactgtttgaaagtcacaaaaggagttgatcatgtgttcaatctcgctgctgatatgggaggtatgggcttcattcagtcgaaccactcggtgatcatgtataacaacactatgatcagctttaacatgatggaggcttcaagaataaatagtgttaagaggttcttttatgcatccagtgcttgcatctaccctgaatttaagcaattggaaactaacgtgagcttaaaggagtctgatgcttggcctgcagagcctcaagatgcttatggcttagaaaagctagcaacagaggagttgtgtaagcactacaacaaggactttggaattgaatgtcgcattggccgtttccataacatttatggcccatttggaacatggaaaggcggacgtgagaaagcaccagcagctttttgtagaaaagccctcacttccactgacaaattcgagatgtggggagatggaaagcaaactcgatctttcaccttcattgatgagtgtgttgaaggtgtcctgaggttaacaaaatccgacttcagagagcctgtgaacatcggaagtgatgagatggtaagcatgaatgagatggcagagatagtcctcagctttgatggcaagaaccttccgatccatcacattccaggaccagagggtgtgcgtggtcgaaactctgacaacactctcatcaaggaaaagcttggctgggctcctaatatgaagttgaaggatgggttgaggattacgtatttctggataaaggaacaaattgagaaagagaaggtgaagggtgccgatgtgtccacttatggatcatccaaagttgtgggaacacaagctccagttgaattaggctccctccgtgctgccgatggcaaagagtgaagtatagatgaagccaagtgattatcattcggtatgcactatggccatctgttagttccaccatgttttgttcgcgtggaatgtttacttattattgatatatctatatattacgcgctaaagcagtcctttttcccccacatcccctcattgcacctaccaaataatactcaagagatgtggtagtccagtaatgcttgcattttgtgatttctttttgctacctcaatgcatttgtggtattttctgagttttgtatgagacaatagccatttgctatcgatctatcattttcttgctcctcgactctgtaacattacactgtctttgctgcaataccagtgttcaatgttcaaatcgcgatgacaacaaaataactacattggtagagctacctagatgttgtaatagtgggaggtagtagtaagtatctgatgaaatagttgaggcgatctaaactcattcatctctactcgtgtatgcttagagatataccgttgatacattatatatacgtatcaatatattacatatacatattgtcc

SEQ ID NO: 1749 - DNA, 1700 bp, Solanum lycopersicum
ggtatttactataattatcttcaaccaagaaaccccttcaacttggaaattattgagtagctctataaagatagagatctattaccaaaaaaaaacatcaaaaaaataaataaaaagcatagcctcttggcccttatcatttttgagtttctccatcttcgagacctttaaagttcaagtttttcaagaatgggaacttctgttgaaaccacttatggagaatacacatatgaaaaccttgagagggagccctactggccttcagagaagcttcgggtctctattacaggtgctggtggatttattgcctcacacattgcgaggcgtctgaagactgaggggcattacattattgcttccgactggaagaagaatgagcacatgtctgaggacatgttttgtcatgagttccatcttgttgatctcagggtgatggataactgtttgaaagtcacaaaaggagttgatcatgtgttcaatctcgctgctgatatgggaggtatgggcttcattcagtcgaaccactcggtgatcatgtataacaacactatgatcagctttaacatgatggaggcttcaagaataaatagtgttaagaggttcttttatgcatccagtgcttgcatctaccctgaatttaagcaattggaaactaacgtgagcttaaaggagtctgatgcttggcctgcagagcctcaagatgcttatggcttagaaaagctagcaacagaggagttgtgtaagcactacaacaaggactttggaattgaatgtcgcattggccgtttccataacatttatggcccatttggaacatggaaaggcggacgtgagaaagcaccagcagctttttgtagaaaagccctcacttccactgacaaattcgagatgtggggagatggaaagcaaactcgatctttcaccttcattgatgagtgtgttgaaggtgtcctgaggttaacaaaatccgacttcagagagcctgtgaacatcggaagtgatgagatggtaagcatgaatgagatggcagagatagtcctcagctttgatggcaagaaccttccgatccatcacattccaggaccagagggtgtgcgtggtcgaaactctgacaacactctcatcaaggaaaagcttggctgggctcctaatatgaagttgaaggatgggttgaggattacgtatttctggataaaggaacaaattgagaaagagaaggtgaagggtgccgatgtgtccacttatggatcatccaaagttgtgggaacacaagctccagttgaattaggctccctccgtgctgccgatggcaaagagtgaagtatagatgaagccaagtgattatcattcggtatgcactatggccatctgttagttccaccatgttttgttcgcgtggaatgtttacttattattgatatatctatatattacgcgctaaagcagtcctttttcccccacatcccctcattgcacctaccaaataatactcaagagatgtggtagtccagtaatgcttgcattttgtgatttctttttgctacctcaatgcatttgtggtattctctgagttttgtatgagacaatagccatttgctatcgatctatcattttcttgctcctcgactctgtaacattacactgtctttgctgcaataccagtgttcaatgttcaaatcgcgatgacaacaaaataacta

SEQ ID NO: 1750 - DNA, 1245 bp, Lactuca sativa
attcgagaggaccgagtgccgctcaaattatatctctagaggatttgaagagcaaaccaaacctcacccttaaatccctgcaatatttcggcaaaatcttcagaatgggaacaataggtgaaacaaaatacgggtcattcacatacgagagccttgaaagggaaccctattggccatcagagaagcttcgtgtctcaatcacaggagctggaggattcattgcttcacacattgcacgtcgtttgaaaacagaaggccattacatcattgcatctgattggaagaaaaatgaacacatgcctgaagatatgttttgccatgaattccatcttgttgatcttcgtgtcatggataactgcttgaaagttacaaaaaatgttgatcatgtcttcaatatggctgctgatatgggtggaatggggttcattcagtccaatcattctgttattatgtataataacaccatgattagctttaatatgcttgaggctgcaagaatcactggagttaagaggttcttctatgcctcaagtgcttgcatttaccctgagtttaagcagttggaaaccaatgttagcttaaaggaatcagacgcctggccagctgagccacaagatgcttacggtttggaaaaactagcaactgaagagctatgcaggcactacaccaaagactttggaattgaatgccgaattggacgctttcataacatttatggaccttttggcacatggaaaggaggaagggagaaagcacctgctgctttttgcaggaaagcccttacggctactgataagtttgaaatgtggggagatgggctacagacacgatcttttaccttcattgatgagtgtgtcgaaggtgtcttaagattgacaaaatcggacttccgtgagccagtgaatattggaagtgatgagatggtaagcatgaatgaaatggctgaaattgttttgagctttgagaacaaaaagcttccaatccaccacataccaggcccagaaggtgttcgtggtagaaactctgacaacactttgatcaaagagaagcttgggtgggcccccaccatgaaattaaaggatggattaagaatcacatatttctggatcaaggaacaaatcgagaaagaaagaggtgaaggttttgacctttcggtttatggttcatccaaagtagttgggactcaagcacccgttcaactcggttctcttagggctgctgatggcaaagagtgaagaatttaaa

SEQ ID NO: 1751 - DNA, 1641 bp, Solanum phureja
tataataatcttcaaccaagaaacccctgcaacttggaaatgattgagtacctctataaagatagagatctattacccaaaaaaacatcaaaaaaacaaaataaaaaaaacatagccccttatcattattgagtttcgccatcttcttcaagaccttaaaagttcaaatttttcaagaatgggaacttctgttgaaaccacttatggagaatacacatatgaaaaccttgagagggagccctactggccatcagagaagcttcgggtctctattacaggtgctggtggatttattgcctcacacattgcaaggcgtctgaagaacgaggggcattacattattgcttctgactggaagaagaatgagcacatgtctgaggacatgttttgtaatgagttccatcttgttgatctcagggttatggataactgtttgaaagtcacaaaaggagttgatcatgtgttcaatctcgctgccgatatgggaggtatgggcttcattcagtcgaaccactcggtgatcatgtataacaacactatgatcagctttaacatgatggaggcttcaagaataaatagtgttaagaggttcttttatgcatccagtgcttgcatctaccctgaatttaagcagttggaaactaacgtgagcttaaaggagtctgatgcttggcctgcagagcctcaagatgcttatggcttagaaaagctagcaacagaggaattgtgtaagcactacaacaaggactttggaattgaatgtcgcattggccgtttccataacatttatggcccatttggaacatggaaaggcggacgtgagaaagcaccagcagctttttgtagaaaagccctcacttccactgacaaattcgagatgtggggagatggaaagcaaactcgatctttcaccttcattgatgagtgtgttgaaggtgttctgaggttaacaaaatcagactttagagagcctgtgaacatcggaagtgatgagatggtaagcatgaatgagatggcagagatagtcctcagctttgatggcaagaaccttccaatccatcacatcccaggaccagagggtgtgcgtggtcgaaactctgacaacactctcatcaaggaaaagcttggctgggctcctaatatgaagttgaaggatgggttgagaattacatatttctggatcaaggaacaaattgagaaagagaaggtgaagggtgccgatgtgtccgcttatggatcatccaaagttgtgggaacacaagctccagttgaattgggctccctccgtgctgccgatggcaaagagtgaagtagatgaagccaagtgattatcattcggtatgcacaatggccatctgttagctccaccatgttttgttcgcgtggaatgtttacttattgatataactatattacgcgctaaagcagtttttttccccccacatcccctcattgcacctaccaaataatactcagagatgtggtagtccagtaatgcttgcattttgtgatttctttttgctacctcaatgcatttgtggtattttctgagtttgtatgagacatagccatttgctatcaatctatcattttcttgctccttgactctgactctgtaacattacactgtctttgttgcac

SEQ ID NO: 1752 - DNA, 1322 bp, Artemisia annua
  misc_feature (18)..(18): n is a, c, g, or t
  misc_feature (21)..(21): n is a, c, g, or t
  misc_feature (25)..(25): n is a, c, g, or t
  misc_feature (30)..(30): n is a, c, g, or t
  misc_feature (32)..(34): n is a, c, g, or t
  misc_feature (38)..(41): n is a, c, g, or t
  misc_feature (277)..(277): n is a, c, g, or t
  misc_feature (814)..(814): n is a, c, g, or t
ttcaactttgcaaacagnatntccntcaanannncaannnnttttcagaatgggaaccaccggtgaaacgaagtatggttcttacacctacgaggcccttgagagagaaccctattggccaacagagaagcttcgtgtttccataacaggggctggaggattcattgcttcgcacattgctcgtcgtttgaaaaccgagggtcattacatcattgcttctgactggaagaaaaatgagcatatgccagaagacatgttttgtcacgagttccatctngttgatcttcgtgtgatggataattgtttgaaagttacagaaaaagttgatcatgtcttcaacttggctgctgatatgggtggtatgggattcattcagtcgaatcactctgttattatgtataacaatactatgattagttttaacatgctcgaggctgccaggatcagtggagtcaagaggttcttctatgcatcaagtgcttgcatttaccctgagtttaaacagttggagaccaatgtgagcttgaaggaagctgacgcatggcctgctgagcctcaagatgcttacggtttggagaaactagctactgaggagttgtgcaggcactataccaaagactttggaatcgagtgcagaattggtcgttttcacaacatctatggaccttttggcacatggaaaggtggaagggagaaagcacccgctgctttctgcagaaaagcccttacggccactgataagtttgaaatgtggggagatgggcttcaaactcgatcttttaccttcattgatgaatgtgttgaaggtgtcttnagattgacaaaatccgacttccgtgaacctgtgaatattggaagtgatgagatggtaagcatgaatgaaatggctgaaattgttcttagctttgaggacaagaagctccctattcaccacatcccgggtccagaaggtgtacgtggtagaaactcggacaacactttgatcaaagagaagcttggatgggctcctaccatgagattaaaggatggattgagatttacacatttctggatcaaggaacaaattgagaaagaaagaggtgaaggttttgacctttcggtttacggatcctctaaagttgtcggaacccaagcacctgttcaacttggatcactcagggcagccgatggaaaagagtaaaggcgtcacatccagtttccgccgtcttctgttcaaaattcttccttgtgttttgttgatgcatttattatttatcttggtatgtaaaaatcctgggcgatgctactttgcacgacctcttatcatttattattgtgctcta

SEQ ID NO: 1753 - DNA, 1472 bp, Lactuca sativa
tggcccgaatgcggggaggatattggagtgtatttgcacccatacgagtaggacacgagtgccgcccaaattatctcgctcgaggatttgcagagcaaaccaaacctcacccttaaatccctgcaatatttcggcaaaatcttcagaatgggaacaataggtgaaacaaaatacgggtcattcacatacgagagccttgaaagggaaccctattggccatcagagaagcttcgtgtctccatcacaggagctggtggattcattgcttcacacattgcacgtcgtttgaaaacagaaggccattacatcattgcttctgattggaagaagaatgaacacatgcctgaagatatgttttgccatgaattccatcttgttgatcttcgtgtcatggataactgcttgaaagttacaaaaaatgttgatcatgtcttcaatatggctgctgatatgggtggaatgggattcattcagtcaaatcattctgttattatgtataataacaccatgattagctttaatatgcttgaggctgcaagaatcactggagttaagaggttcttctatgcctctagtgcttgcatttaccctgagtttaagcagttggaaaccaatgtgagcttaaaggaatcagacgcctggccagctgagcctcaagatgcttacggtttggaaaaactagcaactgaagagctttgcaggcactacaccaaagactttggaattgaatgccgaattggacgctttcataacatttatggaccctttggcacatggaaaggcggaagggagaaagcacctgctgctttttgcagaaaggcccttacggctactgataagtttgaaatgtggggagatggtctacagacacgttcttttaccttcattgatgagtgtgttgaaggtgtcttaagattgacaaaatcggacttccgtgagccagtaaatattggaagtgatgagatggtaagcatgaatgaaatggctgaaattgttttgagctttgagaacaaaaagctcccaatccaccacataccaggcccagaaggtgttcgtggtagaaactctgacaacactttgatcaaagagaagcttgggtgggcccccaccatgaaattaaaggatggattaagaatcacatatttctggatcaaggaacaaatcgagaaagaaagaggtgaaggttttgacctttcggtttatggttcttccaaagtagttggaactcaagcacccgttcaactcggttctcttagggctgctgatggcaaagagtgaaggatttaaatctccattttctattattattattattattattattcatgttttcttgatgcatatgcatatttatctcgacttgtaatctcgtagaactatgctacgtttgcgtgatcttctatccatgtttattgtttgtgctttggcttttgtttttcttatgaatgaagtgtttcttttaagaacaaaaa

SEQ ID NO: 1754 - DNA, 1369 bp, Lactuca sativa
ccattcgagaggaccgagtgccgctcaaattatatctctagaggatttgaagagcaaaccaaacctcacccttaaatccctgcaatatttcggcaaaatcttcagaatgggaacaataggtgaaacaaaatacgggtcattcacatacgagagccttgaaagggaaccctattggccatcagagaagcttcgtgtctcaatcacaggagctggaggattcattgcttcacacattgcacgtcgtttgaaaacagaaggccattacatcattgcatctgattggaagaaaaatgaacacatgcctgaagatatgttttgccatgaattccatcttgttgatcttcgtgtcatggataactgcttgaaagttacaaaaaatgttgatcatgtcttcaatatggctgctgatatgggtggaatggggttcattcagtccaatcattctgttattatgtataataacaccatgattagctttaatatgcttgaggctgcaagaatcactggagttaagaggttcttctatgcctcaagtgcttgcatttaccctgagtttaagcagttggaaaccaatgttagcttaaaggaatcagacgcctggccagctgagccacaagatgcttacggtttggaaaaactagcaactgaagagctatgcaggcactacaccaaagactttggaattgaatgccgaattggacgctttcataacatttatggaccttttggcacatggaaaggaggaagggagaaagcacctgctgctttttgcaggaaagcccttacggctactgataagtttgaaatgtggggagatgggctacagacacgatcttttaccttcattgatgagtgtgtcgaaggtgtcttaagattgacaaaatcggacttccgtgagccagtgaatattggaagtgatgagatggtaagcatgaatgaaatggctgaaattgttttgagctttgagaacaaaaagcttccaatccaccacataccaggcccagaaggtgttcgtggtagaaactctgacaacactttgatcaaagagaagcttgggtgggcccccaccatgaaattaaaggatggattaagaatcacatatttctggatcaaggaacaaatcgagaaagaaagaggtgaaggttttgacctttcggtttatggttcatccaaagtagttgggactcaagcacccgttcaactcggttctcttagggctgctgatggcaaagagtgaagaatttaaagcgtgattttctattaatattattcatgttttcttgatgcatttacttatttatcttgacgtgtaatctgttagaactatgctacgtttgcgtgatcttctattgatgtttattatttgtgc

SEQ ID NO: 1755 - DNA, 1453 bp, Helianthus annuus
  misc_feature (985)..(985): n is a, c, g, or t
  misc_feature (1173)..(1173): n is a, c, g, or t
  misc_feature (1179)..(1179): n is a, c, g, or t
  misc_feature (1254)..(1254): n is a, c, g, or t
  misc_feature (1265)..(1265): n is a, c, g, or t
  misc_feature (1358)..(1358): n is a, c, g, or t
ggggcagccagaaacctaagataaaaagacagagtgcgagtctgtgagatacgagtggcgcccaaattctctcacaacaaatttcttcaaaatcaatcaattttgcttcaattattcagatttttcatcagaatggggacaacaagtgacactaaatacgggtcgttcacctacgagaacctcgagagggagccatactggccgtctgaaaagcttagggtttccataaccggggcgggtggattcatcgcatcgcacattgctagacgtttgaaaaccgaggggcattacattattgcttctgactggaagaaaaacgagcacatgtcggaagacatgttttgtcacgagtttcatcttgttgatcttcgtgtgatggataattgtttgaaagtgacggaaaacgttgatcatgtgtttaatttggctgctgatatgggtggtatggggttcattcagtcgaatcattcggttattatgtataataacactatgattagctttaacatgcttgaggctgccagaatcagcggagtcaagaggtttttctacgcctctagtgcttgcatttaccctgagtttaagcagttggaaaccaatgtgagcttgaaggaatccgacgcgtggcctgctgagcctcaagatgcttacggtttggagaaactagcgaccgaggaattgtgcaggcactacactaaagattttggaatcgagtgccgaattggacgttttcataacatttatggaccatttggcacatggaaaggcggaagggagaaagcaccggctgctttttgcagaaaagcgcttacggcaactgataagtttgaaatgtggggagacgggctacaaacccgatcgtttaccttcattgatgaatgtgttgaaggtgtcttaagattgacaaaatcagactttcgtgagcccgttaatatcggaagtgatgagatggtaagcatgaatgaaatggctgaaattgttctcngttttgaggataagaagctcccgattcatcacattccgggaccggaaggtgtacgtggtagaaactcggataacactttgattaaggaaaagcttgggtgggcccctaccatgagattaaaggatggattgagaatcacatatttctggatcaaggaacaaattgagaaagaaagaggtgaaggtttngacctntcggtttacgggtcgtcgaaagtggtcggtacccaagcgccagtccagctcgggtctctcagggccgccgacggnaaagaataagngtggtatcctcatgtcttaatttcaagattattctgcatgtttgtttatgatgcatacatatgtgtaatctttctagctatttaagagctctnctacttttgcatgctctcttatcgtttgtttactccattatttatttttgtaacttagtttcgatttgtttcgtatgaagcatgtcgttattatc

SEQ ID NO: 1756 - DNA, 1449 bp, Lactuca sativa
ggggaggatattggagtgtatttgcacccatacgagtaggacacgagtgccgcccaaattatctcgctcgaggatttgcagagcaaaccaaacctcacccttaaatccctgcaatatttcggcaaaatcttcagaatgggaacaataggtgaaacaaaatacgggtcattcacatacgagagccttgaaagggaaccctattggccatcagagaagcttcgtgtctccatcacaggagctggtggattcattgcttcacacattgcacgtcgtttgaaaacagaaggccattacatcattgcttctgattggaagaagaatgaacacatgcctgaagatatgttttgccatgaattccatcttgttgatcttcgtgtcatggataactgcttgaaagttacaaaaaatgttgatcatgtcttcaatatggctgctgatatgggtggaatgggattcattcagtcaaatcattctgttattatgtataataacaccatgattagctttaatatgcttgaggctgcaagaatcactggagttaagaggttcttctatgcctctagtgcttgcatttaccctgagtttaagcagttggaaaccaatgtgagcttaaaggaatcagacgcctggccagctgagcctcaagatgcttacggtttggaaaaactagcaactgaagagctttgcaggcactacaccaaagactttggaattgaatgccgaattggacgctttcataacatttatggaccctttggcacatggaaaggcggaagggagaaagcacctgctgctttttgcagaaaggcccttacggctactgataagtttgaaatgtggggagatggtctacagacacgttcttttaccttcattgatgagtgtgttgaaggtgtcttaagattgacaaaatcggacttccgtgagccagtaaatattggaagtgatgagatggtaagcatgaatgaaatggctgaaattgttttgagctttgagaacaaaaagctcccaatccaccacataccaggcccagaaggtgttcgtggtagaaactctgacaacactttgatcaaagagaagcttgggtgggcccccaccatgaaattaaaggatggattaagaatcacatatttctggatcaaggaacaaatcgagaaagaaagaggtgaaggttttgacctttcggtttatggttcttccaaagtagttggaactcaagcacccgttcaactcggttctcttagggctgctgatggcaaagagtgaaggatttaaatctccattttctattattattattattattattattcatgttttcttgatgcatatgcatatttatctcgacttgtaatctcgtagaactatgctacgtttgcgtgatcttctatccatgtttattgtttgtgctttggcttttgtttttcttatgaatgaagtgtttctttt

SEQ ID NO: 1757 - DNA, 1550 bp, Arabidopsis lyrata
aatactaataggagttggaaaactaaaaagaacgagtggtgttgctctgttcctctccctctctataaatacaatttactcttcctctgacccttctctgcattatctcttcgatctctccaactctcgaaaacctttctcagaatgggaactacaaatggaagtgattatggtgcttacacttacaaggagctagaaagagagccttattggccatctgagaagctcaagatatcgattaccggcgctggaggtttcattgcttcgcacattgctcgtcgtctgaagcacgaaggtcattacgtgattgcttctgactggaagaagaatgagcatatgactgaagacatgttctgtgatgaattccaccttgttgatcttagggttatggagaattgtctcaaggttactaaaggagttgatcatgtttttaacttagctgctgatatgggtggtatgggtttcattcagtctaaccattcggtgatcatgtataacaatactatgattagtttcaatatgatcgaggcggctaggatcaatgggattaagaggttcttctatgcttctagtgcttgtatttacccggagttcaagcagttggagactactaatgtgagcttgaaggagtcagatgcttggcctgcagagcctcaagatgcttatggtttggagaaacttgcaacagaggagttgtgcaagcattacaacaaagattttggaattgagtgccgcattggaaggttccataacatttatggtccttttggaacatggaaaggtggaagggagaaggctccagctgctttctgtagaaaggctctcacctccacagataggtttgagatgtggggagacgggcttcaaacccgctcttttaccttcattgatgagtgcgttgaaggtgtactcaggttgacaaaatctgatttccgtgagccggtgaacattggaagcgatgagatggtgagcatgaatgagatggctgagatggttctcagctttgaggagaagaagcttccaattcaccacattccaggcccagaaggtgttcgtggtcgtaactcagacaacaatctgatcaaagaaaagcttggttgggctccaaatatgagattgaaggaggggcttagaataacctacttctggataaaggaacagatcgagaaagagaaagcaaaaggaagtgatgtatccctttacgggtcatcaaaggtggttggaactcaagcaccggttcagctaggctcactccgcgcggctgatggaaaagagtgaatgaatggataattcaccaaagttcagcaaaatgtttagatatatgtttaggtagcttcctattaaaaagctataataagtgttttggattttggtttcttcccttctttaattcttgtttatgtttacttggaaaagtttgcattgttaagtcaattatacgatgtgttattgtggtcctttcacagtatgtatgtttattgtcatcgtcaacttgatgttgtggtcctctcacggaccagtaactaagtaagtggcttgtgttttttctt

SEQ ID NO: 1758 - DNA, 1200 bp, Lactuca sativa
acgagtggcgcccaaattctcaaagggattaatttttctacaataattcgttttttttttaatcagaatgggaacaattggtgaaacaaaatacgggtcattcacatacgagagcctggaaagggaaccctactggccaacagaaaagcttcgtgtctccatcacaggagctggtggattcattgcttcacacattgcacgtcgtttgaaaacagaaggccattacatcattgcttctgattggaagaaaaacgaacacatgcctgaagatatgttttgccatgaattccatcttgttgatcttcgtgtcatggataactgcttgaaagttacaaaaaatgttgatcatgtcttcaatatggctgctgatatgggtggaatgggattcattcagtccaatcattctgttattatgtataataacaccatgattagctttaatatgcttgaggctgcaagaatcactggagttaagaggttcttctatgcctctagtgcttgcatttaccctgagtttaagcagttggaaaccaatgtgagcttaaaggaatcagacgcctggcccgctgagcctcaagatgcttacggtttggaaaaactagcaactgaagagctctgcaggcactacaccaaagactttggaattgaatgccgaattggacgctttcataacatttacggaccttttggcacatggaaaggcggaagggagaaagcacctgctgctttttgcagaaaagcccttacggctactgataagtttgaaatgtggggagatggtctacagacacgctctttcaccttcattgatgagtgtgttgaaggtgtcttaagattgacaaaatctgacttccgtgagccagtaaatatcggaagtgatgaaatggtaagcatgaatgaaatggctgagattgttttgagctttgaaaacaaaaagctcccaatccaccacataccaggcccagaaggtgttcgtggtagaaactctgacaacactttgatcaaagagaaacttgggtgggcccccaccatgaaattaaaggatggattaagaatcacatatttctggatcaaggaacaaatcgagaaagaaagaggtgaaggttttgacctttcggtttatggttcttccaaagtagttgggactcaagcacccgttcaactcggttctcttagggctgctgatggcaaagagtgaag

SEQ ID NO: 1759 - DNA, 1584 bp, Raphanus sativus
ggaaatccttcacctctctctctctctctgcattatctcttcacattctccaagctctctctcagaatggctgcaaccaccaatggaagtagtgactatggtgaatacacatacaaggagcttgaaagagagctctactggccttcagagaagctgaggatctccatcaccggcgctggtgggttcatcgcttcccacattgctcgccgtttgaagcacgaggggcattacgtcattgcttctgactggaagaagaatgagcacatgactgaggacatgttctgcgacgagttccaccttgttgacctcagggtcatggagaattgcctcaaggtcactgatggcgttgatcacgtctttaacttggctgctgatatgggtggtatgggtttcatccagtccaaccactcggtgattatgtataacaacaccatgattagcttcaacatgattgaggctgctaggatcaatgggatcaagaggttcttctatgcttcaagtgcatgtatctacccggagttcaagcagctggaaactaccaatgtgagcctcaaggagtcagatgcttggcctgctgagcctcaagatgcttatggtttggagaaacttgcaacggaggagctgtgcaagcattacaacaaagattttggcattgagtgccgcattggaaggttccacaacatttacggtccctttggaacatggaaaggtggaagagagaaggctccagctgctttctgcaggaaggctctgacctccacagataggtttgagatgtggggagacgggcttcaaacccgttcatttaccttcattgatgagtgtgttgaaggtgtactcaggttgacaaaatcagatttccgtgagccggtgaacattggaagcgatgagatggtgagcatgaatgagatggctgagatggttctcagctttgaggaaaagaagcttccaattcaccacattccaggacctgaaggtgttcgtggccgtaactctgacaacaatctgatcaaagagaagcttggttgggctccaacaatgagattgaaggaggggcttagaataacctacttctggataaaggaacagattgagaaagagaaggctaaaggcagtgatgtgacgctttacggttcatcaaaggtggttgggactcaagcaccggttcagctaggctcactccgtgctgctgatggaaaagagtaaattgtggatgggtttcactactatcaaagcttggccttatttaataatttaaggtcaggaattatgttttagatataaggtcttaggtaagctttcctatgaaaaaaggaaaaagccaataataagtgttttttggatttgagtatccttctcttctttcttcttctgctctttctgtagcaaacttctgattcttgtttttattatttttttagttgaagaagtcgattatacttgtctattttcttgtggtcctttcacaacatgtgcaccatcattgtcaacttgatgatgctggtggtggtaccaaaaagtcaagttgccaagagtcctgtgatattttctttcagcttatcagtatctgatattactgtccga

SEQ ID NO: 1760 - DNA, 1489 bp, Brassica rapa
ggtcttcttgtgaaagcttgtatatatacgattgctctccctcctccgctcaaatccttcacccctctctctctctctctgcattatctcttcacattctctaaggtctctcagaatggctgcagctaccaatggaagtactgactacggtgcctacacatacaaggagcttgagagggagctctactggccttccgagaagctgaggatctccatcaccggcgctggaggtttcatcgcttcccacattgctcgccgtctgaagcacgagggccactacgtcattgcttctgactggaagaagaatgagcacatgactgaggacatgttctgcgacgagttccaccttgttgacctcagggtcatggagaattgcctcaaggtcaccgataaagttgatcacgtctttaacttggctgctgatatgggtgggatgggtttcatccagtccaaccactcggtgattatgtataacaacaccatgattagcttcaacatgattgaggctgctaggatcaatgggatcaagaggttcttctatgcttcaagtgcatgtatctatccggagttcaagcagctggaaactaccaatgtgagcctcaaggagtcagatgcttggcctgctgagcctcaagatgcttatggtctggagaaacttgcaacggaggagctctgcaagcattacaacaaagattttggcattgagtgccgcattggaaggttccataacatctatggtccctttggaacatggaaaggtggaagagagaaggctccagctgctttctgcaggaaggctctgacctccacagataggtttgagatgtggggagacgggcttcagacccgttcatttaccttcattgatgagtgtgttgaaggtgtactcaggttgactaagtcagacttccgtgagccggtgaacattggaagcgatgagatggtgagcatgaatgagatggctgagatggttctcagctttgaggaaaagaagcttccaattcaccacattccaggccctgaaggtgttcgtggccgtaactcagacaacaatctgatcaaagagaagcttggttgggctccaactatgagattgaaggaggggcttagaataacctacttctggataaaggaacagattgagaaagagaaggctaaaggcagtgatgtgacgctttatggttcatctaaggtggttgggactcaagcaccggttcagcttggctcactcagagctgctgatggaaaagagtaaatggatgggtttcactactatcaagcttggtcttatttaataattaaggtcaggaaattatgttttagatataaggtcttaggaaagctttcctttaaaaagaaaaaaagccaataataagtgtttttggattttgagtctccttctcttcttcctcttctgctcatctttctttctctgtagcaaacttcttttattattatttttttagttgaagaagtcattttcttgtgg

SEQ ID NO: 1761 - DNA, 1727 bp, Brassica napus
tgaggaccggtccgaattccgggtcgacccacgcgtccgtggtcttcgaagaagaaaaaacacaaaaaaaactaataaaacgagcggtgttgctgtgtccaagcctcctcgtcttcttgtgaaagcttgtatatatacgattgctctccctcctccgctcaaatccttcacccctctctctctctctctgcattatctcttcacattctctaaggtctctcagaatggctgcagctaccaatggaagtactgactacggtgcctacacatacaaggagcttgagagggagctctactggccttccgagaagctgaggatctccatcaccggcgctggaggtttcatcgcttcccacattgctcgccgtctgaagcacgagggccactacgtcattgcttctgactggaagaagaatgagcacatgactgaggacatgttctgcgacgagttccaccttgttgacctcagggtcatggagaattgcctcaaggtcaccgataaagttgatcacgtctttaacttggctgctgatatgggtgggatgggtttcatccagtccaaccactcggtgattatgtataacaacaccatgattagcttcaacatgattgaggctgctaggatcaatgggatcaagaggttcttctatgcttcaagtgcatgtatctatccggagttcaagcagctggaaactaccaatgtgagcctcaaggagtcagatgcttggcctgctgagcctcaagatgcttatggtctggagaaacttgcaacggaggagctctgcaagcattacaacaaagattttggcattgagtgccgcattggaaggttccataacatctatggtccctttggaacatggaaaggtggaagagagaaggctccagctgctttctgcaggaaggctctgacctccacagataggtttgagatgtggggagacgggcttcagacccgttcatttaccttcattgatgagtgtgttgaaggtgtactcaggttgactaagtcagacttccgtgagccggtgaacattggaagcgatgagatggtgagcatgaatgagatggctgagatggttctcagctttgaggaaaagaagcttccaattcaccacattccaggccctgaaggtgttcgtggccgtaactcagacaacaatctgatcaaagagaagcttggttgggctccaactatgagattgaaggaggggcttagaataacctacttctggataaaggaacagattgagaaagagaaggctaaaggcagtgatgtgacgctttatggttcatctaaggtggttgggactcaagcaccggttcagcttggctcactcagagctgctgatggaaaagagtaaatggatgggtttcactactatcaagcttggtcttatttaataattaaggtcaggaaattatgttttagatataaggtcttaggaaagctttcctttaaaaagaaaaaaagccaataataagtgtttttggattttgagtctccttctcttcttcctcttctgctcatctttctttctctgtagcaaacttcttttattattatttttttagttgaagaagtcattttcttgtggtcctttcacaacatgttcaccatcattgtcaacttggtgatgctgtggtggtaccaacagtcaagttggcaagtctttgtgatatttatctttcatcttatcattatcttatattatgtctttcacaca

SEQ ID NO: 1762 - DNA, 1570 bp, Brassica napus
gggctgcaggtcttcggcacgaggactctctctctctctctgcattatctcttcacattctctaaggtctctcagaatggctgcagctaccaatggaagtactgactacggtgcctacacatacaaggagcttgagagggagctctactggccttccgagaagctgaggatctccatcaccggcgctggaggtttcatcgcttcccacattgctcgccgtctgaagcacgagggccactacgtcattgcttctgactggaagaagaatgagcacatgactgaggacatgttctgcgacgagttccaccttgttgacctcagggtcatggagaattgcctcaaggtcaccgataaagttgatcacgtctttaacttggctgctgatatgggtgggatgggtttcatccagtccaaccactcggtgattatgtataacaacaccatgattagcttcaacatgattgaggctgctaggatcaatgggatcaagaggttcttctatgcttcaagtgcatgtatctatccggagttcaagcagctggaaactaccaatgtgagcctcaaggagtcagatgcttggcctgctgagcctcaagatgcttatggtctggagaaacttgcaacggaggagctctgcaagcattacaacaaagattttggcattgagtgccgcattggaaggttccataacatctatggtccctttggaacatggaaaggtggaagagagaaggctccagctgctttctgcaggaaggctctgacctccacagataggtttgagatgtggggagacgggcttcagacccgttcatttaccttcattgatgagtgtgttgaaggtgtactcaggttgactaagtcagacttccgtgagccggtgaacattggaagcgatgagatggtgagcatgaatgagatggctgagatggttctcagctttgaggaaaagaagcttccaattcaccacattccaggccctgaaggtgttcgtggccgtaactcagacaacaatctgatcaaagagaagcttggttgggctccaactatgagattgaaggaggggcttagaataacctacttctggataaaggaacagattgagaaagagaaggctaaaggcagtgatgtgacgctttatggttcatctaaggtggttgggactcaagcaccggttcagcttggctcactcagagctgctgatggaaaagagtaaatggatgggtttcactactatcaagcttggtcttatttaataattaaggtcaggaaattatgttttagatataaggtcttaggaaagctttcctttaaaaagaaaaaaagccaataataagtgtttttggattttgagtctccttctcttcttcctcttctgctcatctttctttctctgtagcaaacttcttttattattatttttttagttgaagaagtcattttcttgtggtcctttcacaacatgttcaccatcattgtcaacttggtgatgctgtggtggtaccaacagtcaagttggcaagtctttgtgatatttatctttcatcttatcattatcttatattatgtc

SEQ ID NO: 1763 - DNA, 1590 bp, Brassica napus
ctcgtcttcttgtgaaagcttgtatatatacgattgctctccctcctccgctcaaatccttcacctctctctctctctccctgcattatttcttcacattctctaaggtctctcagaatggctgcagctaccaatggaagtactgactacggtgcctacacatacaaggagcttgagagggagctctactggccttccgagaagctcaggatctccatcaccggcgctggtggtttcatcgcttcccacattgctcgccgtctgaagcacgagggccactacgtcattgcttctgactggaagaagaacgagcacatgactgaagacatgttctgcgacgagttccaccttgttgacctcagggtcatggagaattgcctcaaggtcaccgataaagttgatcatgtctttaacttggcggctgatatgggtgggatgggtttcatccagtccaaccactcggtgattatgtataacaacaccatgattagcttcaacatgattgaggctgctaggatcaatgggatcaagaggttcttctatgcttctagtgcatgtatctatccggagttcaagcagctggaaactaccaatgtgagcctcaaggagtcagatgcttggcctgctgagcctcaagatgcttatggtttggagaaacttgcaacggaggagctgtgcaagcactacaacaaagattttggcattgagtgccgcattggaaggttccataacatctatggtccttttggaacatggaaaggtggaagagagaaggctccagctgctttctgcaggaaggctctgacctccacagacaggtttgagatgtggggagacgggcttcaaacccgttcttttaccttcattgatgagtgtgttgaaggagtactcaggttgacgaagtcagacttccgtgagccagtgaacattggaagcgatgagatggtgagcatgaatgagatggctgagatggttctcagctttgaggaaaagaagcttccaattcaccacattccaggccctgaaggtgttcgtggacgtaactcagacaacaatctgatcaaagagaagcttggttgggctccaactatgagactgaaggaggggcttagaataacctacttctggataaaggaacagattgagaaagagaaggctaaaggcagtgatgtgacgctttacggttcatcaaaggtggttgggactcaagcaccggttcagcttggctcactcagagctgctgatggaaaagagtaaatgggatggggttcactactatcaagcttggccttatttaataattaaggtcaggaaattatgttttagatataaggtcttaggtaagctttcctttaaaaagaaaaaagccaataataagtgtttttggattttgagtctccttctcttcttcctcttctgctcatctttctttctgtagcaaacttcttttattattatttttttagttgaagaagtcattttcttgtggtccttttacaacattttcaccatcattgtcaacttgatgatgctgtggtggtaccaacagtcaagttggcaagtcttgtgatatttatctttcatcttgtc

SEQ ID NO: 1764 - DNA, 1505 bp, Centaurea maculosa
  misc_feature (1314)..(1315): n is a, c, g, or t
  misc_feature (1319)..(1319): n is a, c, g, or t
  misc_feature (1334)..(1334): n is a, c, g, or t
  misc_feature (1337)..(1337): n is a, c, g, or t
  misc_feature (1343)..(1344): n is a, c, g, or t
  misc_feature (1354)..(1354): n is a, c, g, or t
  misc_feature (1356)..(1357): n is a, c, g, or t
  misc_feature (1365)..(1365): n is a, c, g, or t
  misc_feature (1367)..(1369): n is a, c, g, or t
cgcggggcacaaagatgaaaaaagataaaaagggtgcccaaaaaacctaaagaaaaaagaccaccataaacttgaagcacatagttggagtgtatttccaccgtaaacgagtagaggatacgagtggcgcccaaattctgtcggaaagggatttgattcataaaaattaaaattttcatctgcttcaaaaaagggtcaattttgctcgtaatttgcgaaggatgggaaccggtgaagcgaaatacgggtcgttcacgtacgagagtctcgagagggagccttactggccgtcagacaagcttcgggtttccatcacgggagctggtgggttcatcgcctcccacatcgctcggcgtctgaaaaccgagggccattacatcatcgcgtctgactggaagaaaaacgagcacatgccggaggacatgttttgccatgagttccatcttgtcgatcttcgtgtgatggataattgtttgaaagttacgcagaacgttgatcatgtctttaacttggctgccgatatgggaggcatggggttcattcagtcgaaccattcagtcattatgtataacaacaccatgataagctttaacatgcttgaggcttctaggatcagtggagttaagaggttcttttacgcctctagtgcttgcatctatcccgagtttaagcagttggaaaccaccaatgtgagcttgaaggaatcagatgcttggcctgctgagcctcaagatgcttacggtttggagaaactagcaacggaggagttgtgcaggcactacaccaaagactttggaattgagtgccgaattggacgctttcataacatctatggaccttttggtacatggaaaggcggaagggagaaagcgcctgctgctttctgcagaaaggcccttacgtccaccgataagtttgaaatgtggggagacgggcttcaaactcgatcttttaccttcattgatgaatgtgtcgaaggtgtcttaaggttgacaaaatccgacttccgtgaaccggtgaatattggaagtgatgagatggtaagcatgaatgaaatggctgaaattgttctcgggtttgaggacaagaagctcccgatccaccacatcccgggcccggaaggagtacgtggtagaaactcagacaacactttgatcaaagagaagcttggatgggcccctaccatgaaattaaaggatggattgagaatcacatatttctggatcaaggagcaaattgagaaagaaaagggttctggctttgacctttcggtttacggcacgtccaaagtcgttgggacccaggcacccgttnnactnggatctctcagggcngcngatggnnaagaatgaangnntgtaaggntnnngtcttaaaattcgatgattgtttcaatgttctttgttaagacatttatgtttgatgtgtaatcttgtagtcttttgagagctttgctactttgctcttttatctcctatcgtttgaatcgattgttattgtgctcc

SEQ ID NO: 1765 - DNA, 1710 bp, Cichorium intybus
tgcttttgcgccctattggtagtggaattccgaacgcatatcgtataatccaatttttttatcttaaacgctgttatatattatttcccttaaaaaaacacatttttatgtcctccaaatttcaaacactataagataaagggcacactcaaaacatctatataaaaagaccatgaagtagaaggataatcggagtgagtatttccaccattggagtaggatacgagtgccgcccaaattatctggaaggggttttgttagaaccaacttcaccggcttcaaaagggatcaaatttcctacatccctctaatatctcgacaaaaatttcagaatgggaacaacaggcgaaacaaaatacggttcattcacatacgagagccttgaaagagaaccgtactggcccacagaaaagctccgtgtttccattacaggggcaggtggattcattgcttcccacattgcacgccgtttaaaaaccgaagggcattacatcattgcatctgactggaagaaaaacgagcacatgtcagaagacatgttttgccatgaattccatcttgttgatcttcgtgtgatggataattgtttgaaagttactgaaaatgttgatcatgtcttcaatttggctgctgatatgggaggaatgggattcattcagtcgaatcattcggttattatgtataataacaccatgattagtttcaacatgctcgaggcttccaggatcactggtgttaagaggttcttttatgcctctagtgcttgcatttaccctgagtttaaacagctggaaaccaatgtcagcttaaaggaatcagacgcttggcctgctgagcctcaagatgcttacggtttggaaaaactagcaactgaagagctatgcaggcactacactaaagactttggaattgaatgccgaattggacgctttcataatatttatggaccttttggcacatggaaaggcggaagggagaaagcacctgctgctttttgcagaaaagcccttacggctgttgataagtttgaaatgtggggagatggccttcagactcgttcttttaccttcattgatgagtgtgttgaaggtgtcttaaggttgacaaaatcggacttccgtgaaccagtgaacattggaagtgatgaaatggtaagtatgaatgaaatggctgaaattgttctgagctttgagaacaaaaagcttcctatccaccacatcccgggccccgaaggtgtacgcggtagaaactctgacaacactttgatcaaagaaaagcttgggtgggcccccaccatgaaattaaaggatggattaagaatcacatatttttggatcaaaggacaaatcgagaaagaaagaggcgaaggctttgacctttcggtttatggctcgtctaaagtggttgggacccaagcacccgttcaactcggctctctcagggcggctgatggcaaagagtgaagacttcaagaattcaagactgttttgtgaatgcatttatatttatcttgacgtgtaatctcctagagcttgctacgttgtgtgattccttatcgtttgttatcgtgctttagcttccgtatttttgttgttttttgagtgaggcatttcccttatggtcttcttgtaagtcttatgaaatatttatatggtttgagaaaaaatctatgcgtttaagagtacaaaagggtgtggatctctcattttc

SEQ ID NO: 1766 - DNA, 1362 bp, Carthamus tinctorius
  misc_feature (1089)..(1090): n is a, c, g, or t
  misc_feature (1154)..(1154): n is a, c, g, or t
  misc_feature (1170)..(1170): n is a, c, g, or t
gggtacgaaattcctcgtaatcacggaaagtacaaacctctcgaaaacggtggacgttacgatgggaaccggtgaagcgaaatacgggtcgttcacgtacgagaatctcgagagggagccttactggccgtccgacaagcttcgggtttccatcacaggagccggtgggttcatcgcctcccacattgctcgccgtctgaaaaccgagggccattacatcatcgcgtctgactggaagaaaaacgagcacatgccggaggacatgttttgccatgagttccatcttgtcgatcttcgtgtgatggataattgtttgaaagttacgcagaacgttgatcatgtctttaacttggcggctgatatgggtggcatgggtttcattcagtcgaaccattcagtcattatgtataacaacaccatgataagctttaacatgcttgaggcttctaggatcaatggagttaagaggttcttttacgcctctagtgcttgcatttaccctgagtttaagcagttggaaaccaccaatgtgagcttgaaggaatcagacgcttggcctgctgagcctcaagatgcttacggtttggagaaactagcaacggaggagttgtgcaggcactacaccaaagactttggaattgagtgccgaattggacgctttcataacatctatggacctttcggtacatggaaaggcggaagggagaaagcacctgctgctttctgcagaaaggctcttacgtccaccgataagtttgaaatgtggggagacgggcttcaaactcgatcttttaccttcattgatgaatgtgtcgaaggtgtcttaaggttgacaaaatccgacttccgtgaaccagtgaatattggaagtgatgagatggtaagcatgaatgaaatggctgaaatcgttctcgggtttgaggacaagaagctcccaattcaccacatcccgggcccagaaggagtacgtggtagaaactcggacaacactttgatcaaagagaagcttggatgggcccctaccatgaaattaaaggatggattgagaatcacatatttctggatcaaggagcaaattgagaaagaaannggtgctggctttgacctttcggtttacggcacgtccaaagtcgttgggacccaggcacctgttnaactcggatctctganggctgctgatggcaaagaatgaaacgtatgtaaggctccagtctccgttttcgttcttcttaaagttcgaagattgttataatgttctttgttaagacatttatgtttgatgtgtaatcttgtagtcttttgagagctttgctactttgctcttttatctcctatcgtttgaatcgattgttattgtgctct

SEQ ID NO: 1767 - DNA, 1543 bp, Tragopogon dubius
cccatgctgcttcgattctaatatttagaaatcttgatttgtacaagtttgatccatatataacataccattgctttcgctcaaattcataatcttagttataaaaagaaaagcagataaagggtacatccaagaaacctttagtagtatacgagtggcgcccaaattttctggttagggttttgttaaaagaatcttctcccgctccaaaagggacatcaattttgctagatctttctaataattcgattttttccaagaatgggaacaactgcagatgcaaagtacgggtcatacacatatgaggctcttgaaagggaaatctactggccaacagagaagcttagggtttccataacaggagcaggtggattcattgcttcccacattgctcgacgtctgaaaaccaaggacattacatcatcgcctctgattggaagaaaaatgagcacatgcctgaggacatgttttgtcatgaattccatcttgttgatcttcgtgtgatggataattgcttgaaagttactgaaaatgttgatcatgtgttcaatttggctgctgatatgggtggaatggggttcattcagtcgaatcattcagtgattatgtataacaacaccatgatcagttttaatatgcttgaggcttccagaatcagtggagttaagaggttcttctatgcctctagtgcttgcatttaccctgagtttaagcaattggaaaccaatgtgagcctgaaggaagcagatgcttggccagctgagcctcaagatgcttacggtttggagaagctagcaaccgaggagctctgcaagcactacaccaaagactttggaatcgaatgcagaattggacgctttcataacatctatggtcctttcggcacatggaaaggtggaagggagaaagcaccagctgctttttgcagaaaagcacttacggctaccgataagtttgagatgtggggagatgggttgcagactcggtcttttaccttcattgatgagtgtgttgaaggtgtcttgaggttgacaaaatcggattttcgtgaaccggtgaatattgggagtgatgagatggtgagtatgaatgaaatggcggaaattgttttgggatttgagaataagaaccttccgattcagcacattccgggcccggaaggtgttcgtgggagaaactcggataacactttgatcaaagagaagcttgggtgggccccgaccatgaaactaaaggatggattgagattcacatatttttggatcaaggaacagattgagaaggaaagaggtgcagggtttgacctttcggtttatggttcttccaaagtggttgggacccaagcacccgttcaacttggttctctcagggctgccgatggcaaggagtgaagcgttaataatacccgatttccattttaagactttttaatttcaagactcttcttatttatctcgacatgtagtttctacattgtgtgagctggtattgtttattattgtgatttactatctgttttttcatgaatttctatgattgaggt

SEQ ID NO: 1768 - DNA, 1466 bp, Brachypodium distachyon
ggtaggccgcccacgagtcttccttcctctttgcctgctcccaaatctcgcgccccacgacttctttcagaatggcactcaacaaggagtatacgtatgcggatctggagaaggaaccatactggccatttgagaagctgcggatctcgattacgggagctggcgggttcatagcctcccacatcgcgaggcgcctgaagggcgaggggcactacattatcgcctctgactggaagaagaatgagcacatggaggaggatatgttctgtcatgagttccatcttgctgatctgagggtgatggacaactgcctcaaggtgaccactggggtcgatcatgttttcaaccttgcagctgatatgggagggatgggcttcatccagtctaaccactccgtgatcatgtacaacaacactatgatcagctttaacatgcttgaggctgctagaatcaatggcatcaaaaggttcttttatgcctcaagtgcttgcatctaccctgaatttaagcagctggaaactgtagttagcttgaaggaggcagatgcttggcctgctgagcctcaagacgcttatggcttggagaaacttgctactgaggaactgtgcaagcattacacaaaggactttggcattgagtgcagggttggtcgctttcacaatatatatggtccatatggaacatggaagggtggaagggagaaggcacctgctgctttctgcagaaaggctcagacctccactgatcgctttgagatgtggggagatggtctgcagactagatccttcacatttattgatgaatgtgtagagggtgtcctcaggctaacgaagtctgatttccgtgagcctgtaaacatcggaagcgatgaaatggtgagcatgaatgagatggctgagatagtcctcggctttgagaacaagcagctgcccatccaccacatcccaggccctgagggtgttcgtggccggaactccgacaacactctcatcaaggagaagcttggctgggctccaaccatgaggctgaaggatgggctgaggatcacatacttctggatcaaggagcagctagagaaggaaagggcggaaggcggcgacgtttcagcctatggatcatccaaggtctgcaccacgcaggcgccagtccagctcggctccctccgcgctgcagatggcaaggagtgaacactcatcctgggcaagaagaccatgtcatgatatgctgctggtctcagatttctttcacggtcctattgtttgttagttgcaacaccatctgtgccatttcttgattcagtttggaatttcacatactgctttttgttgttgttgtaaacgagaataactgctatgattaaaaagaggatgtcagtgttataggccacaatattatacatgtaacatgatgttggttcatcttcacgacaaaccatgaaataaaacttcttagttaccttcgagaca

SEQ ID NO: 1769 - DNA, 1216 bp, Brachypodium distachyon
cacgagtcttccttcctctttgcctgctcccaaatctcgcgccccacgacttctttcagaatggcactcaacaaggagtatacgtatgcggatctggagaaggaaccatactggccatttgagaagctgcggatctcgattacgggagctggcgggttcatagcctcccacatcgcgaggcgcctgaagggcgaggggcactacattatcgcctctgactggaagaagaatgagcacatggaggaggatatgttctgtcatgagttccatcttgctgatctgagggtgatggacaactgcctcaaggtgaccactggggtcgatcatgttttcaaccttgcagctgatatgggagggatgggcttcatccagtctaaccactccgtgatcatgtacaacaacactatgatcagctttaacatgcttgaggctgctagaatcaatggcatcaaaaggttcttttatgcctcaagtgcttgcatctaccctgaatttaagcagctggaaactgtagttagcttgaaggaggcagatgcttggcctgctgagcctcaagacgcttatggcttggagaaacttgctactgaggaactgtgcaagcattacacaaaggactttggcattgagtgcagggttggtcgctttcacaatatatatggtccatatggaacatggaagggtggaagggagaaggcacctgctgctttctgcagaaaggctcagacctccactgatcgctttgagatgtggggagatggtctgcagactagatccttcacatttattgatgaatgtgtagagggtgtcctcaggctaacgaagtctgatttccgtgagcctgtaaacatcggaagcgatgaaatggtgagcatgaatgagatggctgagatagtcctcggctttgagaacaagcagctgcccatccaccacatcccaggccctgagggtgttcgtggccggaactccgacaacactctcatcaaggagaagcttggctgggctccaaccatgaggctgaaggatgggctgaggatcacatacttctggatcaaggagcagctagagaaggaaagggcggaaggcggcgacgtttcagcctatggatcatccaaggtctgcaccacgcaggcgccagtccagctcggctccctccgcgctgcagatggcaaggagtgaacactcatcctgggcaagaagaccatgtcatgatatgctg

SEQ ID NO: 1770 - DNA, 1435 bp, Hordeum vulgare
cagtcctccagcagctccccgattccctcacagaatggcgctcaacgagaagtacacgtacgccgagttggagaaggagccgtattggccattcgagaagctgcggatctcgattacaggagctggcggcttcatagcctcccacattgcaaagcgcctcaagggcgaggggcactacatcatcgcctctgactggaagaagaacgaacacatggaagaggatatgttctgccatgagtttcaccttgctgatctgagggtcatggacaactgcctcaaggtaaccactggggttgaccatgttttcaatctggcagctgatatgggagggatgggcttcatccagtccaaccattctgtcatcatgtacaacaacactatgatcagctttaacatgcttgaggctggtagaatcaatggtgtcaagaggttcttttatgcctcgagtgcttgcatctaccctgaatttaagcagctggaaactgtagttagcttgaaggaggcggatgcttggccggcagagcctcaagatgcctatggcttggagaaacttgccactgaggaattgtgcaagcactacacaaaggactttgacattgagtgccgggttggtcgctttcacaatatatatggtccatatgggacatggaagggtggaagggagaaggcacctgctgctttctgcagaaaggctctaacctccactgaccggtttgagatgtggggagatggtctgcagactagatccttcacatttattgatgaatgtgtggagggtgtcctcaggctcacaaagtctgatttccgcgagcctgtaaacatcgggagtgatgaaatggtgagcatgaacgagatggctgagatagtcctgggcttcgagaacaagcagctgcccatccaccacatccctggccccgagggcgtccgtggccgtaactctgacaacacactcatcaaggagaagcttggctgggctccaaccatgaggctgaaggatgggctgaggatcacgtatttttggatcaaggagcagctggagaaggaaaaatccgaaggcgcagacgtgtcggcatacggatcatccaaggtctgcaccacgcaggcaccggtccagcttggctccctccgcgccgcagatggcaaggagtgaacactctcgcctaggcaaggagatcagttgtttgtcagttgtcacaccatttcttgattcagtctgaactttcatatactgcgtgagatttgtagctttttgtgctgttgtaaacgggaataactgcttggcgcaagaggatgttattaatgttaaacattttatttgtacatgtaaaatccggtcagttcgtcttaatgacaacaatgaaataatattttgttactttgtgagaaaaaaaaaaaaaaaaaactcgagacctagttctctcctggtgccgaattc

SEQ ID NO: 1771 - DNA, 1447 bp, Hordeum vulgare
ttcggcacgaggctttcctctccggtacccagaatattctgggggagaaaacggaaaaaacagtcctccagcagctccccgattccctcacagaatggcgctcaacgagaagtacacgtacgccgagttggagaaggagccgtattggccattcgagaagctgcggatctcgattacaggagctggcggcttcatagcctcccacattgcaaagcgcctcaagggcgaggggcactacatcatcgcctctgactggaagaagaacgaacacatggaagaggatatgttctgccatgagtttcaccttgctgatctgagggtcatggacaactgcctcaaggtaaccactggggttgaccatgttttcaatctggcagctgatatgggagggatgggcttcatccagtccaaccattctgtcatcatgtacaacaacactatgatcagctttaacatgcttgaggctggtagaatcaatggtgtcaagaggttcttttatgcttcgagtgcttgcatctaccctgaatttaagcagctggaaactgtagttagcttgaaggaggcggatgcttggccggcagagcctcaagatgcctatggcttggagaaacttgccactgaggaattgtgcaagcactacacaaaggactttgacattgagtgccgggttggtcgctttcacaatatatatggtccatatgggacatggaagggtggaagggagaaggcacctgctgctttctgcagaaaggctctaacctccactgaccggtttgagatgtggggagatggtctgcagactagatccttcacatttattgatgaatgtgtggagggtgtcctcaggctcacaaagtctgatttccgcgagcctgtaaacatcgggagtgatgaaatggtgagcatgaacgagatggctgagatagtcctgggcttcgagaacaagcagctgcccatccaccacatccctggccccgagggcgtccgtggccgtaactctgacaacacactcatcaaggagaagcttggctgggctccaaccatgaggctgaaggatgggctgaggatcacgtatttttggatcaaggagcagctggagaaggaaaaatccgaaggcgcagacgtgtcggcatacggatcatccaaggtctgcaccacgcaggcaccggtccagcttggctccctccgcgccgcagatggcaaggagtgaacactctcgcctaggcaaggagatcagttgtttgtcagttgtcacaccatttcttgattcagtctgaactttcatatactgcgtgagatttgtagctttttgtgctgttgtaaacgggaataactgcttggcgcaagaggatgttattaatgttaaacattttatttgtacatgtaaaatccggtcagttcgtcttaatgacaacaatgaaataatattttgttactttgtgagata

SEQ ID NO: 1772 - DNA, 1675 bp, Zea mays
tcctcctccataagagacaagaacgaggtcgtctcgccatcgccgccactcctatttaagagctgccggaggtgggggtagatccggcgagccgttcccgctgtccagattcaggaactagactcctccggtccggtcctccccctcccgccccgtctcgctccagcggctccacgccaccgtttgccattcactgccagaatggcgctcaacaaggagtacacgtacgcggagctggagaaggagccgtactggccgttcgagaagctgcgggtctccatcaccggggccggcgggttcatcgcctcccacatcgcgcgccgcctcaagggcgagggccactacgtcgtcgcctccgactggaagaggaacgagcacatgcccgaggacatgttctgccacgagttccacctcgtggacctgagggtcatggacaactgcctcaaggtcaccacgggggttgaccacgtgttcaacctcgcggctgacatgggtgggatggggttcatccagtccaaccactccgtcatcatgtacaacaacaccatgatcagctttaacatgcttgaggctgctagaattaacggcgtcaagaggttcttctatgcatcaagtgcctgcatctaccctgagttcaagcagctggaaactgtagttagcttgaaggagtccgatgcttggcctgccgagcctcaagatgcctatggcctggaaaaactcgcgactgaggagctgtgcaagcactatacaaaggattttggcatcgagtgccggattggtcgctttcacaacatatatggtcccttcggcacatggaaaggtggaagggagaaggcgcctgctgctttctgcaggaaggctctgacctccacagggcgctttgagatgtggggtgatggcctgcaaaccagatccttcacatttattgatgaatgtgttgaaggtgtccttaggttaacaaagtccgatttccgtgagcctgtaaacattggaagcgacgaaatggtgagcatgaacgagatggcggaaatggtcctgagctttgagaacaagcagctgcccatccaccacatccccgggccggagggcgtgcgtgggcgcaactcagacaacacgctcatcaaggagaagcttggctgggctccgactatgaggctgaaggacgggctgaggatcacgtactcctggatcaaggagcagcttgagaaggagaaggccgagggcatggatctgtcggtctacggatcatccaaggtcgtgcagacacaggccccggttcagctcggctccctccgcgccgctgatggcaaggagtgaactttggctgcgccggtcagttgcagggcatgatataccagtaatacacagttgtttcagtttccatgatttgtagtcaccatttcttgattcacatttgactccacaagagaagaccatttggacgatggatattttgtcacaagttacgggatttagttcaaatttgaactgaatacaaaatatcctgacacgatatctgtcgtccaaacacttataataatttccacgctgttttttttcctcttgtgtgcctgtacaatagaatattgcagacttacaacacacatgtaaactggtgtcactttatttcacagaaatagcaatgaataaaataaggttaagcagtcttgaaatc

SEQ ID NO: 1773 - DNA, 1630 bp, Raphanus sativus
  misc_feature (8)..(8): n is a, c, g, or t
  misc_feature (15)..(15): n is a, c, g, or t
  misc_feature (48)..(48): n is a, c, g, or t
  misc_feature (66)..(66): n is a, c, g, or t
  misc_feature (72)..(72): n is a, c, g, or t
  misc_feature (77)..(77): n is a, c, g, or t
  misc_feature (159)..(159): n is a, c, g, or t
  misc_feature (331)..(331): n is a, c, g, or t
  misc_feature (719)..(719): n is a, c, g, or t
  misc_feature (775)..(775): n is a, c, g, or t
  misc_feature (880)..(880): n is a, c, g, or t
  misc_feature (919)..(919): n is a, c, g, or t
  misc_feature (922)..(922): n is a, c, g, or t
  misc_feature (931)..(931): n is a, c, g, or t
  misc_feature (1060)..(1060): n is a, c, g, or t
  misc_feature (1468)..(1468): n is a, c, g, or t
  misc_feature (1518)..(1518): n is a, c, g, or t
ggacccgnagagatnggagaaagtttaacaaaaacgagtggtgttgcnctgttctgttcatcttcntcatcntctcntctccttgtctataaataacaataacacacacgatttctctccctccctcctccttcccccaaaatcctcacatttatctcntcttcaccgtctcgaagctttctcaggaatggcgacaaccaccaatggaagtactgactacggtgcctacacatacaaggacctctcaagagaactctactggccttctcagaaactcaagatatcaatcaccggcgccggaggtttcatagcttcccacatcgctcgccgnctgaagcacgagggccattacgtcatcgcttccgactggaagaagaacgagcacatgactgaagacatgttctgcgatgagttccacctcgttgatctcagggtcatggagaattgcctcaaggttaccgatggtgttgatcacgtctttaacttggctgctgacatgggtggcatgggtttcatccagtccaaccactcggtgatcatgtataacaatactatgattagttttaatatgatcgaggctgctaggatcaatgggattaagaggttcttctatgcttctagtgcatgtatttatccggagttcaagcagctggaaactactaatgtgagcctcaaggagtcagatgcctggcctgcagagcctcaagatgcttatggtntggagaaacttgcaacggaggagctgtgcaagcattacaacaaagactttgggatngagtgccgcattggaaggttccataacatttacggtccttttggaacatggaaaggtggaagagagaaggctcctgctgctttctgcagaaaggctcttacctcnacggataggtttgagatgtggggagacgggcttcaaacncgntctttcacnttcattgatgagtgtgttgaaggtgtactcaggttgacaaaatcagatttccgtgagccggtgaacataggaagcgatgagatggtgagcatgaatgagatggcagagatggttctgagctttgagganaagaagctaccgattcaccacattccaggaccagaaggtgttcgtggccgtaactcggacaacaatctgatcaaagagaagcttggttgggctccaacgatgagattgaaggaggggcttagaataacttacttctggataaaggaacagattgagaaagagaaggccaaaggcagtgatgtgtcgctttatggatcatcaaaagtggttgggactcaagcaccggttcagctcggctcactccgagctgctgatggaaaagagtagatggatgatggagaatatggccttgatcaatatatgattaaggtcaggagaatgtttagttatacctttaagtaagctttcctattattatagaaaaaaagcaataagtgttttggatttgactgtcctcttttgctaatnatcttgcttgttttataattatttttttgggggttgaagaaactgttccntgttaagttaattatactatgtgtaattatatattattgtggtcctgacacaatatgttaagttgatgttgtggtaccaggaatctagtgtccgagttctgatattttccca

SEQ ID NO: 1774 - DNA, 1509 bp, Brassica oleracea
  misc_feature (279)..(279): n is a, c, g, or t
  misc_feature (304)..(304): n is a, c, g, or t
  misc_feature (395)..(395): n is a, c, g, or t
  misc_feature (1419)..(1419): n is a, c, g, or t
  misc_feature (1421)..(1421): n is a, c, g, or t
  misc_feature (1423)..(1423): n is a, c, g, or t
  misc_feature (1425)..(1425): n is a, c, g, or t
  misc_feature (1494)..(1495): n is a, c, g, or t
ggtgaaagcttgtatatatacgattgctctccctcctccgctcaaatccttcacctctctctctctctctctctctgcattatctcttcacattccctaagatctctcagaatggctgcagctaccaatggaagtactgactacggtgcctacacatacaaggagcttgagagggagctctactggccttccgagaagctcaggatctccatcaccggcgctggtggtttcatcgcttcccacattgctcgccgtctgaagcacgagggccactacgtnattgcttctgactggaagaagaacnagcacatgactgaagacatgttctgcgacgagttccaccttgttgacctcagggtcatggagaattgcctcaaggtcaccgataaagttgntcatgtctttaacttggcggctgatatgggtgggatgggtttcatccagtccaaccactcggtgattatgtataacaacaccatgattagcttcacatgattgaggctgctaggatcaatgggatcaagaggttcttctatgcttctagtgcatgtatctatccggagttcaagcagctggaaactaccaatgtgagcctcaaggagtcagatgcttggcctgctgagcctcaagatgcttatggtttggagaaacttgcaacggaggagctgtgcaagcactacaacaaagattttggcattgagtgccgcattggaaggttccataacatctatggtccttttggaacatggaaaggtggaagagagaaggctccagctgctttctgcaggaaggctctgacctccacagacaggtttgagatgtggggagacgggcttcaaacccgttcttttaccttcattgatgagtgtgttgaaggagtactcaggttgacgaagtcagacttccgtgagccggtgaacattggaagcgatgagatggtgagcatgaatgagatggctgagatggttctcagctttgaggaaaagaagcttccaattcaccacattccaggccctgaaggtgttcgtggacgtaactcagacaacaatctgatcaaagagaagcttggttgggctccaactatgagactgaaggaggggcttagaataacctacttctggataaaggaacagattgagaaagagaaggctaaaggcagtgatgtgacgctttacggttcatcaaaggtggttgggactcaagcaccagttcagcttggctcactcagagctgctgatggaaaagagtaaatgggatggggttcactactatcaagcttggccttatttaataattaaggtcaggaaattatgttttagatataaggtcttaggtaagctttcctttaaaaagaaaaaagccaataataagtgtttttggattttgagtctccttctcttcttcctcttctgctcatcntncntnctgtagcaaacttcttttattattatttttttagttgaagaagtcattttcttgtggtccaaaaaagannaaaaagagaaaaaa

SEQ ID NO: 1775 - DNA, 1615 bp, Glycine max
gccaattgtgagcaaataacaaacgagtggctttcccttcttctcatcctatatataccattcccatcactccccatgccctctcaattcacttcctatccccttctctgattctctccatatattatctcaaacccctctcacagaatgggaagtgctggaggaactgactatggtgcatacacttatgagaatcttgagagagagccttactggccatcagagaagcttaagatttccatcactggtgctgggggttttatcgcgtcacacatagctcggcgcctcaagacagaggggcattacattattgcttctgattggaagaaaaatgagcacatgactgaggacatgttctgtgatgaattccatcttgttgatctcagggtcatgaataactgcctcaaggttacagagggggttgatcatgttttcaatcttgccgcagacatgggtgggatgggttttattcagtctaaccactctgtcattatgtacaacaacacaatgattagcttcaacatgattgaggctgccaggattaacggcattaagaggtttttttatgcctctagtgcttgtatctaccctgaattcaaacagttggaaactaatgttagcttgaaggagtctgatgcatggccagctgagccacaagatgcatatgggctagagaagcttgcaacagaggaattatgcaagcactataacaaggattttggaattgagtgccgcattgggaggttccacaacatatacggtccttttgggacatggaaaggcatgctttacactgaattgaaaacttttatagtggaagggagaaggctcctgctgctttttgtcgtaaagttatcacttcctctgatagatttgagatgtggggggatggattgcaaacacgatcatttaccttcattgatgaatgtgttgaaggggtgctcagattgactaaatctgatttccgagagccagtaaatattggaagcgatgagatggtcagcatgaatgagatggctgagatcattcttggctttgagaacaagaatattcctattcaccacattcctggccccgagggtgtccgaggtcgtaattcagacaatacacttataaaagaaaaacttggttgggctccaactatgaggttgaaggatggactgaggatcacatacttctggattaaggagcagatcgagaaggagaaggctcaaggtattgatatatcagtgtatgggtcttccaaagtggtgcagactcaagccccagttcaactaggctcacttcgagcagcagatggcaaagaatgaggtggtcaacatatggctgtagtagtattcacctaaatgtttcaagtgaagagttggattatatatagcaactaaatagcggtatctggttatttttaattagctgctaaggatttcttatgtatctgctggttgttcatgtttggatcggaagccctgatgttcctaatgtattttatatagttttttaaggcacttcgtggtgcttaaggtggtttactgcactagaagctctaaattatttgttttgaattttgatgtctaaataattgattagtaagcaaataatcttttcttccttgtga

SEQ ID NO: 1776 - DNA, 1532 bp, Triticum aestivum
gtacccagaatattctggggacaaaacggaaaaaccagtctccagcagctccccgattccctccatcagttttcggtgtccccggctccgagctcatccactgctcctgcgacgtcgccggccgccgctccggagcccccctccttgccgccggcacgcggccgctccgtctctcgcagaatggcgctcaacaaggagtacacttacgcggacttggagaaggagccatactggccattcgagaagctgcggatctcaatcactggagctggtgggttcatagcctcccacattgcaaagcgcctcaagggcgaggggcactacatcatcgcctctgactggaagaagaacgaacacatggaagaggatatgttctgccatgagtttcaccttgctgatctgagggtcatggacaactgcctcaaggtaaccactggggttgaccatgttttcaaccttgcagctgatatgggagggatgggcttcatccagtccaaccattctgtcatcatgtacaacaacactatgatcagctttaacatgcttgaggctagtagaatcaatggtgtcaagaggttcttttatgcctcgagtgcttgcatctaccctgaatttaagcagttggaaactgtagttagcttgaaggaggcagatgcttggcctgcagagcctcaagatgcctatggcttggagaaacttgccactgaggaattgtgcaagcactacacaaaggacttcgacattgagtgccggattggtcgctttcacaatatatatggtccatatgggacatggaagggtggaagggagaaggcacccgctgctttctgcagaaaggctctaacctccactgaccggtttgagatgtggggagatggtctgcagactagatccttcacatttattgatgaatgtgtggagggtgtcctcaggctcacaaagtctgatttctgcgagcctgtaaacattggaagtgacgaaatggtgagcatgaacgagatggctgagatagtcctgggcttcgagaacaagcagctgcccatccaccacatccctggccccgagggtgtccgtggccgtaactctgacaacacgctcatcaaggagaagcttggctgggctccaaccatgaggctgaaggatgggctgaggatcacgtatttttggatcaaggagcagctggagaaggaaaagtccgaaggtgctgacatgtcggcatatggaacatccaaggtctgcaccacgcaggcaccggtccagcttggctccctccgcgccgcagatggcaaggagtgaacactcgctctaggcaaggagatcagttgtttgtcagttgtcacaccatttcttgattcagtctgaactttcacatactgcatgagatttgtagccttttgtgctgttgtaaacgggaataactgcttggtgcaagaagatgttatgttaaacattttatttatatacatgtaaaatctggtcagttcgtcttcatgaaaacaatgaaataatagtttgttactttgtgaaaaaaa

SEQ ID NO: 1777 - DNA, 1540 bp, Triticum aestivum
cccggtacccggaatattctggggagaaaacggaaaaaccagtctcaagcagctccccgattccctccatcagttttcggtctccccggttccgagctcatccactggtcctgcgacgtcgccgaccgccgctccggaacccccctccttcccgccggcaagcagccgctccgtctctcacagaatggcgctcaacaaggagtacacttacgcggacttggagaaggagccatactggccattcgagaagctgcggatctcgatcactggagctggtgggttcatagcctcccacattgcaaagcgcctcaagggcgaggggcactacatcatcgcctctgactggaagaagaacgaacacatggaagaggatatgttctgccatgagtttcaccttgctgatctgagggtcatggacaactgcctcaaggtaaccactggggttgaccatgttttcaatctcgcagctgatatgggagggatgggcttcatccagtccaaccattctgtcatcatgtacaacaacaccatgatcagctttaacatgcttgaggctggtagaatcaatggtgtcaagaggttcttttatgcctcgagtgcttgcatctaccctgaatttaagcagttggaaactgtagttagcttgaaggaggcagatgcttggcctgcagagcctcaagatgcctatggcttggagaaacttgctactgaggaattgtgcaagcactacacaaaggactttgacattgagtgccggattggtcgctttcacaatatatatggtccatatgggacatggaagggtggaagggagaaggcacctgctgctttctgcagaaaggctctaacctccactgaccggtttgagatgtggggagatggtctgcagactagatccttcacatttattgatgaatgtgtggagggtgtcctcaggctcacaaagtctgatttctgcgagcctgtaaacatcggaagtgacgaaatggtgagcatgaacgagatggctgagatagtcctgggcttcgagaacaagcagctgcccatccaccacatccctggccccgagggtgtccgtggccgtaactctgacaacacgctcatcaaggagaagcttggctgggctccaaccatgaggctgaaggatgggctcaggatcacgtattcttggatcaaggagcagctggagaaggaaaagtctgaaggcaccgacatgtccgcatacggaacatccaaggtctgcaccacgcaggcaccggtccagcttggctcccttcgcgccgcagatggcaaggagtgaacaccagctctaggcaaggagatcagttgtttgtcagttgtcacaccatttcttgattcagtctgaactttcacatactgcatgagatttgtagccttttgtgctgttgtaaacgggaataactgcttggtgcaagaggatgttttgttaaacattttatttatatacatgtaaaatctggtcagttcgtcttatgaaaacaatgaaataatagtttgttactttgtgagaaaaaaaaaa

SEQ ID NO: 1778 - DNA, 1390 bp, Lolium multiflorum
caagaatcttctttgcccacttccaaatctcgctgcggcggctccgttcagcgacttcaaagaatggcgctcaacgacaagcacacatacgcggaattggagaaggagctgtactggccagctgagaagctgcggatctccattacaggagctggcgggttcatcgcttcccaccttgcaaagcgcctcaagagcgaggggcactacatcatcgcctctgactggaagaagaatgagcacatggacgaggatatgttctgccatgagtttcaccttgctgatctcagggtgatggacaactgcctcaaggtcaccactggggttgaccatgttttcaacctagcagctgatatgggagggatgggtttcatccagtctaaccactctgtgatcatgtacaacaacactatgatcagctttaacatgcttgaggctggtagaatcaatggtgtcaaaaggttcttttacgcctcaagtgcttgtatctaccctgaatttaagcagctggaaactgtcgttagcttgaaggaggcagatgcttggcctgcagagcctcaagatgcttatggtttggagaaacttgcgacggaggaactatgcaagcactacacaaaggacttcgacatagagtgccgagttggtcgctttcacaatatttatggtccatatggaacatggaagggtggaagggagaaggcacctgctgctttctgcagaaaggctctaacctccactgaccgctttgagatgtggggagatggtctgcagactagatccttcacattcattgatgaatgtgtggagggtgtcctcaggctaacgaagtctgatttctgtgagcctgtgaacatcgggagtgacgaaatggtgagcatgaacgagatggccgagattgtccttggcttcgagaacaaggagctgcccatccaccacatccctggccccgagggtgtccgcggccgtaactctgacaacacacccatcaaggagaagcttggctgggctccaaccatgaggctgaaggatgggctgaggatcacatacttctggatcaaggagcagctggagaaggagaggatggaaggagccgatgtgtcggcctacggaacatccacggtcgtcggcacccaggcgcccgtccagcttggatccctccgcgctgcagatggcaaggagtaaaagactcaccctgggaaagacgatgatgccattatgtgcccgctggttccagacgtggcatcatctgctatttcttagttaccgcaccatctccatatctttattcagtttggacttgacttgcaacatgagatgtatacctttggttagcctgcattctgtgtttttgtaaacgagaaaaactgcttggtacctcggccgcgaccacgct

SEQ ID NO: 1779 - DNA, 1546 bp, Avena sativa
agaatcttcgttgccctccaaatctcgctgccgcgactccgttcagcgacttcaaagaatggccctcaacgaggagtacacgtacgcggcgttggagaaggagctgtactggccatctcagaagctgcggatctccattacaggagctggtgggttcatcgcctcccaccttgcgaggcgcctgaagggcgaggggcactacatcatcgcctctgactggaagaagaatgagcacatggaagaggatatgttctgccacgagttccaccttgctgatctgagggtgatggacaactgcctcaaggtgaccactggggttgaccatgttttcaacctagcagctgatatgggagggatgggcttcatacagtccaaccactctgtgatcatgtacaacaacactatgatcagcttcaacatgcttgaggccggtagaatcaatggtgtcaaaaggttcttttatgcatcaagtgcttgtatctaccctgaatttaagcagcttgaaactgttgttagcttgaaggaggcagatgcttggcctgcagagcctcaagacgcttatggcttggagaaacttgctacagaggaactgtgcaagcactacacaaaggactttgacatagagtgccgagttggtcggtttcacaatatttatggtccatatggaacatggaagggtggaagggagaaggcacctgctgctttctgcagaaaggctctaacctccactgaccgctttgagatgtggggagatggtctgcagactagatccttcacattcattgatgaatgtgtggagggtgtcctcaggctaacgaagtcagatttctgtgagcctgtaaacattggaagcgatgaaatggtgagcatgaacgagatggctgagatagtacttggtttcgagaacaagcagctgcccatccaccacatccctggccctgagggtgtccgtggccggaactcggacaacacgctcatcaaagagaagcttggctgggctccaaccatgaggctgaaggatgggctgaggatcacatactcgtggatcaaggagcagctggagaaggaaaagtccacgggcgccaacgtgtcggactacggatcatccaaggtgtgcaccacgatggcgcctgtccagctcggctccctccgcgccgcagatggcaaggagtgacacactcaacctgggaaagaagatggtgccattatatgccggggcggttccagatgtggcatcatctgctgtttgttgctagttgccacaccatatcttgattcagtttggacttcacgtgctacaatgagatctactatacgttttgttagcttgcatttcacctgctttgtgtttgttttttttgtaaacgggaaaaactgcttggtacgagaagatgtgaatgcttgctatagacaacaatatcaaattatacatgtaaaatgatgtgggttcatcttcacgagaacaatgaaataaggggctggttatatttttttaactgaatccatgtgctggtgagtaatctgtaattaaaaaaaaaaaaaaaaa

SEQ ID NO: 1780 - DNA, 1147 bp, Manihot esculenta
atatattcctgatcgtatgctgcagaatggggagttctggtgcaaccgcttatggtgagtacacctatgaggaccttgagagggagccctattggccttcagaaaagctccgcatttcaattactggtgctggtgggttcatagcctcgcacattgccgggcgacttaagagtgaagggcattatataattgcttcggactggaagaagaatgagcaatatgacagaggacatgttctagtgatggataactgtttgaaggtgacatctggggttgatcatgtgttcaaccttgctgctgatatgggaggaatgggcttcattcaatcaaaccattctgtcattatgtataacaatacaatgatcagtttcaatatgcttgaggctgcaaggatcaatggagttaagaggttcttttatgcttctagtgcctgcatttaccctgaatttaagcagctagacactaatgtgagcttgaaggagtctgatgcctggcctgcagagcctcaagatgcttatggtttggagaagcttgcaactgaagagctatgcaagcactacactaaggactttggaattgagtgtcgaattgcgcgatttcatagcatatacgggccatttggtacatggaaaggtgggagagaaaaagcccctgcagcattttgtcggaaggccatcacttccacccatgtgtttgagatgtggggagatgggctgcaaacatggtcttttaccttcattgatgaatgtgtagagggtgtactaagattgacaaagtcagatttccgagagccagtgaatattggaagtgatgaaatggtcagtatgaatgagatggctgagattgtcctcagctttgagatcaagaagcttcccatccatcacattcctggtcctgagggagtgcgaggtcgaaactcagataacactctgattaaagaaaagctgggatcggccccttctatgaagttaaaggatggacttaggatcacatacttctggattaaggagcagattgaaaaagagaaagctcaaggtgttgatttaaccatttatgggtcatcaaaagtagtgggaacacaagcacctgtgcgactgggctccctccgagctggtgatggcgaagaatgaggcttatagactttgaa

SEQ ID NO: 1781 - DNA, 2014 bp, Selaginella moellendorffii
aaggtttgtaatttgatagctagaggagatggggagccactatggcgattacaccgcaggggcagagctggagcgcgaggcctattggccgaatgaaaagcttcgcatttccatctccggcgctggaggattcatcgcatcacacattgcgcggcggctcaaggccgagggccactacgtcatcgcgtcggattggaagaagaacgagcatatgagcgaggagatgttttgccacgaattccatctcgtggatctgcgagtgatggagaattgcttggcggtgaccaagggtgttgatcacgtctttaatttggcagccgacatgggtgggatgggattcatacaatcgaatcactcggtgattcttttcaacaacaccatgatcagtttcaacatgctggaagcagctcggatcaatggagtcaaaagatttttctatgcatccagcgcatgcatttacccagaattcaagcaacttgaaacgaacgtgagtctcaaggaatcggatgcttggccagcagagcctcaagatgcttatggactagagaagctctgcagtgaagagctgtgcaagcactacaccaaggattttggaatcgagtgccggattggaagatttcacaatatttatgggccttttggtacctggaaaggtggacgggagaaggctccagcggcattttgtaggaaagctctaacttccactgataagtttgagatgtggggtgatgggaagcaaacacgatcatttacgttcatcgatgaatgtgtggagggtgttttgaggctgacaaagtcggactttcgtgaaccgctcaatatcggaagtgatgagatggtgagcatgaacgagatggctgagattatcttgggttttggagacaagaaactgccaatccaccatatccctgggccagaaggtgttcgtggtagaaattcggacaacgatctgataaaggagaagctcggttgggccccaacaatgcgactcaaggatggactccggatcacttatatgtggatcaaggaggagctagacaaggagatctctgagggacaggatatggctgcttatagctcctccaaagttgtgggaactcaagctcctgtccagcttggctcgctcaggaaggccgatggcaaggagtagtaaagcgaacttaagtgacaaactcaaaaaaagtaaaagagtgagctttggataatcacgaagcgttccttcactcccacttgcagtggaagtgaaagagtagcagcaataagaatacaaacatcttggttttatttttctttctcttggcttggattcgattcgcttgaaacgatggaactttagctggcgagagcttccttgagctccttattctctttcatctccatgataatgtcacagcccccgataagctcgcctttgtggtagagctgaggataagttggccagtttgagaatgccttgagcccctgcctcacctcctcgtcactgagaatatcaaagctgccaaattcgatgccttcctccttgagtgcgcttgccaccttcttgctaaacccgcactttggctcctccggcgtccctttcatgaaaagcattgtcggggacgagtgaatcagctttttcagccggctgttgatgtcttccttttcctctgtcgcccccacagcttccttgagctcgccactcttgtgcatttccatgacgatgtcgcatccacctatcagctcgcccttgaagtatagctgcggaaacgttggccagttggagaaggacttgatgccttgccggacctcttcgtcgctcagaatgtcgaaggagccaaaaggaactcccacctcctcgagtgctcccgccactttcttgctgaaaccgcactttggctccgacggactccctttcatgaacagcatcacgtcgtgcgagtggataagcttctttagacgctcctcgagagtttcctccggtcccttgtcggatccattggcgtgagctttgctgccattctcttgcgactttagc

SEQ ID NO: 1782 - DNA, 2409 bp, Selaginella moellendorffii
cccttccttcccttcccacgggccaccctccatgagaaaatttccatttgggaaattttcttgtggcgttgcatagaacctctactgagataccttagaaattttcgtgcaattgtaaaaaggtgaaaaggaaatagtaaaaggctcttttcttggggcctttttaccccatacatagggcttgtataaattaggagggaagagaggagagatagccaaaggtttgtaatttgatagctagaggagatggggagccactatggcgattacaccgcaggggcagagctggagcgcgagacctattggccgaatgaaaagcttcgcatttccatctccggcgctggaggattcatagcatcacacatcgcgcggcggctcaaggccgagggccactacgtcatcgcgtcggattggaagaagaacgagcatatgagcgaggagatgttttgccacgaattccatctcgtggatctgcgagtgatggagaattgcttggcggtgaccaagggtgttgatcacgtctttaatttggcagccgacatgggtgggatgggattcatacaatcgaatcactcggtgattcttttcaacaacaccatgatcagtttcaacatgctggaagcagctcggatcaatggagtcaaaaggtttttctatgcatccagcgcatgcatttacccagaattcaagcaacttgaaacgaacgtgagtctcaaggaatcggatgcttggccagcagagcctcaagatgcttatggactagagaagctctgcagtgaagagctgtgcaagcactacaccaaggattttggaatcgagtgccggattggaagatttcacaatatttatgggccttttggtacctggaaaggtggacgggagaaggctccagcggcattttgtaggaaagctctaacttccactgataagtttgagatgtggggtgatgggaagcaaacacgatcatttacgttcatcgatgaatgtgtggagggtgttttgaggctgacaaagtcggactttcgtgaaccgctcaatatcggaagtgatgagatggtgagcatgaacgagatggctgagattatcttgggttttggagacaagaaactgccaatccaccatatccctgggccagaaggtgttcgtggtagaaattcggacaacaatctgataaaggagaagctcggttgggccccaacaatgcgactcaaggatggactccggatcacttatatgtggatcaaggagcagctagacgaggagatctctgagggacaggatatggctgcttatagctcctccaaagttgtgggaactcaagctcctgtccagcttggctcgctcaggaaggccgatggcaaggagtagtaaagcgaacttaagtgacaaactcaaaaagtaaaagagtgagctttggataatcacgaagcgttccttcactcccacttgcggtggaagtgaaagagtagcagcaataagaatacaaacatcttggttttatttttctttctcttggcttggattcgattcgcttgaaacgatggaactttagctggcgagagcttccttgagctccttattctctttcatctccatgataatgtcacagcccccgataagctcgcctttgtggtagagctgaggataagttggccagtttgagaatgccttgagcccctgcctcacctcctcgtcactgagaatatcaaagctgccaaattcgatgccttcctccttgagtgcgcttgccaccttcttgctaaacccgcacattggctcctccggcgtccctttcatgaaaagcattgtcggggacgagtgaatcagctttttcagccggctgttgatgtcttccttttcctctgtcgcccccatagcctccttgagctcgccactcttgtgcatttccatgacgatgtcgcatccacctatcagctcgcccttgacgtatagctgcggaaacgttggccagttggagaaggacttgatgccttgccggacctcttcgtcgctcagaatgtcgaaggagccaaaaggaactcccacctcctcgagtgctcccgccactttcttgctgaaaccgcactttggctccgacggactccctttcatgaacagcatcacgtcgtgcgagtggataagcttctttaggcgctcctcgagagtttcctccggtcccttgtcggatccattggcgtgagctttgctgccattctcttgcgactttagcttggcgtccgcgagagcttctcccagctccccactcttgtgcatctccattatcacatcacaccctcccaaaagctcgcctttgtagtacagctgcgggtatgtgggccagttggagtagagcttcaaaccttgacggacttcttcgtcttgcaagatgtcgaagctcccaaaatccac

SEQ ID NO: 1783 - DNA, 1501 bp, Musa acuminata
  misc_feature (4)..(4): n is a, c, g, or t
  misc_feature (66)..(67): n is a, c, g, or t
  misc_feature (103)..(103): n is a, c, g, or t
  misc_feature (115)..(115): n is a, c, g, or t
  misc_feature (835)..(835): n is a, c, g, or t
  misc_feature (847)..(847): n is a, c, g, or t
  misc_feature (874)..(874): n is a, c, g, or t
  misc_feature (877)..(877): n is a, c, g, or t
  misc_feature (895)..(895): n is a, c, g, or t
  misc_feature (898)..(898): n is a, c, g, or t
  misc_feature (931)..(931): n is a, c, g, or t
  misc_feature (940)..(940): n is a, c, g, or t
  misc_feature (943)..(943): n is a, c, g, or t
  misc_feature (952)..(952): n is a, c, g, or t
  misc_feature (960)..(961): n is a, c, g, or t
  misc_feature (964)..(964): n is a, c, g, or t
  misc_feature (982)..(982): n is a, c, g, or t
  misc_feature (991)..(991): n is a, c, g, or t
  misc_feature (1009)..(1009): n is a, c, g, or t
  misc_feature (1065)..(1065): n is a, c, g, or t
gggnaccgagatctcatctcgcacgcctcgccatcgctctctctctctccctcgcctctctgctcnngtctccgttgaatcgtcgagaatgggtagcaccacnggaaatgatggnaccgactacggagcgtacacttttgcaaacttagagagggaaccatattggccttctgagaagttgcggatttctatcactggagctggaggattcatcgcatctcacattgctaggcgtctgaagaatgaaggtcattacattattgcctctgattggaagaagaatgagcacatgaccgaggatatgttctgtcatgaattccatcttgtcgatctgagggtcatggataattgcttgaaggtcactagtggggcaaaccatgtatttaaccttgctgctgatatgggtggaatgggtttcatccagtccaaccattcagtgattttttacaataacactatgatcagtttcaacatgcttgaagctgcaaggattaatggtgtgaaaaggttcttttatgcctcaagtgcttgcatctaccctgagttcaagcagttggacaccaatgtgagcctgaaggagtctgatgcttggcctgctgagcctcaagatgcttatggcttggaaaagcttgctacagaggaattgtgcaagcactacaataaggactttggcattgaatgccggatcggaaggttccataacatttatggtccctttggaacttggaaaggtgggagggagaaagcccctgctgccttctgccgaaaggcaataacatctactgataagtttgagatgtggggagatggtctgcaaactcgatccttcaccttnattgatgaatgngttgaaggtgttctaagattgacaaantcngacttccgagagccagtnaanattggcagtgatgaaatggtgagcatgaatganatggctganatngtactcagntttgagannaanaaccttcccatccatcanattcctggncctgagggtgtccgtggncgcaactctgacaacactctgatcaaagagaaacttggttgggctccatctatganactaaaggatggcctccgaatcacatacttttggataaaggagcaaatcgaaaaagaaaaagctcggggacaagatgtgtctgtttatggatcatccaaagtgtaggaacgcagcaccagtgcagttgggttctctccgtgcagccgatggaaaagaatgaatccaacatccaggatttagtaccggtagctttaagacaccggcatggaagacaatacagcaaagtcagagagtcgaaatcggtagatttgctttgtgttatttcatatcgtagtaagtaaggtggtgtttgttctgccttgtttgtcgttcctcggattcgccttgtgttaaggttaatatcatcatcgtcgtagagacatcgcgttagtcttcgtgcctattctgaatctaaaacgacataacaacaaatagaaaaggaaaggctattgttgg

SEQ ID NO: 1784 - DNA, 2134 bp, Physcomitrella patens
ggaggaacaaacaatctggacccttctttggctatccccttttcggctactttaacttcaaactttccctgggagttttgccatttgtctctgtgaagagagtctgggtttcggaaggtttttcgaagtgatcgattgaggagtcgggaagatcgtatctggtgttgttgcttgtaggagagtagtttgtttgagatggcgagtaatggcagcttcggtgactacacggccacgaacttggaccgggaagagtactggccctcccaaaagctgagaatttctatcacgggagctggtgggtttattgcctcgcacatcgcgcgtcgattgaagagcgaggggcactacataatcgcctccgactggaagaagaatgagcacatgagtgaggatatgttctgcgacgagtttcacctcgtggatctgcgtgtcatggacaattgcatgaaggtcactaagggcgctcatcatgtgttcaacttggctgccgacatgggtggtatgggcttcatccagtctaaccacgccgtcattatgtacaacaacaccatgatcagtttcaacatgctcgaagccgctcgcatcaacggtgttacccggtttttctatgcctcaagcgcgtgcatttaccctgaattcaagcaactcgaaactgatgtgagcagtttgaaggagtctgatgcgtggcccgctctgccccaagatgcttacggtcttgaaaagttggccaccgaggagttgtgcaaacattacacgaaggactttggcatggagtgccgcattggtcgctttcacaacatttatggcccatacggaacctggaagggtgggcgtgagaaggcacccgccgccttctgcagaaaggccttgacagccaccgagcatttcgagatgtggggcgatggcaagcaaactcgctccttcaccttcatcgacgagtgtgtagagggcgtcttgcgcttgacgaagtccgacttccaagagcctgtaaatatcggtagcgatgagatggtgagcatgaacgagatggccgagattgtgctcagcttcgacaacaagcagctcccgatcaagcacattcccggacccgagggagtgcggggacgaaactctgataacactctgatcaaggagaagctcggctgggctccatccatgcgactcagggacggactcgccatcacctacaagtggatcaaggagcagattgagaaggagaaggagtccggtgcagaccttgcatccaagtatggatcttccaaggtggtcggcacccaagctccagtgcagctgggctctttgagagctgctgatggcaaggagtaaaccaactcaactcaattccacaggctggtttaaaacaatctgcatgatgtgactgtgattgttgggttttttctccgtgtgaattagttgtgtcggtcggttgaggtcgactgtgagactccacagaatgaggtcgctttgactgtctgagtgtttgccgcaagatgccaccgggtttgactatcccttgttcaattttccccctcactcccccgctccccttgtggtttataaccgagctggaagaccagtgaagcttggctccagcctagatcagttagagtgtttcaatgcaagacattctttcaataataaacaaaaagaataaaagaacctgattgcaggcgtccatgtgacacttacctttgattaaactcgtcagtgggtcaagtttttttcttctcattttgacaatggttctgcgaaattctaccgaagctggtgaaaattctgttcatattagtataccagaagttcttgttaaaacccctagtatctttgttcggtcaaatttgagtacttctagctatacggacttgggttgatgtttttacatgaggggtcaaaacttgtaagtaagtaaattgtaaaattgaatcacatgcccagttgcaaataattgcttgtacataacagtagattaaaaataatttcctgcaaatgactagaatgaaaattccattatttgtgttaaatgtaaaatgaataattacgaaatggaaaaaaaggtgtatccacaacgtttgtaaaaaccaatgtatcattttagtctataatgaaatcgactaatctatgattgacactcatc

SEQ ID NO: 1785 - DNA, 2133 bp, Physcomitrella patens
ggaggaacaaacaatctggacccttctttggctatccccttttcggctactttaacttcaaactttccctgggagttttgccatttgtctctgtgaagagagtctgggtttcggaaggtttttcgaagtgatcgattgaggagtcgggaagatcgtatctggtgttgttgcttgtaggagagtagtttgtttgagatggcgagtaatggcagcttcggtgactacacggccacgaacttggaccgggaagagtactggccctcccaaaagctgagaatttctatcacgggagctggtgggtttattgcctcgcacatcgcgcgtcgattgaagagcgaggggcactacataatcgcctccgactggaagaagaatgagcacatgagtgaggatatgttctgcgacgagtttcacctcgtggatctgcgtgtcatggacaattgcatgaaggtcactaagggcgctcatcatgtgttcaacttggctgccgacatgggtggtatgggcttcatccagtctaaccacgccgtcattatgtacaacaacaccatgatcagtttcaacatgctcgaagccgctcgcatcaacggtgttacccggtttttctatgcctcaagcgcgtgcatttaccctgaattcaagcaactcgaaactgatgtgagcagtttgaaggagtctgatgcgtggcccgctctgccccaagatgcttacggtcttgaaaagttggccaccgaggagttgtgcaaacattacacgaaggactttggcatggagtgccgcattggtcgctttcacaacatttatggcccatacggaacctggaagggtgggcgtgagaaggcacccgccgccttctgcagaaaggccttgacagccaccgagcatttcgagatgtggggcgatggcaagcaaactcgctccttcaccttcatcgacgagtgtgtagagggcgtcttgcgcttgacgaagtccgacttccaagagcctgtaaatatcggtagcgatgagatggtgagcatgaacgagatggccgagattgtgctcagcttcgacaacaagcagctcccgatcaagcacattcccggacccgagggagtgcggggacgaaactctgataacactctgatcaaggagaagctcggctgggctccatccatgcgactcagggacggactcgccatcacctacaagtggatcaaggagcagattgagaaggagaaggagtccggtgcagaccttgcatccaagtatggatcttccaaggtggtcggtacccaagctccagtgcagctgggctctttgagagctgctgatggcaaggagtaaaccaactcaactcaattccacaggctggtttaaaacaatctgcatgatgtgactgtgattgttgggttttttctccgtgtgaattagttgtgtcggtcggttgaggtcgactgtgagactccacagaatgaggtcgctttgactgtctgagtgtttgccgcaagatgccaccgggtttgactatcccttgttcaattttccccctcactcccccgctccccttgtggtttataaccgagctggaagaccagtgaagcttggctccagcctagatcagttagagtgtttcaatgcaagacattctttcaataataaacaaaaagaataaaagaacctgattgcaggcgtccatgtgacactcacctttgattaaactcgtcagtgggtcaagtttttttcttctcattttgacaatggttctgcgaaattctaccgaagctggtgaaaattctgttcatattagtataccagaagttcttgttaaaacccctagtatctttgttcggtcaaatttgagtacttctagctatacggacttgggttgatgtttttacatgaggggtcaaaacttgtaagtaagtaaattgtaaaattgaatcacatgcccagttgcaaataattgcttgtacataacagtagattaaaaataatttcctgcaaatgactagaatgaaaattccattatttgtgttaaatgtaaaatgaataattacgaaatggaaaaaaaggtgtatccacaacgtttgtaaaaaccaatgtatcattttagtctataatgaaatcgactaatctatgatgacactcatc

SEQ ID NO: 1786 - DNA, 1785 bp, Physcomitrella patens
agccagggcggaatctcccttgcattcttcgagctcctccgcgttttgcagtattaaaacaccactgaggctgcgcgaggaaggactagctctctcggccctcacttggctatccccaccgcaggttactgcatctacaaagattgtgcgagggtgcactgtgatttcgtcgctgcgggaagaggttggggtttttgatttgtgtgtgtaaggtttttgatcatagagacaggtgaaattttcactatagctgttggtttgttggagattaattcagagatggcgagctatggccgcttcggtgactataccgccacaaacttggaccgggaggcatacaggcccgcggagaagctgcgaatctccatcacaggggctggtgggttcatcgcctcgcacatcgcgcgccgattgaagagcgaagggcactacatcattgcctccgactggaagaagaatgagcacatgagcgaggatatgttctgcgacgagttccacctcgtggatctgcgcgtcatggacaattgcttgaaggtcaccaagggcgccaatcacgtcttcaacctggccgccgacatggggggcatgggcttcatccagtccaatcacgctgtcattatgtacaacaataccatgatcagcttcaacatgcttgaagcctcacgcatcaatggtgtctctaggtttttctatgcttcaagcgcgtgtatctatcctgaattcaaacagctggagactgacgtgagcagcctgaaggagtcggacgcttggcccgctctgccccaggatgcttatggccttgagaagttagccacggaggagctgtgtaggcactatacaaaggacttcggcatggagtgtcgcattggtcgtttccacaacatctacggtccctatggaacctggaaggggggacgtgagaaggctcccgctgccttctgcaggaaggccttgacagctaccgagtactttgagatgtggggcgatggcaagcaaacccgttcattcaccttcatcgacgagtgcgtggagggcgtcttgcgcctgacgaagtccgacttccaggaaccagtaaacatcggcagtgacgagatgctgagcatgaacgagatggccgagattgtgctcagctttgacaacaagaagctcccaatcaagcacatccccggaccggagggagtgcgcgggcggaactcagacaacactttgatcaaagagaagctcggctgggctccctccatgcgcctcagggacgggcttgccatcacatacaaatggatcaaggagcagatcgagaaagagaaggaatcgggtgccgatcttgcatccaaatatggatcctccaaggtggtcggcacccaggccccagtgcagctgggctccttgagagccgccgacggcaaggagtaaacagttttgcaccattttgaagctaatgaaaggctttttaataatgaaaggctttaaataacgtgggcttcaaatccgaggaaatcgggggggatggtggctggttgaagccagcggaacgagactcacgcggtggagtccagtgcagtatagagctatacaagaaggtttgactgccttggattacttgctgcagttgcaaccagaactgagccattctatattcattatctcttgttacctttgctagcagctgaggaaagcctagtacagccttagaacggaagggttgtcactgtaactgttgtaggaaaaacctatgaaaacagaacataaccaatttcagcgggctttccaacgctacctttggatgcc

SEQ ID NO: 1787 - DNA, 1227 bp, Gerbera hybrid cultivar
gctccattacaggcgcgggtggattcattgcttcacacattgccaggcgtttgaaaacagagggccattacatcattgcctctgactggaagaagaatgaacacatgtcagaagacatgttttgtcatgaatttcatcttgctgatcttcgcgtaatggataattgtttgaaagttacggaaaatgttgatcatgtctttaatttggctgctgatatgggtggtatgggcttcattcagtcgaatcactctgttattatgtataataacacgatgattagctttaatatgcttgaggctgcaaggattaatggagttaagaggttcttctatgcctctagtgcttgcatttaccctgagtttaagcagttggaaactaatgtgagcttgaaggagtctgacgcttggcctgccgagcctcaagatgcttatggtttggagaaactagcaactgaggagttgtgtaagcactacactaaagactttggaattgagtgccgaattggacgcttccataacatctatggaccttttggcacatggaaaggcgggagggagaaagcgcctgcggctttttgccgaaaagccctaacctccattgacaagtttgaaatgtggggagacggccttcaaactcgatcttttacgttcattgatgaatgcgtcgaaggtgtcttgaggttgacaaaatcggatttccatgagcctgtgaatattggaagtgatgagatggtgagtatgaacgaaatggcagaaatcgttcttggatttgaagataagaagcttccgatagaacatattccgggcccggagggtgttcgtggtcgtaactctgataatactttgatcaaagagaagcttgggtgggccccgaccatgaaactgaaggatggactgagaatcacatatttctggataaaggatcaaattgagaaaaaaaaggtgaaggttttgacctctccctttacggacctccaaggtggtggggactcaagcacctgttcaactcggatctctcagagccgctgatggcaagaatgaagcgtccgttccgttttattatgatatcctaaattcaagattagttgtgttcatgatttatctctctgtgtaatctttttattatctattattgtttacgttgcttttccaagcatttgtcattttttgtgggttttggtgttggtcattatgaaataaattttcattttcattgtcaaaaaaaaac

SEQ ID NO: 1788 - DNA, 1349 bp, Coffea canephora
atgtatcactggggctggtggtttcattgcttcccacattgcccgtcgtttgaaaactgagggacactatattgttgcttctgactggaagaaaaatgagcacatgacagaggacatgttctgtcatgagtttcatcttgttgatctcagggtcatggaaaattgcttgatagtcactaaagcagttgatcatgtcttcaatcttgctgctgatatgggtggaatgggctttattcagtccaatcactctgttattatgtataataacacaatgatcagctttaacatgattgaggctgcaaggattaatggagtaaagaggttcttctatgcttccagtgcttgcatttatcctgaattcaagcaattggacacaaatgtaagcctgaaggaatctgatgcatggcctgcagagcctcaagatgcatatggcctggagaaacttgcaaccgaagagttgtgcaagcactacaacaaagactttggcattgagtgtcgtattggaaggttccataacatatatggtccatttggaacatggaaaggtggcagggaaaaggctccagctgctttctgtagaaaagcaattacttcaacagataagtttgagatgtggggagatggactacaaacacgttcattcactttcatcgatgaatgcgttgaaggtgttcttagactgacaaagtctgacttccgtgagccagtaaatattggtagtgatgaaatggtaagcatgaatgaaatggctgagattgttcttagcttcgaggacaagaagctgcccatccaccacattcctggccctgaaggtgttcgtggtcgtaattccaataacactctaatcaaggaaaaacttggttgggctccgagtatgagactcaaggatgggctgagaattacatacttttggattaaagagcaaattgaaaaggagaaaggtcatggtgtggatttatcaatctatggcacttctaaggtggtgggaacacaggctccggtgcagcttgggtcacttcgcgctgctgatggcaaggagtgaaacacattgttttgctgtttgtgcataataaagtgaatctctttttcacgtactagctacattatagtggcagaatagaggaatgtagcataattatcttctcttcagctgctacttgggcaaattatatgctcctgtgtgtaagggatgccgttttgctcctgcttaggtatctagctatcagttttctcctgcctaggtatctagctctcagtttgtgatgatgtaagccaatatagcagtttgtgcaatgcttgtcatttgctcctgctgttggcatctaatgaagctatccacattcttctgc

SEQ ID NO: 1789 - DNA, 1886 bp, Physcomitrella patens
ggggctgtatatgagcaggtctcggcgattgatctcgcaattcatgaaagctttagttgggtttgtgggaagagattgcagcgcggagtgaatttgaacgtttctcatgttaaaggtggtctagaaggaaaattctgaggttgggtttcgtcggggaggtgtggtaggaggcagacaaacatggcggagagcaatgggacgagcttcggcaactacacggccacgaacttggaccgcgagctgtattggccgaaccagaagctgcgaatctccatcacgggcgccggagggttcattgcgtcgcacatcgcgcgccgattgaagagcgagggccactacatcatcgcctctgactggaagaagaatgaacatatgagtgaggatgcgttctgcgatgagttccacctcgttgacctgcgcgtcatggacaattgcctcaaggtcacccagggcgcgcaccacgtcttcaacctcgcggcagacatgggcggcatgggtttcattcagtccaaccacgccgtgatcatgtacaacaacaccatgatcagctttaacatgctcgaggccgcgcgcatcaatggcgtctctcggtttttctatgcctcaagcgcgtgtatttaccctgagttcaagcagctggagactgatgtgagctctttgaaagaatcggatgcttggcctgctctgccccaggatgcctacggactcgagaaactggccacagaggagttgtgcaagcattacacaaaggacttcggcatggagtgccgaattgggcgtttccacaacatctacggaccctacggaacatggaaggggggacgcgagaaagcgccagctgccttctgccgaaaggccttaacagctacggagtacttcgagatgtggggcgatggcaagcaaacccgatccttcaccttcatcgacgaatgcgtggagggagtcttacggttgacgaagtccgatttccaggagccagtgaacatcggaagcgacgagatggtgagcatgaacgagatggctgagatcgtgctcagcttcgacaacaagaaacttccgatcaagcacattccggggccggaaggtgtgcgggggcgaaactcggacaacacactgattaaggagaagctgggctgggcaccctcgatgcgcctgatggacgggctggctatcacatacaaatggatcaaggagcagatcgacaaggagaaggaattgggcaccgagctcgcgtccaagtatggcacctctatggtggtgggcacgcaggctccagtgcagctcggctccttgcgagctgcggacggcaaggaaagccattaatccatctccgcagcagacctattccatgaattccttcccccctttgaaaactcaaaaacgatgacactgcgcagccattgtcccatggatcgaacagcctgtcgatcaaaagctgggttaagctggcgaattcctcccgtattgcgcacgccttctccagcattcaaattggcggtgtttcttgcccatcgctgcaagcttcactgcgtcgacattgtcggccttcaggaccgattccgctgcctgcgagatctctttatgtcttctgcttcttcttttgtttttgttgtttctcaactcttccttcatcaccgattttgaatcctacgtggtcgaaaagctttcaattcttgcatgctggaccacgcgcgtgccgtcacgccgcaacacacacgcttccgaaaagggcctttttcggtaacatggcttgttattgctgtctactttatgggtgaactcgaattcatatattgtcttcaaggctttatgagatagctgttgttgcaacacgagcgatgaaatgatttgattatcttctgtgaataaatgaacaggtgtttttc

SEQ ID NO: 1790 - DNA, 1445 bp, Festuca arundinacea
  misc_feature (56)..(56): n is a, c, g, or t
  misc_feature (604)..(604): n is a, c, g, or t
  misc_feature (935)..(935): n is a, c, g, or t
  misc_feature (964)..(964): n is a, c, g, or t
  misc_feature (976)..(976): n is a, c, g, or t
  misc_feature (1045)..(1045): n is a, c, g, or t
  misc_feature (1119)..(1119): n is a, c, g, or t
  misc_feature (1123)..(1123): n is a, c, g, or t
  misc_feature (1127)..(1127): n is a, c, g, or t
  misc_feature (1139)..(1140): n is a, c, g, or t
  misc_feature (1142)..(1143): n is a, c, g, or t
  misc_feature (1147)..(1149): n is a, c, g, or t
  misc_feature (1165)..(1165): n is a, c, g, or t
ggcacgaggcctcgtgccgcaagaatcttctttgcccacttccaaatctcgctgcngcggctccgttcagcgacttcaaagaatggcactcaacgacaagcacacatacgcggaattagagaaggagctgtactggccagctgagaagctgcggatctccattacaggagctggcgggttcatcgcctcccaccttgcgaagcgcctgaagagcgaggggcactacatcatcgcctctgactggaagaagaatgagcacatggaagaggatatgttctgccatgagtttcaccttgctgatctcagggtgatggacaactgcctcaaggtgaccactggggttgaccatgttttcaacctagcagctgatatgggagggatgggcttcatccagtccaaccactctgtgatcatgtacaacaacactatgatcagctttaacatgcttgaggctggtagaatcaatggtgtcaaaaggttcttttatgcctcaagtgcttgtatctaccctgaatttaagcagctggaaactgtcgttagtttgaaggaggcagatgcttggcctgcagagcctcaagatgcttatggtttggagaaacttgcnacggaggaactatgcaagcactacacaaaggacttcgacatagagtgccgagttggtcgctttcacaatatttatggtccatatggaacatggaagggtggaagggagaaggcacctgctgctttctgcagaaaggctctaacctccactgaccgctttgagatgtggggagatggtctgcagactagatccttcacattcattgatgaatgtgtggagggtgtcctcaggctaacgaagtctgatttctgtgagcctgtgaacattgggagtgacgaaatggtgagcatgaacgagatggccgagattgtccttggcttcgagaacaagnagctgcccatccaccacatccctggcccngagggtgtccgnggccgtaactctgacaacacactcatcaaggagaagcttggctgggctccaaccatgaggctgaaggangggctgaggatcacatacttctggatcaaggagcagctggagaaggagaagttggaaggcgccgatgtgtcggnctanggancatccaaggtcnncnncacnnnggcgccggtccagctnggatctctccgcgctgcagatggcaaggagtaaaagactcaccctgggaaagacgatgatgccattatatgcccgctggttccagacgtggcatcatctgctgtttcttagttaccgcaccatctccatatctttattcagtttggacttgacctgcaacatgagatgtataccttggttagcctgcgttctgtgttttttttgtaaacgagaaaaactgcttggtacaagatgatgtcaatgttatagacaacaacattaaattatacatgtaaaatga

SEQ ID NO: 1791 - DNA, 1879 bp, Marchantia polymorpha
cacagcgaaaagacttgacattcactggaatcactcattcacgctcacttgcgtcgggacttgcttccgaaggctataaaagcctccgaggtatcagttcccaggctgtgaggcggaaatcgagtcgagcagacagccagagcgagtgagagagtgagtggattttcattcaggctgtgggagaataagagatcgtctgtgtgagattagagaagggggaagggaaggggcaggcgaggaaatatggcttcgaacggagtgaatggaaccaccaatgggctgtacgaggccacaaacttggacaaggagctgtactggcccgagaagaagttgcgaatttctgtgacaggtgccgggggtttcatcgcctcgcacattgccaggaggctcaagagcgaggggcattacgtgattgcttccgattggaagaggaacgagcacatgaccgaggatatgttctgtgatgagttccatctggtcgacctcagggtcatggaaaattgtttgaaggtcacacaggatgtggaacatgtgttcaacttggccgccgacatgggaggcatgggattcattcagtccaaccactcggtcatcatgtacaacaataccatgatcagcttcaacatgctcgaagccgcccgcatcaacggtgttaagagattcttctacgcatcaagcgcatgcatttacccagagtacaagcagttggacgtcgactgtgtcagcctgaaggaagccgacgcctggcccgctgagccacaagatgcctacggtttggaaaagcttgcgaccgaagagctgtgcaagcattacaccaaggacttcggaatgcagtgtagaattggacgattccacaacatctacggcccctacggaacctggaagggaggacgtgagaaagcccctgctgctttctgcagaaaggcgatcacctccaccgagaagttcgaaatgtggggagatggcaagcagaccagatcattcacattcattgacgaatgtgtcgagggtgtcctccgattgaccaagtcagagtactctgagccagtaaacatcggaagtgacgagatggtgagcatgaacgagatggcagagatcgtgctgagcttcgagggtaaggacttgccgatcgaacacatccccggacccgagggagtgaggggaaggaactccgacaacactttgatcaaggagaaattaggatggtctccgacaatgaggctgaaggacggtcttagaatcacatactactggatcttagagcaggtcgagaaggagaaggctaagggtgtgactatggacacgtacgccacatcgaaggtcgtgggcacgcaggcacccgtagcgttgggctccctgcgcgcagccgacggcaaggagtgaggaggagccgtgattttgacactattgccgtatgggtgggggtgccctgagatctgaattggaaggacggaaacgattcctctgtcctctgaggctccgagcgctggatgcatactgcagctactctggttagagattatgagagtcacagtgagctccagcgccggattttccaccgcacacgataacgttgttagtgcttcggctgcacagtacataaatgtgaatggagcctagcggctcataatcgaaagcaacgaggagatctacctggttcctcctctaccttaaaacaaaagccaaccaggtcataacccttgagcgaaagggtttcacataattcggcagctgcactggagatgcaagtaggaaaccaacactcggttataggactatctagaacgtcgggatctagtctccgttcaaatgtgaagatctacaaagttctaatacaagttcttatacatagcagccatatttttgaccaaaaaaaaaa

SEQ ID NO: 1792 - DNA, 1146 bp, Selaginella moellendorffii
gcgcgaggcgtattggccgcaagccaagctccggatttccatctccggcgctggaggattcatcgcctcacacatagcgcggcggctcaaggcggagggacactacgtgatcgcgtccgactggaagaagaacgagcacatgagcgaggacatgttttgccacgaattccatctcgtggatctgcgcgtcatggagaattgcctggcggtgacaaggggcgtggatcacgtcttcgatctcgcggccgacatgggcggaatgggattcatccagtccaatcactctgtgattctcttcaacaacaccatgatcagtttcaacatgctcgaggcctcccggatcaacggagtcaaaagatttttttatgcgtccagtgcatgcatttaccccgagtttaagcagctggagactaacgtgagtttgaaggagtcagatgcatggccggcagagccccaagatgcctatggactggagaagctgtgcactgaagagctgtgcaagcactacaccaaggattttgggatcgagtgccgcattggacgattccacaacatctatggaccctttgggacctggaaaggtggacgagagaaggctccggctgcgttttgtcgaaaggccctgacttccaccgattcgtttgagatgtggggcgatggaatgcagacgcgatcgttcaccttcatcgacgagtgcgtggagggcgtcttgcgactcacaaagtccgatttccgggaaccgctcaacattggaagcgacgagatggtgagcatgaacgagatggcagagatcatactaggatttgagaacaagcaaatcccgatccgtcatatacctgggccggagggagtccgcgggagaaactcggagaacagtttgatcaaggagaagctcggatgggctccctcgatgcgattgaaagatgggctgcgtatcacttacttgtggattaaggagcagcttgacaaggagattggcgagggatctcaagacttacttacgggttacagctcctccaaggttgtgggaactcaagctccagtccaacttgggtctctcaggaaggccgatggaaaggagtaaattcataacatttttggagctatgctccgagtatcaaaaatttcaatatagtttcgtttttt

SEQ ID NO: 1793 - DNA, 977 bp, Persea americana
cactggtgctggaggttcattgcctcacacattgccaggcgtttgaagagcgaggggcactacatcatcgcttccgactggaagaagaatgagcacatgactgaggacatgttctgtaatgagttccatctggtcgatctgcgggtcatggataattgcttgaaagttacaaatggagtggatcatgttttcaatctcgctgcggatatgggaggaatgggttttatccagtccaaccattcagttatcatgtataacaacactatgattagtttcaacatgcttgaagccgcgaggattaatggggtgaagagattcttctatgcgtctagtgcttgcatctacccagagttcaaacagttggaaactaatgtgagcttgaaggagtctgatgcatggccagcagagcctcaagatgcttatggtctggagaagcttgcaacagaagagttgtgcaagcactacaccaaagactttggaattgaatgtcggattgggcggtttcataacatttatggtccctttggaacatggaaaggtgggagagagaaggcccctgctgctttctgcagaaaggctattacatccactgataagtttgagatgtggggagatgggctgcaaactcgatccttcaccttcattgatgaatgcgtagaaggtgtcctgagattgacaaagtcagactttcgcgagccagtgaacataggaagtgatgaaatggtgagcatgaacgaaatggcagaaatagtccttagttttgaggacatgaagctccctattcatcacattcctggcccagagggtgtgcgtggtcgcaactcagacaacactctgataaaagagaagctgggatgggcgcccacaatgagattgaaagatggcttgaggatcacatacttttggatcaaggagcagatagagaaagaaaaatctcagggtgttgacctgtcagtttatgggtcatccaaagtagt

SEQ ID NO: 1794 - DNA, 977 bp, Persea americana
  misc_feature (879)..(879): n is a, c, g, or t
cactggtgctggaggttcattgcctcacacattgccaggcgtttgaagagcgaggggcactacatcatcgcttccgactggaagaagaatgagcacatgactgaggacatgttctgtaatgagttccatctggtcgatctgcgggtcatggataattgcttgaaagttacaaatggagtggatcatgttttcaatctcgctgcggatatgggaggaatgggttttatccagtccaaccattcagttatcatgtataacaacactatgattagtttcaacatgcttgaagccgcgaggattaatggggtgaagagattcttctatgcgtctagtgcttgcatctacccagagttcaaacagttggaaactaatgtgagcttgaaggagtctgatgcatggccagcagagcctcaagatgcttatggtctggagaagcttgcaacagaagagttgtgcaagcactacaccaaagactttggaattgaatgtcggattgggcggtttcataacatttatggtccctttggaacatggaaaggtgggagagagaaggcccctgctgctttctgcagaaaggctattacatccactgataagtttgagatgtggggagatgggctgcaaactcgatccttcaccttcattgatgaatgcgtagaaggtgtcctgagattgacaaagtcagactttcgcgagccagtgaacataggaagtgatgaaatggtgagcatgaacgaaatggcagaaatagtccttagttttgaggacatgaagctccctattcatcacattcctggcccagagggtgtgcgtggtcgcaactcagacaacactctgataaaagagaagctgggatgggcgcccacaatgagattgaangatggcttgaggatcacatacttttggatcaaggagcagatagagaaagaaaaatctcagggtgttgacctgtcagtttatgggtcatccaaagtagt

SEQ ID NO: 1795 - DNA, 1915 bp, Pennisetum glaucum
ggccgttgctgcggactacgaggttggttttacacggggcagagagagagagagagagagagagagagagagagagagagccgaagcccgcgtcgttccctgcagtttctccccaccccttcttccctgcctcggcttgcgccttcgaccctgctgaaacttccgacctcagaaatcgaaaggggtctgtggagagttttttagcagcagtgcaatggaggtatttggcaaatctgtgattgctgagcccagcaatgtgatttttttgtccgccattcttaacacagaagggtcaaaccctagtcacaagtgtgacaaaaggtgccagaatgagcacgtttttggcaacatgtaccgttgcaaactgactggaaccactcacatctgcgacaaaaactgtaaccagaggatcctctatgataaccataactcgctctgccgagtgagtgggcagttgttcccgctctctccactggagcagcaggcagtgaggggcatccgcaggaagcatgaagttgacagcaatgaaggttgctcctttaagcgcaggcgtggtgcacagctgcatccttcccctttcgagaggtcctactctgctgtgtctccaatcccgagccaggttggagatggcatggacctgagctagagctaatgagacttacttttcatcggccagccacctaattccattctctctatccacatccccttcaatcacaggatgggcctataagagcttccttctttgtagacttatgaagggatgagactccttagatgcactgaataaatgtctatgtagtatgaattcagtttcatggaaccttgttgtaactcgtaaactttggttgaacttcctattctgaattagtactttcagacaatcatccgcggcttctatttttacccccttcctatttagttattttgtttatttttttacttcactagctattttttctaagctattttaatatttgattgtctgagcgctttaatataattgaactgtgtaaatttgttcggcaatgtaatccctgaaggatttcttggttctgtaatccagaggattgcaggaacccgactgactttgctgactgaaatttttgtactgttgttactagtgtttgcttgacaggttcctgatcaagcttgaattatttacggtttgttcccctatatattgattctatctgttatttaactctttttttacaggttatgtttctaacacctgttgtttccttcctgttctgtcttgttttgtctttaccgttaactttattgtgtgcagggccatccaggtgctaatcattttgggagatgtttttatctcttttatataattctataatttatattgctaacttaattttgtttatgaattaacttttgtcttttgtttttgcaggtgaactacttatctctgattcctttcctttcatcactggcaaattggggcttttcaagttaccaggggctcttctcattccttgcagtggagacttaagcttcagctgagcagcatgctttgcagaacataaatcaatgccagagaagtttggtgctattactttgctaaacagcttgagggacaccataactacagtgtccaaataggcaagaagatgctgcagtttacaaacttaattcggtagcgcagtttgaagagcagctaccatctgcagtctgaagaaatctcaccagcatctcaaaggattctggggagaatccattcaataaacttgctttcagcccaagcatgccttgttatgattgtacttaatacaagtgttataatagtgggtgctttccctccgcatgaagctttttggtgctgcccccaccaacccatttgtctgtctatatgaacaaattttgttggctaatggaattgcccatttgcatttcatgt

SEQ ID NO: 1796 - DNA, 1904 bp, Panicum virgatum
ggtcccggttgttgctgctgactgcgaggttcctgttccacggggcggagagagagagagagagagagagagggcgaagccctcttccgcgtcgtcccctgctgtttctctccacccttccctgcctcggcttgagcctccgaacttgccgaaacttctgacctcagaaaccgaaaggggtctgtgagggaaatttttgcagcagtgcaatggaggtatttggcaaatctgtgattgctgagcccagcaatgtgattttcttgtctgccattcttaacacagaagggtcaaaccctagtcacaagtgtgacaagaggtgccagaatgagcacgtttttggaaacatgttccgttgcaaactgactggaaccactcacatctgcgacaaaaactgtaaccagaggatcctctatgataaccacaactcgctctgtcgagtgagtgggcagttgttcccgctctctccactcgagcagcaggcagtgaggggtatccgcaggaagcatgaagttgacagcaatgaaggttgctcctttaagcgcaggcgtggtgcgcagctgcacccttcccctttcgagaggtcctactctgctgtgtctccaatccccagccaggttggagatggcatggacctgagctagagctaatgagacttacttttcttcggccagccatctaatgccgttctttctacccccttttcccttcgatcacaagatgggactataagagcttccttctttgtagacctgtgaagggatatgagactccttagaccactgaataaatgtctatgtagtatgaattcagtttcatggaaccttgttgtaactcgtaaactttggttgaactgcctattcggaatcagtagtactttcagataaacgatcgccgcttctcttttccccactcctatttagttattttgttttttttactttacgttctgttatttttcttttctatgttcttctaatattgattgcctgatgcgctataatataatcaagctgtgtaaatttgttggacaatgtaaatctctgaggattctttggttctgcaatccaggcagcaggaacctgactgactttgctgactgaaatttctgtacagttgtgactagtgttttgcttgacaggttcctgatcaagctcatattgtttacggtttgttctcatatagcttgattctatctgttaattaactcttttttacaggttatctttctaacacttgttgtttccctcctgttctcttttgttttgtcgttatacttaacttttgttgtatgcaggaccatccaggtgctaattattttcggaaatgttttgatattttaaataatttatatttatataatgctaacttaattttatttgttaattaacttctctcttttgtttttgcaggtaaactgctaatccttgattcatttcctatcgtcagtggcaagaaactaatcaaggaggctcttctcattgtttgcagtggagggctgttaagcttcagctgagcagcatgctttgcagaacataaatcggtgatgagaagattggtactactactttgctagataagcttgagagacagataactacaacgcccaaattggcaaaaatactgcactttaccaacttattgtttggtaacgcagtttgaagagcagctaccatctgcagtttgaagaaatctcactgcctctcggtggcttcaggagcacccatcccacaatcttgctttcaccccaagcatgccttgttatgattttacttaatgtaactgttataatagtgggtgcttttccttttcatgaagtttcgttggtacccacaccccagcctttgtatgtctatatgaacaaatattcttgactaatgcctaatggaactgctaatttgtcattt

SEQ ID NO: 1797 - DNA, 928 bp, Panicum virgatum
ataaatttgccatccttgtgttattggatgattagaagaaaaaaaaaaaaaagtgaggttcgtgtttcacttccacggggcgagagagagagagagagagggcgaagccctcttccgtgtcgtctcgtcccctgctgtttctccccacccttccctgcctcggcttgcgcctccgaccttgccgaaacttccaccctcagaaccgaaaggggtctgtgaggagattttttgcagcagtgcaatggaggtatttggcaaatctgtgattgctgagcccagcaatgtgattttcttgtctgccattcttaacacagaagggtcaaaccctagtcacaagtgtgacaagaggtgccagaatgagcacgtttttggaaacatgttccgttgcaaactgactggaaccactcacatctgcgacaaaaactgcaaccagaggatcctctatgataaccacaactcgctctgtcgggtgagtgggcagttgttcccgctctctccactcgagcagcaggcagtgaggggtatccgcaggaagcatgaagttgacagcaatgaaggttgctcctttaagcgcaggcgtggtgcgcagctgcacccttcccctttcgagaggtcctactctgctgtgtctccaatccccagccaggttggagatggcatggacctgagctagagctaatgagacttacttttcttcggccagccttctaattccgttctttctacccccttttcccttcgatcacaagatgggactataagagcttccttctttgtagacttttgaagggatatgagactccttagaccactgaataaatgtctatgtagtgtcaattcagtttcatggaaccttgttgtaactcgtaaactttggttgaactgcctattcggaatcagtagtactttcagataatcattcgctgct

SEQ ID NO: 1798 - DNA, 927 bp, Saccharum officinarum
ctggctgctggggctgcgtgggtcgcgtttcacgggcgtagagagagagcgaagagggcgagggagagaagggggtcaagccctacgcggctacgcgtcgtctcctgctgtttcttcccatccctttcctgcctgggcttccaccttcaaccttgctgaaagttctgacctcagaaactgaaagaggcttgtgaagagttttcttgcggcagtgcaatggaggtatttggcaaatctgtgattgctgagcccagcaatgtgattttcttgtccgcaatccttaacacagaagggtcaaaccctagtcacaagtgtgacaagaggtgccagaacgagcacatttttgggaacatgtaccgttgcaaactgactggaaccactcacatctgcgacaaaaactgtaaccagaggatcctctatgacaaccataactcactttgccgagtgagtgggcagttttttccgctctctccactggagcagcaagcagtgaggggtatccgcaggaagcatgaagtggacagcaatgaaggctgctcctttaagcgcaggcgtggtgcacagctgcatccttcccccttcgagaggtcctactctgctgtgtctccaatcccaagccaggttggagatggcatggacctgagctagagctaatgagacttccttttcttcggccagccacctaattccgttctgtctaccccttttcccttcgattacaggatggaactataagagcttccttctttgtagacttatatgaagggatatgagactccttagatgcaccgaataaatgtcgatgtagtatttattctgttcatggaaccttggttgtaaacttgtgaactttgattgagcgcctattctgatttagtggtactttcagacaatcattcactgctaaaaaaaccaaaaccaacaccc

SEQ ID NO: 1799 - DNA, 1052 bp, Cenchrus ciliaris
  misc_feature (63)..(64): n is a, c, g, or t
ggttcgtgttacacggggcggagagagagagagagagagaagagggggcgaagagagagagannagagggggcgaagcccgttccctgcagtttatccccatcccttccctgcctcgtcttgcgccttcgaccttgctgaaacttctgacctcagaaatcgaaaggggtctgtgaagagatttttagcggcagtgcaatggaggtatttggcaaatctgtgattgctgagcccagcaatgtgattttcttgtccgccattcttaacacagaagggtcaaaccctagtcacaagtgtgacaaaaggtgccagactgagcacgtatttggcaacatgtaccattgcaaactgactggaaccactcacatctgcgacaaaaactgtaaccagaggattctctatgataaccataactcgctctgccgagtgagtgggcagctgttcccgctctctccactggagcagcaggcagtgaggggtatccgcaggaagcatgaagtcgacagcaatgaaggttgctcctttaagcgcaggcgtggtgctcagctgcatccctccccttttgagaggtcctacactgctgcgtctccaatcccaagccaggttggagatggcatggacctgagctagagctaatgagacttatttatcttcggccagccacctaattccgttctttctaccccctccccttcaatcacaggatgggactataagagcttccttctttgtaggcttatgaagggatatgagactccttagatgcactgaataaatgtctatgtagtatgaattcagtttcatggaaccttattgtaactcgtaaactttggttgaactgcctattctgaattagtagtactttcagacaatcgttcgctgcttctatttgttacccccttcctatttagttattttgtttgcttttttactttacattcagctgttttctatgctatctaatatttgattgtctgagcgcttttaacatagttgagctgtgtaaatttgttcgggcaatgtaaatccttgaaggatttcttggttctgtaa

SEQ ID NO: 1800 - DNA, 2256 bp, Sorghum bicolor
gttgttgctagctgcgtgggtcgcgtttcacgggcgtagagagagagagagagaaagcgaagaggaagggagggagggagagagagaagggggggccaagccctacgcgtcgtctcctgcggtttcttcccacccctttcctgcctcggcttgcgccttcaacctttgctgaaaattctgtcctcagaaagtgaaaggggcctgtgaagagttttcttgcggcagtgcaatggaggtatttggcaaatctgtgattgctgagcccagcaatgtgattttcttgtctgcaatccttaacacagaagggtcaaaccctagtcacaagtgtgacaagaggtgccagaacgagcacatttttgggaacatgtaccgttgcaaactcactggaaccactcacatctgcgacaaaaactgtaaccagaggatcctctatgacaaccataactcgctctgccgagtgagtggacagttttttccgctctctccattggagcagcaagcagtgaggggtatccgcaggaagcatgaagtggacagcaatgaaggctgttcctttaagcgcaggcgtggtgcacagctgcatccttcccccttcgagaggtcctactctgctgtgtctccaatcccgagccaggttggagatggcatggacctgagctagagttaatgagacttccttttcttcggccagccacctaattccgttctatctaccccctttcccttcgattacaggatggaactataagagcttccttctttgtagacttatatgaagggatatgagactccttagatgcaccgaataaatgtctatgtagtatctattctgtttcatgggaccttgttgtaactcgtgaactttgattgagcgcctattctgatttagtggtactttgatacaatcattcgctgtttcactttttttttcacacttccgatttagttattttgtgtgttttactttatgttcaactaattttctttctaatttcgattcttgaatgcgatttaatataattgagtggtgtacatgtgtctgtcaatgtaaatatgtgaaggattctttggtcctgtaatccaggcacagggaactgacttgcctttgctgactgaagtttttgtacagctgttactagtgttttgcttgacaagttcctaatcaagcttgaatcatttacggtttgttctcatatagctcaattctatctgttgcttaactcttttttacaggttatgtttctaacgcttaatgttttcctcatgttcttttttgtcttgtttttccccttaacatttgttgtatgcaggaccatccaggttctaatcgtttttgggaaatgttttgttctttttgtataattatattgctcacttaatttcatttgttaattaatttgctttgttttgttttgttttgttttgcaggtgaacatcactgattctattttcatcgtcggatggcaagaaactaatcatggagtcccttctcattccttgctgtggagaactgtttagctgcagctgagcagcatgctttccaggtccatgtcagcatgtcgggaagttagtttcttttgctgtcatgccacaacctctgttactcgaaatagccataaatcgaggcagtctctttgctcatgtaaaacagatgatgttcttgctctatagactgagtgaggagagaacataaattggtggaagagaagtttgatgctaccactttgctataaggactgagccagacacaataacatcaaactgagataccgcagtttacaactttttcaatatggcagattgaagagcagcaagatcagcttccatgaagctggcaagctgcagtttgaacagcttccacctgcagtttgaagaaatctttctaaggtcttggactaaaggcgaatccttctgtgtcaatcttgccttcaccccaagcatgctggataccttgtaatgattgtagtacttgacaactgttaccaaagtagtggatgcttttctttcgcatgaagttttgttggtaccccacctcgtctgtctgtaagaaaaaatgttatgcatcctggtccatttcttctatgcatcctgagaaaatggtcagtataatctagggctttcttttgtcatgttgatttttgtatgtcctaagagcatctctcctatatacttaaaaagtactagcattctaggagatgaaagtggtacagcagatctcctatctcatcatctatacctataattttcaagagctct

SEQ ID NO: 1801 - DNA, 927 bp, Sorghum bicolor
gttgttgctagctgcgtgggtcgcgtttcacgggcgtagagagagagagagagaaagcgaagaggaagggagggagggagagagagaagggggggccaagccctacgcgtcgtctcctgcggtttcttcccacccctttcctgcctcggcttgcgccttcaacctttgctgaaaattctgtcctcagaaagtgaaaggggcctgtgaagagttttcttgcggcagtgcaatggaggtatttggcaaatctgtgattgctgagcccagcaatgtgattttcttgtctgcaatccttaacacagaagggtcaaaccctagtcacaagtgtgacaagaggtgccagaacgagcacatttttgggaacatgtaccgttgcaaactcactggaaccactcacatctgcgacaaaaactgtaaccagaggatcctctatgacaaccataactcgctctgccgagtgagtggacagttttttccgctctctccattggagcagcaagcagtgaggggtatccgcaggaagcatgaagtggacagcaatgaaggctgttcctttaagcgcaggcgtggtgcacagctgcatccttcccccttcgagaggtcctactctgctgtgtctccaatcccgagccaggttggagatggcatggacctgagctagagttaatgagacttccttttcttcggccagccacctaattccgttctatctaccccctttcccttcgattacaggatggaactataagagcttccttctttgtagacttatatgaagggatatgagactccttagatgcaccgaataaatgtctatgtagtatctattctgtttcatgggaccttgttgtaactcgtgaactttgattgagcgcctattctgatttagtggtactttgatacaatcattcgctgtttcactttttt

SEQ ID NO: 1802 - DNA, 2063 bp, Saccharum officinarum
  misc_feature (2047)..(2047): n is a, c, g, or t
ctgcgtgggtcgcgtttcacgggcgtagagagagagcgaagagggcgagggagagaagggggtcaagccctacgcggctacgcgtcgtctcctgctgtttcttcccatccctttcctgcctgggcttccaccttcaaccttgctgaaagttctgacctcagaaactgaaaggggcttgtgaagagttttcttgcggcagtgcaatggaggtatttggcaaatctgtgattgctgagcccagcaatgtgattttcttgtctgcaatccttaacacagaagggtcaaaccctagtcacaagtgtgacaagaggtgccagaacgagcacatttttgggaacatgtaccgttgcaaactgactggaaccactcacatctgcgacaaaaactgtaaccagaggatcctctatgacaaccataactcactttgccgagtgagtgggcagttttttccgctctctccactggagcagcaagcagtgaggggtatccgcaggaagcatgaagtggacagcaatgaaggctgctcctttaagcgcaggcgtggtgcacagctgcatccttcccccttcgagaggtcctactctgctgtgtctccaatcccaagccaggttggagatggcatggacctgagctagagctaatgagacttccttttcttcggccagccacctaattccgttctgtctaccccttttcccttcgattacaggatggaactataagagcttccttctttgtagacttatatgaagggatatgagactccttagatgcaccgaataaatgtcgatgtagtatctattctgttcatggaaccttggttgtaaacttgtgaactttgattgagcgcctattctgatttagtggtactttcagacaatcattcgctgcttctctctttttttttcacacttctgatttagttatcttgtgtgttttactttatgttcaactaatttcccttacttctaattttgattctttgatgcaatttaatataattaagcggtgtacatttgtctgtcaatgtaaatatgtgaaggattctatggtcctgtaatccaggcgcagggaactgacttgcctttgctgactgaagtttttgtacagctgttactagtgttttgcttgacaagttcctaatcaagcttgaatcatttacggtttgttctcatatagctcaattctatctgttgcttaacccttttttacaggatatgtttctaacgcttaatgttttcctcatgttcttttttgtcttgtttttccccttaacatttgttgtatgcaggaccatccaggttctaatcgtttttgggaaatgttttgttctttttgtataattatattgctaacttaatttcatttgttaattactttgctttgttttgtttttgcaggtgaacatgctgattctattttcattgtcgggtggcaagaaactaaccaaggagtctcttctcattccttgctgtggaggactgtttagctgcagctgagcaacatgctttccaggtccatgtcagcatgcgggaagttagtttcttttgctgtcatgccacaacctctgttactggaaataataagccaaatcaaggcagtctctttgctcatgtaaaacacatggatgtccttgctctataggctgagtgaggagagaacataaattgttggaagagaagtttgatgctaacactttacgagaaggaccgagccagagtgccggacacaataacatcaaactgagatactgatgctgcagtttaccaactttttcgatagggcagattgaagagcagcaagatcagcttccatctgcagtttgaagaaatctttttaaggtctcggactaaaggagaatcctttcggcaatcttgccttcaccccaagcatactgcgtaccatgtaatgattgtagtacttgacaactgttaccaaagtactagggggtgtttggtttgaggtgttaaagtttaataaacgctgtagcactttcgtcttatttgacaaaaagttttcaatcttggactaattaagcttaatagantcgtctcgtaaaaaaa

SEQ ID NO: 1803 - DNA, 850 bp, Triticum aestivum
gactccgcgagaggttcctgttccctggcggagagagagagagagagagagagagaggggcagggagggagaggaaggagagaccgaaggccgcggtgtttttacctcgtctcctcctccgccttcgagctctactgaaactccgatcttagaaaccaagaaaagggggtctgtgaagaggtttctcgcggcagaacaatggaggtacttggcaaatctgtgattgctgagcccagcaatgtgattttcttgtccactattctgaacacagaaggggaaatccccagtcacaagtgtgacaagaggtgccagaatgagcacatctttggaaacatgtaccgctgcaaactgactggaatgacgcacatttgtgacaaaaactgtaaccagaggatcctctatgacaaccacaactcgctttgccgagtgagtgggcagttgttcccgctctcaccactggagctgacggcagtgagggggattcggaggaagcatgaagccgacagcaatgaagggtgctccttcaagcgcaggcgtggtgcacagctccatccttccccttttgagaggtcctactccgccgtgtctccgataccgagccaagctggagatggcatggacctgagctagagctaacgagacttccatcttttctttccccggctaccttatgcggatgtctactccatttccccttctttgacaggatggaaactataagagcttccttctttatagacttatgaagggatatgagactccttagaggcactaaataatgtctatgtagtatcaattcagtttcatgggaccttgttgtaatcgtaacttcgattgaacagcctattct

SEQ ID NO: 1804 - DNA, 1978 bp, Triticum aestivum
gcaattgactccgcgagaggttcctgttccctggcggagagagagaggcagggagggagaggaaggagagaccgaaggccgcggtgtttttaccccgtctcttcctccgccttcgagctttactgaaactccgatctcagaaaccaagaaaaggggatctgtgaagaggtttctcgcggcagaacaatggaggtacttggcaaatctgtgattgctgagcccagcaatgtgattttcttgtccactattctgaacacagaaggggaaatccccagtcacaagtgtgacaagaggtgccagaatgagcacatctttggaaacatgtaccgctgtaaactgactggaatgacacatatttgtgacaaaaactgtaaccagaggatcctctatgacaaccacaactcgctttgccgagtgagtgggcagttgttcccgctctcgccactggagctgcaggcagtgagggggattcggaggaagcatgaagctgacagccatgaagggtgctccttcaagcgcaggcgtggtgcacagctgcatccttccccttttgagaggtcctactccgccgtgtctccgataccgagccaagctggagatggcatggacctgagctagagctaacgagacttccatcttttcttgccccggctaccttatgcggatgtctactccatttccccttctttgacacgatggaaactataagagcttccttctttatagacttatgaagggatatgagactccttagaggcactaaataatgtctatgtagtatcaattcagtttcatgggaccttgttgtaatcgtaacttcgattgaacagcctattctgaattacttagtgttaatcatttgctattaccgtttagattatttctctatagcgcggtgctcttgtttgctccaacttttcattattgtagctcctttctttcttatgctctcttgaggttcattatctgctgcatttcagtgcattcaagctgtgcaaatttgcttgacatagttggtgatgtaaatccgttgcagattacattatcctatttcttggggcgtgaacttactaactaaatttccttcataattagtgctttgcatggcaggttgctgatcaggtctcagctatttatggtttgctctcatatagcttatttgtttcagttaaatgttttcttctttgcaggttatgtttctaacatctatattgcttcctcctgttttgttttgacttgcttctttccttgacccctttctgttttgcagggtgatccaggtgctaacttttttgaaaatattttggtctttatgtaatgttccctttgttaagttgatttcgtttgttctgagtgttcacttgtcttttatgcttgtgcaggtgaattggtgttcgttctttcgctcttcttggtccatgggaggcaggagctatggaagatcattgaaatcctttgcagcagtggaatagcaatgtaccatcaaagtcttcggctgcagaatgcttttcagtgcattgtgcacaacagaaatcatcagcagaagaggggtttggaattattcaaacaagagccagcctgaagccactgaaacttcaaaactcatactggagaagagcctgcaggagcttgatatcgcattgctgctgcggtgggagaagtctactccagtatctgccatctgcgatccaaagcaaaactctctgtagatctagttgagtatccaccatctgcgatccaaaccaagatagatctctgaagatatagttgagtatccaccatctgcgatccaaaccaagatgtctgaagatctcaacagattttagtgtccctaatccaacaagcttgttctcaacgcaaacttatactgccgtggaatttcctttttccattctaaaagggattaggtcatgattgttcattgtaaggcaattatatccagagtaaagggaactttccttctgcctcaaaaaaaaaa

SEQ ID NO: 1805 - DNA, 830 bp, Hordeum vulgare
attgactccacgagaggttcccgttccctggcggagagagagagagagggagagggagaggaaggagagaccgaaggccgcccgtgttcttaccccgtctcctcctccgccttcggcctttactgaaactcccatctcagaaaccaagaaaagggggtctgtgaagaggtgtcttgcggcagaacaatggaggtacttggcaaatctgtgattgctgagcccagcaatgtgattttcttgtccactattcttaacacagaagggcaagtccccagtcacaagtgtgacaagaggtgccagaatgagcacatctttggaaacatgtaccgctgcaaactgactggattgacacacatctgtgacaaaaactgtaaccagaggatcctctatgacaaccacaactcgctctgccgagtgagtgggcagttgttcccgctctcgccactggagctgcaggctgtgagggggattcggaggaagcatgaagctgacagccatgaagggtgctcctttaagcgcaggcgtggtgcacagcttcatccttccccttttgagaggtcctactccgccgtgtctccgataccgagccaagctggagatggcatggacctgagctagagctaacgagacttccatcttttcttttcccggctaccttatgcggatctctactccatttccccttctttgacaggatggaaactataagagcttccttctttgtagacttatgaagggatatgagactcctttagaggcactaaataatgtctatgtagtataaattcagtttcatgggaccttgttgtaatcgtaacttcgattgaaca

SEQ ID NO: 1806 - DNA, 843 bp, Hordeum vulgare
attgactccacgagaggttcccgttccctggcggagagagagagagagggagagggagaggaaggagagaccgaaggccgcccgtgttcttaccccgtctcctcttccgccttcggcctttactgaaactcccatctcagaaaccaagaaaagggggtctgtgaagaggtgtcttgcggcagaacaatggaggtacttggcaaatctgtgattgctgagcccagcaatgtgattttcttgtccactattcttaacacagaagggcaagtccccagtcacaagtgtgacaagaggtgccagaatgagcacatctttggaaacatgtaccgctgcaaactgactggattgacacacatctgtgacaaaaactgtaaccagaggatcctctatgacaaccacaactcgctctgccgagtgagtgggcagttgttcccgctctcgccactggagctgcaggctgtgagggggattcggaggaagcatgaagctgacagccatgaagggtgctcctttaagcgcaggcgtggtgcacagcttcatccttccccttttgagaggtcctactccgccgtgtctccgataccgagccaagctggagatggcatggacctgagctagagctaacgagacttccatcttttcttttcccggctaccttatgcggatctctactccatttccccttctttgacaggatggaaactataagagcttccttctttgtagacttatgaagggatatgagactcctttagaggcactaaataatgtctatgtagtataaattcagtttcatgggaccttgttgtaatcgtaacttcgattgaacagcctattctgaat

SEQ ID NO: 1807 - DNA, 2042 bp, Brachypodium distachyon
acttcgtccgggcgttgctgctgattctgcgagaggttcgtgtgtctcgggtccacgcgagggggaagggggagagaggagggagaggagaggacgaagctctccgtgtttctgcgattctgccccgcccttcctccgccttcgagctttgctgaaacaccgatcccaggaaccaagaaaaaagggtccgtgaacaggtttcttgcggcagaacaatggaggtacttggcaaatctgtgattgctgagcccagcaatgtgattttcatgtccactattcttaacacagaagggccaatccccagtcacaagtgtgacaagaggtgccagaatgagcacatctttggaaacatgtaccgttgcaaactgactggaatgacacacatttgtgacaaaaactgtaaccagaggatcctctacgacaaccacagctcgctctgccgagtgagcgggcagttgttcgcactctcgccactggagttgcaggcagtgagggggatccgtaggaagcatgaagttgacagccatgaagggtgctcttcttttaagcgcaggcgtggtgcacagctgcatccttccccttttgagagatcctactccgtcgcatctccgataccgagccaagctggagatggcatggacctgagctagagctaacgagacctccatcttatcttcccccagccaccctatgcggatttttctactccattttcccttctttaacaggatggaactataagggcttccttctttgtagacttatgaagggatatgagactccttagaggcaataaataaatgtctatgtagtagcagttcattttcgtggaaccttgttgtaatcgtaacttcgattgaacagcctattctaattacgtagtattttgagataatcgtctgctattaccgtttagatcatttacctctggtgcagtaatcttgtttgctctaacattatattattgttctcgtttctttcttatgttctcttaatgttaatcatctaactcatttttgtgcggtcgagctatgcaaatttgcttgacgtggtcgatgatgtatatctgttgaacattatttgatccaattttttgcggtgtgaacttactaactgaatttcctgcatagcgaatgcttttcatggcaggggtgctgatgaagtctgggttatttatggtttgttcacataagcttaattgtttctatgaaatgctttctgttttgcaggttttgcttaaatttacttattaccacttatattgcttcttcctgttttctatttatttgcttcttgcactcacctttttctgttttgcagggccatccaggtgctaactttttctgtaaatgtttttgtttttcgtataattttccctttgttaagttgttttattttgttcatacaagtgttcacttgtttcttttgcttgtgcaggtgaccttctggtctgctgttcttttcaaaccgtgggtcatggaggcaagagctactcaagaagattattgaagtcgtttgcagcagagttgtatcggcgaggtaccctcgaagtgttctgcctcaccatgcttttcagaacaaaaatcagcagcaaagaggcttgaaactattcaaacaagggccagtggcactgaaatttcgaaacttatactggagaagacccaacagcagctaccgactttcgacattgcattgctgctgcgtttggagaggcagtaaataggcttgaaactattcaaacaagggccagtctgaagccactgaaacttcgaaactcttactggagaaaaccagcagcggccccactcttgatttgcattgttttggaaaaattgactcgagaaaccaccatctgggatttgtggaaacctctctgaatgtctctaataagagatttgtttgtcgccaatccgacaagcttgctttgtacacaaacttatcttgttatgaagtttcatttcaccctgtaaaagagcttgggccatgattgtactcctgcttcttgaggaaataatatccagagtaaagttttctcttgcgtc

SEQ ID NO: 1808 - DNA, 1709 bp, Brachypodium distachyon
gcgttgctgctgattctgcgagaggttcgtgtgtctcgggtccacgcgagggggaagggggagagaggagggagaggagaggacgaagctctccgtgtttctgcgattctgccccgcccttcctccgccttcgagctttgctgaaacaccgatcccaggaaccaagaaaaaagggtccgtgaacaggtttcttgcggcagaacaatggaggtacttggcaaatctgtgattgctgagcccagcaatgtgattttcatgtccactattcttaacacagaagggccaatccccagtcacaagtgtgacaagaggtgccagaatgagcacatctttggaaacatgtaccgttgcaaactgactggaatgacacacatttgtgacaaaaactgtaaccagaggatcctctacgacaaccacagctcgctctgccgagtgagcgggcagttgttcgcactctcgccactggagttgcaggcagtgagggggatccgtaggaagcatgaagttgacagccatgaagggtgctcttcttttaagcgcaggcgtggtgcacagctgcatccttccccttttgagagatcctactccgtcgcatctccgataccgagccaagctggagatggcatggacctgagctagagctaacgagacctccatcttatcttcccccagccaccctatgcggatttttctactccattttcccttctttaacaggatggaactataagggcttccttctttgtagacttatgaagggatatgagactccttagaggcaataaataaatgtctatgtagtagcagttcattttcgtggaaccttgttgtaatcgtaacttcgattgaacagcctattctaattacgtagtattttgagataatcgtctgctattaccgtttagatcatttacctctggtgcagtaatcttgtttgctctaacattatattattgttctcgtttctttcttatgttctcttaatgttaatcatctaactcatttttgtgcggtcgagctatgcaaatttgcttgacgtggtcgatgatgtatatctgttgaacattatttgatccaattttttgcggtgtgaacttactaactgaatttcctgcatagcgaatgcttttcatggcaggggtgctgatgaagtctgggttatttatggtttgttcacataagcttaattgtttctatgaaatgctttctgttttgcaggttttgcttaaatttacttattaccacttatattgcttcttcctgttttctatttatttgcttcttgcactcacctttttctgttttgcagggccatccaggtgctaactttttctgtaaatgtttttgtttttcgtataattttccctttgttaagttgttttattttgttcatacaagtgttcacttgtttcttttgcttgtgcaggtgaccttctggtctgctgttcttttcaaaccgtgggtcatggaggcaagagctactcaagaagattattgaagtcgtttgcagcagagttgtatcggcgaggtaccctcgaagtgttctgcctcaccatgcttttcagaacaaaaatcagcagcaaagaggcttgaaactattcaaacaagggccagtggcactgaaatttcgaaacttatactggagaagacccaacagcagctaccgactttcgacattgcattgctgctgcgtttggagaggcagtaaa

SEQ ID NO: 1809 - DNA, 838 bp, Eragrostis curvula
  misc_feature (17)..(18): n is a, c, g, or t
  misc_feature (34)..(34): n is a, c, g, or t
  misc_feature (38)..(38): n is a, c, g, or t
  misc_feature (43)..(43): n is a, c, g, or t
  misc_feature (45)..(45): n is a, c, g, or t
  misc_feature (101)..(101): n is a, c, g, or t
  misc_feature (300)..(300): n is a, c, g, or t
  misc_feature (328)..(328): n is a, c, g, or t
  misc_feature (341)..(342): n is a, c, g, or t
agggagaaaaggagggnntgtgtggctcttcggngtgngaggntnctaggcggaagaaggaaaaagagagaaagagaagagggcggacgaagtctccgcgnccctccctgcttcgtttacccatccctttcgtgtctccccttcgaccttcctgaaacttctgattatcacaaactgaggaaagggtctgtgcgaggtttcaagcagcagtacgatggaggtatttggcaaatctgtgattgctgagcccagcaatgtgattttcttgtccaccattcttaacacagaggggtcaaaccntagtcacaagtgtgacaagaggtgccanaatgagcatgttnntggaaacatgtaccgttgcaaactgactggaatcactcacatctgcgacaaaaactgtaaccagaggatcctctacgacaaccataactcactctgcagagtgagtggccagctgttcccgctctcaccagtggaacagcaggcagtgagggggatccgaaggaagcatgaagttgacagcaatgaaggttgctccttcaagcgcaggcgtggtgcaaagttgcatccttccccattcgagaggtcctactctgctgtttctccatcccaagccaggaggagatggcatgggactgagctagagctaacgagattcctttacttcgggagccacctcattccggtctttagaatacccgtttatacgtgcaaattgagaagattgggactataaaaagttaccttctttggtagaattatgaaagggtattgagaatccttaacgatctgaaaataatggctaagaatgatgagtcaaattttatgaactataggt

SEQ ID NO: 1810 - DNA, 854 bp, Avena sativa
gcgtgccgttgctcttgactctgcgagaggttcctgtttcctggcggagagagagggagaggcgagagggagaggacgaagccctccgtgtttctaccccctttccccgccgtcgagctttactgaaactccgatctcagaaaccgagaaagaaggggtctgtgaagaggtttcttgcggcagaacaatggaggtacttggcaaatctgtgattgctgagcccagcaatgtgattttcatgtccactattcttaacacagaggggcaaattcccagtcacaagtgtgacaagaggtgccagaatgagcacatctttggaaacatgtaccgttgcaaactgactggtttgacacacatctgtgacaaaaactgtaaccagaggatcctctatgacaaccacaactcgctctgccgagtgagtgggcagttgttcccactctcgccactggagctgcaggcagtgagggggatccgaaggaagcatgaagttgacagccatgaagggtgctcttttaagcgcaggcgtggtgcacagatgcatccttcccctttcgagcggtcctactctgccgcgtctcccataccaagccaagctggagatggcatggacctgagctagagctgacgagacttccgtctcttctttccccagccaccttatgcggatctttctactccattttcccttctttgacaggacggaactataagagcttccatctttgtagactgatgaagggacgactccttagagggactaataaatgtctgtagtattaattcagtttcatgggaccttgttgtaatcgtaacttcgatggaacatcctattctgaattacgtagtattttcat

SEQ ID NO: 1811 - DNA, 1403 bp, Festuca arundinacea
  misc_feature (195)..(195): n is a, c, g, or t
  misc_feature (439)..(439): n is a, c, g, or t
  misc_feature (442)..(442): n is a, c, g, or t
  misc_feature (1306)..(1306): n is a, c, g, or t
ggcacgaggcttgattcttgtttcctggcggagaggagaagtgggggggagaggccgaagacctccgcgtttctactcccttgccccgccttcgagctgttctgagactccgatctcggaaaccgagaaaaagggggtctgcgaagaggtctcttgcggcagaacaatggaggtacttggcaaacctgtgattgntgagcccagcaatgtgattttcttgtccactattcttaacactgaagggcaagttcccagtcacaagtgtgacaagaggtgccagaatgagcacatctttggcaacatgtaccgttgcaaactgactgggatgacgcacatttgtgacaaaaactgcaaccagaggatcctctatgacaaccacaactcgctctgccgagtgagtgggcagctgttcccgctctcgccactggagctgcaggcngtnagggggatccggaggaagcatgaagttgacagccatgaagggtgctcctttaagcgcaggcgtggtgcacagcttcatccttcccctttcgagaggtcctactctgccgtctctccgattccaagccaagctggagatggcatggacctgagctagagctgacgagacttccatccttcctttccccagccaccttaagcggatctttctactccattttcccttctttgacaagatggaactataagagtttccttctttgtagactgatgaagggatatgagactccttagagggacagaataaatttctatgtagtatcacttctgattcatgggaccttgttgtaatcgtaacttcgattgaacatcctattctgaattacgtagtattttgagatgatcacttttgaataccgtttagattatttccctgtagtgcaataatcttgtttgctctaactttatattattctaggttgcgactccttttcttggttatgttctcttacggttattcacaattatgtgatggcatttcagtgcagtcaagctgagcaaatttgtttgacacagttgatgtaaatttattgaagattacctatactatttcgtggggcgtgaacttactaactgaatttcctccatagctagtgctttgcatggcaggttgctgatcaagcctgagttatttatggtttgctctcatatagcttgattttttctgctaaatgcttttcttctttgcaggttatgcttctaacatttatattgcttcatcctgttttattttgttttgcttctttaccctgactttttcttctgttttgtagggtcatacaggtgctaacttatcttttttttnggtgtttatatacttccgtttgttaagttggtttcatttgtttgaacgagtgttcacctgtttgtttgttttatgtaggtaactgctggttgttctt

SEQ ID NO: 1812 - DNA, 919 bp, Triticum aestivum
gtccgggccgttgcaattgactccgcgagaggttggtgttccctggcggagagagagagggagggagggagaggaaggagagaccgaaggccgcgttgtttttacctcgtctcctcctccgccttcgagctctactgaaactccgatctcagaaaccaagaaaagggggtctgtgaagaggtttctcacggcagaacaatggaggtacttggcaaatctgtgattgctgagcccagcaatgtgattttcttgtccactattctgaacacagaaggggaaatccccagtcacaagtgtgacatgaggtgccagaatgagcacatctttggaaacatgtaccgctgcaaattgactggaatgacacacatttgtgacaaaaactgtaaccagaggatcctctatgacaaccacaactcgctttgccgagtgagtgggcagttgttcgcgctctcaccactggagctgcaggcagtgagggggattcggaggaagcatgaagctgacagcagccatgaagggtgctccttcaagcgcaggcgtggtgcacagctgcatccttccccttttgagagatcctactccgccgtgtctccgataccgagccaagctggagatggcatggacctgagctagagctaacgagacttccatcttttctttccccggctaccttatgcggatgtctactccatttccccttctttgacaggatggaaactataagagattccttctttatagacttatgaagggatatgagactccttagaggcactaaataatgtctatgtagtatcaattcagttttatgggaccttgttgtaatcgtaacttcgattgaacagcctattctgaattacttagtattaatcatttgctattaccgtttagattatttctctatagcgcggcgctcttg

SEQ ID NO: 1813 - DNA, 728 bp, Musa acuminata
  misc_feature (43)..(43): n is a, c, g, or t
  misc_feature (46)..(46): n is a, c, g, or t
  misc_feature (91)..(91): n is a, c, g, or t
  misc_feature (96)..(96): n is a, c, g, or t
ggacagggagtcgtcgcacccaacgggaaggattaagaagggncantccaggcgatccgtgggcgaaatctgttcgatcgttgggtttctntcctnttcggaatcgtttctcggttttggggttcatcactcgagcttgatacgagaaagcacaacaagaaccaagcttcaatcagctgagcaatggaggtatatggcaaatctatgattgccgagccaagcaatgtgatttacttgtccagtattcttaacaaggaagggctgattcctagtcacaaatgtgacaagaggtgccaaaacgaacatgtgtttgggaacatgtaccgctgcaaactaacaggactgacacacatctgcgataaaaattgtgagcagaggattttgtacgataaccatagttctctttgcagagtgagcggccagttttttcctctttcgccagcagaagagcaggcggtgagaggagtccgaaggaagctggaagtgacaaataccgatggctgtgcttttaagcgcaggcgcgatgcccagctgcatccttctcccttcgagaggatcttttctgcagtctctccaatatgcagtcaaattggagatggcatggatatgagttagagctgattagttccatttctttcccttctccctttcctttccccacccatctttgttctggatggaatcaagggcttctattttattatggaacttggaactgaactattatg

SEQ ID NO: 1814 - DNA, 1903 bp, Hordeum vulgare
cacaccgctcttgatcgatctcctgctctcgtctctgccaaaaacatccagtcatccgtcctacggtcccaatggcccacgtcctcgccgccgcggagcccctcaccctcctcaagcgcccgacgccgcagaacgacggcttcggcgacgacaacggcagcacggaggagaaggcactcaaggcgcgccgccgggagtccgacccggcggcggcactggccgcggcgcgtcacgagttcggcgagcacggcggcgtgaacatgtccatcgaggcctcggccacgttcaccgtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcgtccgtgctcatgcagctggtgggcgccggcgggcacgtcgtggcgtcgcggtgcctgtacggcggcacccacgcgctgctgtcccggttcctgccgcgcacctccggcgtgaaggcgacgttcgtggacgcggacgacgaggcggccgtgcgcgcggccatgaggccgggggagacgcgggtggtgtacgtggagacgatgtcgaacccgacgctggccgtcgccgacatcccgatgctggcgcgggtggcgcacgaggccggggccaagctggtggtggacaacaccttcacccccgtcgtcgtcacgccggcgcggctcggcgcagacgtcgtcgtccacagcgtgtccaagttcatcagcggcggcgccgacatcatcgccggtgcgatctgcgggccggcgagcctggtgaacgcgatgatggacctgcaggacggggcgctgatgctgctgggcccgacgatgaacgccaaggtggcgtcggagctggcggggcgcctcccgcacctgccgctgcggatgcaggagcactcgcgccgcgccgccgagttcgcggcccggatgcgccgccagggcctgcgcgtcacctacccgggcctccccgaccacccgcaccacgcccggctgcgcgccatgggcaacccgggctacggcgccggcggcatgctctgcctcgacatgggcaccgaggagcgcgccaaccgcctcatgtaccacctgcagaacaccacccagttcggcctcatggccgtcagcctcggctactacgacacgctcatgtcctgctccggcaacagcaccagcagcgagatggaccccgaggaccgcgcccgcgccggcatctccccgggcctcatccgcatgtccgtcggctacaacggcaccctggagcagcgctgggcgcagttcgagcgcgcgctcgcgctcatgcagcaggagacccccgccgccgccgccaccgccaagtacggcaaggccgtctgaccaccaaagcgttgatgcctgctcatggtgtatattatatatatatactcctcctatcactagctaagtaagtactgtcaagcaccatctggatctgttcagaacttcagatggatggatgtgccagtgtgttaagcagcacgcctgattagactttgctgagcgtactgcgagatgcgtcatccatgtatcggaataaattagcgtgattttctgtcgatgatggtttgtcaaatgccatcccgattttacttttcgctcgcacgcttggattctgcatttaccgtggcttgttgctctccatgccaactccagaatactgtttcggcaatgttgaagatcgaaagagagtcgagacacaacaaaatgaatcaactctattattgatgattgagtacaagtatatatagccttcagtggatgcattcaaaaaaaaaaaaaaaaaa

SEQ ID NO: 1815 - DNA, 1686 bp, Triticum aestivum
  misc_feature (1012)..(1012): n is a, c, g, or t
  misc_feature (1024)..(1024): n is a, c, g, or t
  misc_feature (1673)..(1673): n is a, c, g, or t
cgctcgcgctctcttctctgcaaaaacatccagtcatccatcctacgatcccaatggcccacgtcctcgccgccgccgagcccctcaccctcctcaagcgcccgcccccgcagaacgatggcttcggcgacgacaacggcagcacggaggagaaggcgcccaaggcgcgccgccgggagtccgaccccgcggcggcactggccgcggcccggcacgagttcggcgagcacggcggcgtgaacatgtccatcgaggcctcggccacgttcaccgtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcctgcgtgctgatgcagctggtgggcgccggcgggcacgtggtggcgtcgcgctgcctgtacggcggcacccacgcgctgctgtcccggttcctgccgcgcacctctggcgtgcaggcgacgttcgtggacacggacgacgaggcggccgtgcgcgcggccataaggccgggggagacgcggctggtgtacgtggagacgatgtcgaacccgacgctggccgtcgccgacatcccgatgctggcgcgggtggcgcacgaggccggggccaagctggtggtggacaacaccttcacccccgtggtcgtctcgcccgcgcggctcggcgccgacgtcgtcgtccacagcgtgtccaagttcatcagcggcggcgcagacatcatcgccggtgcgatctgtgggccggcgagcctggtgaaactccatgatggacctgcaggacggcgcactgatgctgctgggccccacgatgaacgccaaggtggcgtccgagctggctggctcgcctcccgcacctgccgctgcggatgcaggagcactcgcgccgcgccgccgagttcgcngcccggatgcgncgccagggcctccgcgtcacctacccgggcctccccgaccacccgcaccacgcccggctgcgcgccatgggcaacccgggctacggcgccggcggcatgctgtgcctcgacatgggcacggaggagcgcgccaaccgcctcatgtaccacctgcagaacaccacccagttcggcctcatggccgtcagcctcggctactacgacacgctcatgtcctgctccggcaacagcaccagcagcgagatggaccccgaggaccgcgcgcgcgccggcatctccccgggcctcatccgcatgtccgtcggctacaacggcaccctggagcagcgctgggcgcagttcgagcgcgccctcgcgctcatgcagcagcaggacacccccgccgccgccgcaaagtacggcaaggccgtctgacgacccaagaggctgcgtaaaccaccaagcgctgatgcctcatggcatgtaatgtattatagtatatactcctacatttactagctaagtaagcgccatctgaatctgttcagatggatggacatgctagtgtgttaagcagcacgctaaattagtctttggggagcgtactgcgagatgcatcatgcatgtattatcggaataaatttggcgtaatttcctgtcaaaaaaaaanaaaacatgacaga

SEQ ID NO: 1816 - DNA, 1886 bp, Hordeum vulgare
cacaccgctcttgatcgatctcctgctctcgtctctgccaaaaacatccagtcatccgtcctacggtcccaatggcccacgtcctcgccgccgcggagcccctcaccctcctcaagcgcccgacgccgcagaacgacggcttcggcgacgacaacggcagcacggaggagaaggcactcaaggcgcgccgccgggagtccgacccggcggcggcactggccgcggcgcgtcacgagttcggcgagcacggcggcgtgaacatgtccatcgaggcctcggccacgttcaccgtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcgtccgtgctcatgcagctggtgggcgccggcgggcacgtcgtggcgtcgcggtgcctgtacggcggcacccacgcgctgctgtcccggttcctgccgcgcacctccggcgtgaaggcgacgttcgtggacgcggacgacgaggcggccgtgcgcgcggccatgaggccgggggagacgcgggtggtgtacgtggagacgatgtcgaacccgacgctggccgtcgccgacatcccgatgctggcgcgggtggcgcacgaggccggggccaagctggtggtggacaacaccttcacccccgtcgtcgtcacgccggcgcggctcggcgcagacgtcgtcgtccacagcgtgtccaagttcatcagcggcggcgccgacatcatcgccggtgcgatctgcgggccggcgagcctggtgaacgcgatgatggacctgcaggacggggcgctgatgctgctgggcccgacgatgaacgccaaggtggcgtcggagctggcggggcgcctcccgcacctgccgctgcggatgcaggagcactcgcgccgcgccgccgagttcgcggcccggatgcgccgccagggcctgcgcgtcacctacccgggcctccccgagcacccgcaccacgcccggctgcgcgccatgggcaacccgggctacggcgccggcggcatgctctgcctcgacatgggcaccgaggagcgcgccaaccgcctcatgtaccacctgcagaacaccacccagttcgccctcatggccgtcagcctcggctactacgacacgctcatgtcctgctccggcaacagcaccagcagcgagatggaccccgaggaccgcgcccgcgccggcatctccccgggcctcatccgcatgtccgtcggctacaacggcaccctggagcagcgctgggcgcagttcgagcgcgcgctcgcgctcatgcagcaggagacccccgccgccgccgccaccgccaagtacggcaaggccgtctgaccaccaaagcgttgatgcctgctcatggtgtatattatatatatatactcctcctatcactagctaagtaagtactgtcaagcaccatctggatctgttcagaacttcagatggatggatgtgccagtgtgttaagcagcacgcctgattagactttgctgagcgtactgcgagatgcgtcatccatgtatcggaataaattagcgtgattttctgtcgatgatggtttgtcaaatgccatcccgattttacttttcgctcgcacgcttggattctgcatttaccgtggcttgttgctctccatgccaactccagaatactgtttcggcaatgttgaagatcgaaagagagtcgagacacaacaaaatgaatcaactctattattgatgattgagtacaagtatatatagccttcagtggatgcattca

SEQ ID NO: 1817 - DNA, 1650 bp, Leymus cinereus x Leymus triticoides
  misc_feature (50)..(50): n is a, c, g, or t
  misc_feature (55)..(55): n is a, c, g, or t
  misc_feature (88)..(88): n is a, c, g, or t
  misc_feature (194)..(194): n is a, c, g, or t
  misc_feature (218)..(218): n is a, c, g, or t
  misc_feature (227)..(227): n is a, c, g, or t
  misc_feature (437)..(437): n is a, c, g, or t
  misc_feature (446)..(446): n is a, c, g, or t
  misc_feature (552)..(552): n is a, c, g, or t
  misc_feature (555)..(555): n is a, c, g, or t
  misc_feature (566)..(566): n is a, c, g, or t
  misc_feature (634)..(634): n is a, c, g, or t
  misc_feature (704)..(704): n is a, c, g, or t
  misc_feature (725)..(725): n is a, c, g, or t
  misc_feature (1043)..(1043): n is a, c, g, or t
  misc_feature (1109)..(1109): n is a, c, g, or t
  misc_feature (1241)..(1241): n is a, c, g, or t
  misc_feature (1289)..(1289): n is a, c, g, or t
  misc_feature (1292)..(1292): n is a, c, g, or t
  misc_feature (1313)..(1313): n is a, c, g, or t
ccgttgctgtcgccgttgctgtcggtcctgcgatcccaatggcccacgtnctcgncgccgcggagcccctcaccctcctcaagcgccngccgccgcagaacgacggcttcggcgacgacaacggcagcacggaggagaaggcgcccaaggcgcgccgccgggagtccgacccggcggcggcgctggccgcggcncggcacgagttcggcgagcacggnggcgtgaanatgtccatcgaggcctcggccacgttcacggtgatggagccggacaccatgcgccggctcttcacgggggagctgggcccggagcgcggcgacctgtacatctacagccgccacttcaacccgacggtgctggcgctggggcggcagatggccgcgctggaggggaccgaggccgcctactgcacggcgtccggcatgtcggccatctcntccgtgctnatgcagctggtgggcgccggcgggcacgtggtggcgtcgcgctgcctgtacggcggcacccacgcgctcttgtcccggttcctgccgcgcacctccggcgtgcagncgncgttcgtggangcggacgatgaggcggccgtgcgcgcggccataaggccgggggagacgcgggtggtgtacgtggagangatgtcgaacccgacgctggccgtggccgacatcccgatgctggcgcgggtggcgcacgaggccggggcnaagctggtggtggacaacacnttcacccccgtcgtcgtctcgcccgcgcggctcggcgccgacgtcgtcgtccacagcgtgtccaagttcatcagcggcggcgccgacatcatcgccggtgcgatctgcgggccggcgagcctggtgaacgcgatgatggacctgcaggacggcgcgctgatgctgctgggccccacgatgaacgccaaggtggcgtccgagctggcggggcgcctcccgcacctgccgctgcggatgcaggagcactcgcgccgcgccgccgagttcgccgcccggatgcgccgccagggcctccgcgtcacctacccgggcctcccngaccacccgcaccacgcccggctgcgcgccatgggcaacccgggctacggcgccggcggcatgctntgcctcgacatgggcaccgaggagcgcgccaaccgcctcatgtaccacctgcagaacaccacccagttcggcctcatggccgtcagcctcggctactacgacacgctcatgtcctgctccggcaacagcacnagcagcgagatggaccccgaggaccgcgcccgcgccggcatctccccnggnctcatccgcatgtccgtcggntacaacggcaccctggagcagcgctgggcgcagttcgagcgcgccctcgcgctcatgcagcaggagacccccgccgccgccgccgccaagtacggcaaggccgtctgacgacacaagagaatgcgtaaaccaagcgctgatgcctgctgatggtgtgtatattatatatatactcctactattactagctataagtacggttaatcaccatctgaatctgttcagatggatggacatgccagtgtgttaagcagcacgctaaattagtctttggggagcgtactgcgagatgcatcatgcatgaattatcggaataaattggcgtaattttctgtca

SEQ ID NO: 1818 - DNA, 1704 bp, Zea mays
cccgcaccgctctgaaaaccattcccaggcccgcccgacttcctgcccttgtacaacgcacggtccccgtcccaatggcccagactctgtccgccgcctccgagctggccaccctgaagcgcccgttcggcaacgacgggttcggcgatggcagcaacaacggcagcgccaccggcgagaagcccaaggcgcggcggcgggaggcggacccggcggcggcgctggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcgggcacgtggtggcgtcgcggtgcctgtacggcgggacacacgcgctgctggcccggttcctgccgcgcgcctccggggtgcgcgccaccttcgtggacgccgacgacgaggccgccgtgcgcgccgcggtggtccccggcgagacgcgggtggtgtacgtggagaccatgtccaacccgacgctcgccgtcgccgacatccccatgctggcgcgggtggcgcacgaggccggcgccaagctcgtggtggacaacaccttcacccccgtggtggtgtcgcccgcgcgcctcggcgccgacgtcgtcgtccacagcgtctccaagttcatcagcggcggcgccgacatcatcgccggcgcgatctgcgggccggcgagcctggtgaacgcgatgatggacctgcaggagggggcgctgatgctgctgggccccacgatgaacgccaaggtggcgttcgagctgtcggagcggctgccgcacctgccgctgcggatgcaggagcactcgcgccgcgcgctggcgttcgccgagcggatgcaggggctgggcctgcgcgtgctgtacccgggcctcccgggccacccgcaccacgcgcgcctggccgccatgggcaacccgggctacggctgcggcggcatgctgtgcctcgacatgggcaccgaggagcgcgccaaccgcctcatgcaccacctccagaacaccacccagttcggcctcatggccgtcagcctcggctactacgagacgctcatgtcctgctccggcagcagcaccagcagcgagatgccgcccgaggaccgcgcgcgcgcgggcatctccccgggcctcgtccgcatgtccgtcggctacaacggcacgctggagcagcgctgggcgcagttcgagcgcgcgctcgcgctcatgcagacgccgacgcccacgcaccacctcaagcaggccgccgaccgcgacggccccgaagccgccaacaaccaccaccgcaagcactgacgcgcttgcgcttccgagcgtgcgtgcgtgcatgcatggcctgtggacttgtgtttgtcgtgttcgtgtatatactactagtgccattcaagcaagaatattaaacaccatctgatccctctggttcagatggatcgatatgccagtgcaagcggctcgatctctggggaacctgggaatggacctgaataaatgggatttgtcttta

SEQ ID NO: 1819 - DNA, 1775 bp, Panicum virgatum
aaaccgagtcctgagcccgatctcctgctcctcatcccctgcaactaacgcacgcgcccgtcccgatggcccaggccatggccgccgcctccgagctggtcacccccctgaagcgcccgttcgggagcgacgggctcggcgacggcaacatcatcagcaacagcggcggcagcaacggcggcgtcgcgccgggcgccgacgacgagaagcccaaggcgcggcgccgcgaggcggacccggcggcggcgctggcagcggcgcggcacgagttcggcgagcacggcggcgtcaacatgtccatcgaggcgtccgcgacgttcacggtgatggagccggacacgatgcggcggctgtttgcgggggagctgggccccgaccgcggcgacatgtacatctacagccggcacttcaacccgacggtgctggcgctggggcggcagatggcggcgctggagggcaccgaggccgcctactgcacggcgtcgggcatgtccgccatctccgccgtgctgatgcagctggtgggcgctggcgggcacgtggtggcgtcgcggtgcctgtacggcggcacccacgcgctgctgtcccggttcctgccgcgggcgtccggggtgcgcgccacgttcgtggacgccgacgacgaggccgccgtgcgcgccgcggtggtgccgggggagacccgggtggtgtacgtggagaccatgtccaacccgacgctggccgtagcggacatcccgatgctggcgcgggtggcgcacgaggcgggggccaagctggtggtggacaacaccttcacccccgtcgtggtctcccccgcgcgcctcggcgccgacgtcgtcgtccacagcgtctccaagttcatcagcggcggcgccgacatcatcgccggcgcgatctgcgggccggcgagcctggtgaacgcgatgatggacctgcaggagggggcgctgatgctgctgggcccgacgatgaacgccaaggtggccttcgagctgtcggagcggctgccgcacctgccgctgcggatgcaggagcactcgcggcgcgcgctggcgttcgcgtcccggatgcagcggctgggcctgcgcgtgctctacccggggctccccgaccacccgcaccacgcgcgcctcgccgccgccgccaaccccgggtacggctccggcggcatgctctgcgtcgacatgggcaccgaggaccgcgccaaccgcctcatgcaccacctccagaacaccacccagttcggcctcatggccgtcagcctcggctactacgagacgctcatgtcctgctcggggagcagcaccagcagcgagatgccgcccgaggaccgcgcccgcgccggcatctcgccgggcctcgtccgcatgtccgtcggctacaacggcacgctcgagcagcgctgggcgcagttcgagcgcgcgctcgcgctcatgcagccgccgccgctgcaccacaaggccgccgccggccgcgacgtccccgacgccggcaccaccaaccaccgcaagcactgaccggcgtccgagtccaaatgtgtgcttccctggcagggggtgatatatatgttgtgcctgtttctggtgtatagtgcactattattactattaccatttgagtaagcaaggttaaggttaaacaccgtctgacccctccggttcagatggatagtgtaagccgcttcgtctctgggggatcctggaaacggacctgaataagtgtaatcagctagtgtgctgcttaatctgaacttcttgcaggaagatatacatgca

SEQ ID NO: 1820 - DNA, 1776 bp, Sorghum bicolor
ctctgcacccattccattcccgagcccgatctcctgctcctctgcaacgcacgcacgacacgctcccatcccgcaatggcccagactatggccgccgcctccgagctggtcaccctgaagcgcccgttcggcggcaacgacgggttcggcgacggcagcggcaatggaggaaccgtcgccgaggagaagcccaaggcgcgccgccgggaggcggacccggcggcggcgctggcctcggcgcggcacgagttcggcgagcacggcggcgtgaacatgtccatcgaggcgtcggcgacgttcacggtgatggagccggacaccatgcgccgtctcttcgcgggcgagctgggccccgaccgcggcgacatgtacatctacagccggcacttcaacccgacggtgctggcgctgggccggcagatggcggcgctggagggcaccgaggccgcctactgcacggcgtccgggatgtccgccatctccgccgtgctgatgcagctggtgggcgccggcgggcacgtggtggcgtcgcggtgcctgtacggcggcacccacgcgctgctggcccggttcctgccgcgcacctccggggtgcgcgccaccttcgtggacgccgacgacgaggccgccgtgcgcgccgccgtggtcccgggggagacgcgggtggtgtacgtggagaccatgtccaacccgacgctggccgtcgccgacatccccatgctggcgcgggtggcgcacgaggcgggggccaagctcgtggtggacaacaccttcacccccgtggtggtctcgcccgcgcgcctcggcgccgacgtcgtcgtccacagcgtctccaagttcatcagcggtggcgctgacatcatcgccggcgcgatctgcgggccggcgagcctggtgaacgcgatgatggacctgcaggacggggcgctgatgctgctgggcccgacgatgaacgccaaggtggcgttcgagctgtcggagcggctgccgcacctgccgctgcggatccaggagcactcgcgccgcgcgctggcgttcgccgagcggatgcaggggctgggcctgcgcgtgctgtacccgggcctccccgaccacccgcaccacgcgcgcctggccgccatgggcaaccccggctacggctcggggggcatgctgtgcctcgacatgggcaccgaggagcgcgccaaccgcctgatgcaccacctccagaacaccacccagtttggactcatggccgtcagcctgggctactacgagacgctcatgtcctgctccgggagcagcaccagcagcgagatgccgcccgaggaccgcgccagggccggcatctccccgggcctcgtccgcatgtccgtcgggtacaacggcacgatggagcagcgctgggcgcagttcgagcgcgcgctcgcgctcatgcacccgcccacgcaccacctcagcctcaagggcgccgccgccgccgaccgcgacggcagcgacgccgcgggcaacaaccaccgcaagcactgactgacgcttgcgcttccgactttccgagtgtgcatgcatggtgatatgtgctgttgtggacttgtgtcgtgttcgtgtgtatatactagtagtactaccattgaagtaaggttaaacaccaccgtctgatccctctggttcagatggatatgccggtgcaagcggcttcatctctggggaacttgggagtggacctcaataaatgggatgcgtctttaacggtttccccctttaatctctctctctctctctatatgaatcttacag

SEQ ID NO: 1821 - DNA, 1738 bp, Sorghum bicolor
gcacccattccattcccgagcccgatctcctgctcctctgcaacgcacgcacgacacgctcccatcccgcaatggcccagactatggccgccgcctccgagctggtcaccctgaagcgcccgttcggcggcaacgacgggttcggcgacggcagcggcaatggaggaaccgtcgccgaggagaagcccaaggcgcgccgccgggaggcggacccggcggcggcgctggcctcggcgcggcacgagttcggcgagcacggcggcgtgaacatgtccatcgaggcgtcggcgacgttcacggtgatggagccggacaccatgcgccgtctcttcgcgggcgagctgggccccgaccgcggcgacatgtacatctacagccggcacttcaacccgacggtgctggcgctgggccggcagatggcggcgctggagggcaccgaggccgcctactgcacggcgtccgggatgtccgccatctccgccgtgctgatgcagctggtgggcgccggcgggcacgtggtggcgtcgcggtgcctgtacggcggcacccacgcgctgctggcccggttcctgccgcgcacctccggggtgcgcgccaccttcgtggacgccgacgacgaggccgccgtgcgcgccgccgtggtcccgggggagacgcgggtggtgtacgtggagaccatgtccaacccgacgctggccgtcgccgacatccccatgctggcgcgggtggcgcacgaggcgggggccaagctcgtggtggacaacaccttcacccccgtggtggtctcgcccgcgcgcctcggcgccgacgtcgtcgtccacagcgtctccaagttcatcagcggtggcgctgacatcatcgccggcgcgatctgcgggccggcgagcctggtgaacgcgatgatggacctgcaggacggggcgctgatgctgctgggcccgacgatgaacgccaaggtggcgttcgagctgtcggagcggctgccgcacctgccgctgcggatccaggagcactcgcgccgcgcgctggcgttcgccgagcggatgcaggggctgggcctgcgcgtgctgtacccgggcctccccgaccacccgcaccacgcgcgcctggccgccatgggcaaccccggctacggctcggggggcatgctgtgcctcgacatgggcaccgaggagcgcgccaaccgcctgatgcaccacctccagaacaccacccagtttggactcatggccgtcagcctgggctactacgagacgctcatgtcctgctccgggagcagcaccagcagcgagatgccgcccgaggaccgcgccagggccggcatctccccgggcctcgtccgcatgtccgtcgggtacaacggcacgatggagcagcgctgggcgcagttcgagcgcgcgctcgcgctcatgcacccgcccacgcaccacctcagcctcaagggcgccgccgccgccgaccgcgacggcagcgacgccgcgggcaacaaccaccgcaagcactgactgacgcttgcgcttccgactttccgagtgtgcatgcatggtgatatgtgctgttgtggacttgtgtcgtgttcgtgtgtatatactagtagtactaccattgaagtaaggttaaacaccaccgtctgatccctctggttcagatggatatgccggtgtaagcggcttcatctctggggaacttgggagtggacctcaataaatgggatgcgtctttaacggtttcccccttt

SEQ ID NO: 1822 - DNA, 1711 bp, Brachypodium distachyon
gatcgatcgatcaatctccagccctcctgcaaacaaacacatccatcgtcccaaaacccaaatccgatccccaatggctcacgtgctggccgccgcggaacccatcagcatgctcaagcgccccccgccgccgaacgacgacgagaaggcgccgccggtcaacaaggcggcgcgccgccgcgacccgccgtcgtcggacccggctgcggcgctggccgcggcgcgccacgagttcggcgagcacggcggcgtgaacatgtccatcgaggcttcggcgaccttcaccgtcatggagccggacacgatgcggaagctcttcgcgggcgagctgggcccggaccgcggggacctgtacatctacagcaggcacttcaacccgacggtgctcgcgctgggccggcagatggcggccctggagggaaccgaggcggcctactgcacggcgtccgggatgtccgccatctcgtccgtcctgatgcagctcgtgggggccgggggacacgtggtggcgtcccggtgcctgtacggcgggacccacgcgctgctgtccaggttcctgccgcggacgtccggcgtgaccgcgacgttcgtggacgcggacgacgaggacgccgtgcgggcggcggtgaggccaggggagaccaaggtggtttacgtcgagaccatgtccaacccgacgctggccgtcgcggacatccccatgctggcgagggtggcgagggaggccggggccaagctcgtggtggacaatacttttacgcccgtcgtcgtgtcgcctgccaggcttggggccgacgtcgtcgtgcacagcgtctccaagttcatcagcggcggcgccgacatcatcgcaggcgcgatctgcgggccggcgagcctggtgaactcgatgatggacctgcaggacggggcgctgatgctgctcggcccaacaatgaacgccaaggtggcctcggagctggccgcgcgcctgccgcaccttccgctgcggatgcaggagcactcgcgccgggccggggagttcgcggcccggatgcagcgcatgggcctgcgcgtggtttacccgggcctccaagaccacacccaccacggccgcctcagggccatggccaacccgggctacggcttcggtgggatgctctgcgtcgacatgggcaccgaggagcgggccgcccgcctcatgcaccacctccagaacaccacccagttcggcctcatggccgtcagcctgggctactacgagaccctcatgtcctgctccgggagcagcaccagcagcgagatggacccgaatgaccgggccctggccgggatctcgcccgggcttatccgcatgtccgtgggctacaatggcaccctggagcagcgctgggcccagttcgagcgcgccttcgccctcatgcagcagcaggacgccccctccgccgccgccaagtactgtaaggctatctgaatctgagtcaccggcggtgctgatggtatatattagtgctattagctgcaaagttaggttaagcgccatctgatcagctgatcagacggatgccaaccaatgtgttaagctgcatgtatgatttagacttcggggaactgggagatgtaacggaataagcatgtgcgaattgaacttgaagtaggcaggcgatgaacagtaagctgtacgtttcatgttgatgtcatctctctgcgttggttgtgctcgatcatgcggttt

SEQ ID NO: 1823 - DNA, 1711 bp, Brachypodium distachyon
gatcgatcgatcaatctccagccctcctgcaaacaaacacatccatcgtcccaaaacccaaatccgatccccaatggctcacgtgctggccgccgcggaacccatcagcatgctcaagcgccccccgccgccgaacgacgacgagaaggcgccgccggtcaacaaggcggcgcgccgccgcgacccgccgtcgtcggacccggctgcggcgctggccgcggcgcgccacgagttcggcgagcacggcggcgtgaacatgtccatcgaggcttcggcgaccttcaccgtcatggagccggacacgatgcggaagctcttcgcgggcgagctgggcccggaccgcggggacctgtacatctacagcaggcacttcaacccgacggtgctcgcgctgggccggcagatggcggccctggagggaaccgaggcggcctactgcacggcgtccgggatgtccgccatctcgtccgtcctgatgcagctcgtgggggccgggggacacgtggtggcgtcccggtgcctgtacggcgggacccacgcgctgctgtccaggttcctgccgcggacgtccggcgtgaccgcgacgttcgtggacgcggacgacgaggacgccgtgcgggcggcggtgaggccaggggagaccaaggtggtttacgtcgagaccatgtccaacccgacgctggccgtcgcggacatccccatgctggcgagggtggcgagggaggccggggccaagctcgtggtggacaatacttttacgcccgtcgtcgtgtcgcctgccaggcttggggccgacgtcgtcgtgcacagcgtctccaagttcatcagcggcggcgccgacatcatcgcaggcgcgatctgcgggccggcgagcctggtgaactcgatgatggacctgcaggacggggcgctgatgctgctcggcccaacaatgaacgccaaggtggcctcggagctggccgcgcgcctgccggaccttccgctgcggatgcaggagcactcgcgccgggccggggagttcgcggcccggatgcagcgcatgggcctgcgcgtggtttacccgggcctccaagaccacacccaccacggccgcctcagggccatggccaacccgggctacggcttcggtgggatgctctgcgtcgacatgggcaccgaggagcgggccgcccgcctcatgcaccacctccagaacaccacccagttcggcctcatggccgtcagcctgggctactacgagaccctcatgtcctgctccgggagcagcaccagcagcgagatggacccgaatgaccgggccctggccgggatctcgcccgggcttatccgcatgtccgtgggctacaatggcaccctggagcagcgctgggcccagttcgagcgcgccttcgccctcatgcagcagcaggacgccccctccgccgccgccaagtactgtaaggctatctgaatctgagtcaccggcggtgctgatggtatatattagtgctattagctgcaaagttaggttaagcgccatctgatcagctgatcagacggatgccaaccaatgtgttaagctgcatgtatgatttagacttcggggaactgggagatgtaacggaataagcatgtgcgaattgaacttgaagtaggcaggcgatgaacagtaagctgtacgtttcatgttgatgtcatctctctgcgttggttgtgctcgatcatgcggttt

SEQ ID NO: 1824 - DNA, 1428 bp, Zea mays
atggcccagacgaccatggccgccgcctccgagctggtcaccctaaagcgcccgttcggcaaggacgtgtctggctctggcgacggcagcgtcgccgaggagaagcccaaggcgccggcgcgccggcgggaggcggaagacccggcggcggcgctggccgcggcgcggcacgagttcggcgagcacggcggcgtgaacatgtccatcgaggcgtcggcgacgttcacggtgatggagccggaaaccatgcggcggctcttcgcgggcgagctgggccccgaccgcggcggcatgtacatctacagccggcacttcaacccgacggtgcaggcgctggggcggcagatggcggcgctggagggcacggaggccgcctactgcacggcgtccgggatgtccgccatctcctccgtcatggtgcagctggtgggtgccggcggccacgtggtggcgtcgcggtgcctgtacggcggcacccacgcgctgctcgcccggttcctgccgcgcgccgccggggtgcgcgccaccttcgtggacgtcgacgacgaggccgccgtgcgcgccgcggtggtccccggtgagacgcgggtagtgttcgtggagaccatgtccaacccgacgctcgccgtcgccgacatccccatgctggcgcgggtggctcacgaggccggcgccaagcttgtggtggacaacaccttcacccccgtcgtggtctcgcccgcgcgcctcggcgccgacgtcgtcgtccacagcgtctccaagttcatcagcggcggcggcgacatcatcgctggcgcgatctgtgggccggcgagcctggtgaacgcgatgatggacctgcaggagggggcgctgatgctgctgggccccacgatgaacgccaagatggccttcgagctgtgggagcgcctcccgcacctgccgctgcggatgcaggagcactcgcgccgcgcgctggcgttcgccgcgcggatgcagcgcctgggcctgcgcgtgctctacccgggcctcccggaccacccgcaccacgcgcgcctggccgccatgcggaacccgggatacggctccggcggcatgctgtgcgtcgacatgggcacggaggagcgcgccaaccgcctcatgcaccacctccagaacaccacccagttcggcctcatggccgtcagcctgggctactacgagacgctcgtgtcctgctccgggaccagcaccagcagcgagatgccgccccaggaccgcgagcgcgccggcatctccccgggcctcgtccgcatgtccgtgggctacaacggcacgctggagcagcgctgggcacagttggagcgcgcgctagcgctcatgcagccgccgccaccgccgcggcaccaccacctcaagggcgctgccgaccgcgatggccccgacgccgccaacaaccacggcaaacac

SEQ ID NO: 1825 - DNA, 1784 bp, Saccharum officinarum
  misc_feature (14)..(14): n is a, c, g, or t
  misc_feature (977)..(977): n is a, c, g, or t
  misc_feature (983)..(983): n is a, c, g, or t
  misc_feature (1043)..(1043): n is a, c, g, or t
  misc_feature (1053)..(1053): n is a, c, g, or t
  misc_feature (1115)..(1115): n is a, c, g, or t
cccacgcgtccggntgaacccattcccgagcccgatctcctgctcctctgcaacgcacgcaccacacgctcccatcccaatggcccagactatggccgccacctccgagttggtcaccctgaagcgccctttcggcggcaacgacgggttcggcgacggcggcagcaacggcaccgtcgccgacgagaagcccaaggcgcgtcgccgggaggcggatccggcggcggcgctggcctcggcgcggcacgagttcggcgagcacggcggcgtgaacatgtccatcgaggcgtcggcgacgttcacggtgatggagccggacaccatgcgccgtctcttcgcgggcgagctgggccccgaccgcggcgacatgtacatctacagccggcacttcaacccgacggtgctggcgctggggcggcagatggcggcgctggagggcacggaggccgcctactgcacggcgtccgggatgtccgccatctccgccgtgctgatgcagctggtgggcgccggggggcacgtggtggcgtcccggtgcctgtacggcggcacccacgcgctggtggcccggttcctgccgcgcacctccggggtgcgcgccacttcgtggacgccgacgacgaggccgccgtgcgcgccgcggtggtcccgggggagacgcgggtggtgtacgtggagaccatgtccaacccgacgctggccgtcgccgacatccccatgctggcgcgggtggcgcacgaggcgggggccaagctcgtggtggacaacaccttcacccccgtggtggtctcgcccgcgcgcctcggcgccgacgtcgtcgtccacagcgtctccaagttcatcagcggtggcgccgacatcatcgccgtagtcagctcgctagtctcctgccgccggaacgtgacgtggtgacccaccccatcttaagcgcgatctgcgggccggcgagcctggtgaacgcgatgatggacctgcangacggngcgctgatgctgctgggccccacgatgaacgccaaggtggcgttcgagctgtcggagcgnctcccgcacntgccgctgcggatccaggagcactcacgccgcgcgctggcgttcgccacgcggatgcagcgnctgggcctgcgcgtgctgtacccgggcctccccgaccacccgcaccacgcgcgcctggccgccatgggcaaccccgggtacgggtcggggggcatgctgtgcctcgacatgggcaccgaggagcgcgccaaccgcctgatgcaccacctccagaacaccacccagttcggcctcatggccgtcagcctgggctactacgagacgctcatgtcctgctccgggagcagcaccagcagcgagatgccgcccgaggaccgcgcgcgcgcgggcatctccccgggtctcgtccgcatgtccgtgggatacaacggcacgctggagcagcgctgggcgcagttcgagcgagcgctcgcgctcatgcagccgccgacgccgctggcgcaccacctcaacctcaagggcgccgccgaccgcgacggcaccgacgccgccagcaacaaccaccgcaagcactgacgcctgcgcttccgacttccgagtgtgcatgcatggtgatatgtttactgtggacttgtgtcgtgttcgtgtatatactagtagtaccattgaagtaaggttaaacaccaccgtctgatccctctgcttcagatggatatgccagtgcaagcggcttgatctctggggaacttgggagtggacctgaataaatgggatgcgtctttaacggtt

SEQ ID NO: 1826 - DNA, 1459 bp, Panicum virgatum
ctgcgatgcgtccggggtgatgcaggtcgcgccccaccaccaccacagccgcctccgacccctgctctccaatttgaggcccaaaccctcccggccccgtcgccttgccgccggccgcgcgctgccgccatccgacgagccctccgcctcctcctcctccccaggcccgcggcgccgcgcgtccggtccggtgcgggcgtgagatccatccacccggctgcggggcggccgttctcctcctcgcgtcggaaagtttttgtgtgcttcatccatgacaagctaaagatatcgcatgaacagtgccagttagtctgcctttgctctgtcttgatcctgattgttttgtgctttgccttgcaaagaaaggaatcatgacttcagttgttcatagtgtttcaggtgaccacagagctgaggatcaacatcaacagcagaagcaagctgaacctgaggaccagcaagaagccccagttactagttcagatagtcaaccaacagtgggcacaccatcagctgattatgtgactccctatgcccctcatgacatggctcatgcaatgggtcaatatgcctacccaaatattgatccatactatggaagcctatatgcggcttacggtggacagccaatgatgcatccaccgttggtcggaatgcatccgactggcttacctttgcctactgatgcaattgaagagcctgtgtatgtaaatgcaaaacaatacaatgccattttaaggcgacgccaatctcgggctaaagctgaatcagaaaggaagcttgtcaagggccgtaagccctatctccatgagtcacgtcatcagcatgccttgaaaagggccaggggagctggaggcaggtttctcaattcaaagccagatgacaaggaagagaactctgactcgagtcacaaagagaaacaaaacggagtcgcgccccacaagagtggccaaccgtcaacccctccctctcccaacggtgcatcttcagctaatcaggcagacagtcaccaatgaggcttcgagaactcacagccgaagagagttaagcccctgacgctagatgtggcaacagatctgtacagcaagtgctagcgggcaacagcaaggatggtgtcggttggttgtggtaggacatattccatagaaaaacatagacgagtcagacaggttttgcagtttggtttgttcctctcagtttattcacctttgtgtacaattctagtagcattgtgtcctcatggatagctcagtcagttcttcagaaagcctttgtagcatatcagcccattgtttgttgcttggagttggagatttgggattggagttcataacctgctgtcctgcatcatcatccgcagcacagaataatcgctggctatgtgtatgttagatgacaataaaccctaatgtaggacatgtgagcacctcatctgaatctagctttgtttcctctgcat

SEQ ID NO: 1827 - DNA, 3193 bp, Zea mays
gcacaacatttcaaccagaaaaactagccgaagcaaacccattccacaagcacctggtgggatcatctcatcatcagaaacaaagagagagattccgtgcccacttgttgtagtagattgtgaggattgaggagtagcaaagagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgtcgcagtccccgccgccggactccgtcccggcgtccacggcactgatcaaggtcatccgccgggcgcagtccgcgcagaaaaaacgcggggactctcacctcgccgtcgaccagctgctgctcggcctgctcgaggactcgcagatctccgactgcctcaaggaggccggcgtgtccgcggcgcgggtgcgcgccgagcttgagaagctccgcggcggggaggggcgccgcgtggagtccgcgtcgggggacactaacttccaggcgctcaagacatacggccgggacctcgtcgagcaggccgggaagcttgatcccgtcatcggccgcgacgaggagatccgccgcgtggtgcgcatcctctcgcgccgcactaagaacaaccccgtcctcatcggcgagcccggcgttggcaagacggccgtcgtggagggcctcgcgcagcgcatcgttcgcggcgacgtgcccagtaacctcctcgacgtccgcctcatcgcgctcgacatgggcgcgctcgtcgcgggcgccaagtaccgcggcgagttcgaggagcggctcaaggccgtgctcaaggaggtggaagaggccgaggggaaggtcattctcttcatcgacgagatacacctcgtcctgggcgcgggcaggacggagggttccatggacgcggccaacctgttcaagccaatgctggcgaggggacagctcaggtgcatcggcgccaccacgctggaggagtaccgcaagtacgtggagaaggacgcagcgttcgagcggcggttccagcaggtgttcgtcgcggagccgagcgtgcccgataccgtcagcattctgaggggactcaaggagaagtacgaggggcaccatggcgtgaggatccaggaccgcgccctcgtggtcgcggcacagctctccgcgaggtacatcatgggtcggcacctgcctgacaaagccatagacctggtggacgaggcctgcgccaatgtgagggtgcagctcgacagccagccggaggagattgataacctggagaggaagagaatccagcttgaggttgagctccacgcgctcgagaaggagaaggacaaggccagcaaagcccggctgattgaggtcaggaaggaattggacgatctgagggacaagctgcagcccctgaccatgaagtacaggaaggagaaggagagaatcgatgagatcaggaagctgaagcagcgccgcgaggagctccagttcaccctgcaggaggccgagcgccggatggacctggcccgtgtggccgatctcaagtacggcgccctccaggaaatcgacgccgcgatctccaagctggagagcgaaacaggggagaacctgatgctcaccgaaaccgtcggccctgaacaaattgcagaggtggtgagccgttggacgggtattccagtgacccggcttggccagaacgacaaggagaggctggtcggcctggctgacaggcttcaccagagggtggtcggccagacagaggctgtgagcgccgtcgcagaggcggtgctgaggtcgagggccggtcttggcaggccacaacagcccactggctcgttcctcttcctgggtccgactggcgtggggaaaactgagctggccaaggccctagccgaacagctgttcgacgacgagaaccttcttgtccgcatcgacatgtcggagtacatggagcagcactcggttgctcgcctcatcggagcaccacctggctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacaccgtgatcatcatgacatcgaacctcggcgccgagcacctcctcgctgggatggtgggcaagaactccatgaaggtcgctcgcgatctggtcatgcaggaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtgtacggcgcgcggccaatcaggaggtggatcgagaagagggtggtgacgcagctgtcgaagatgctgatccaggaggagatcgacgagaactgcacggtctacatcgacgccgcgcccggcaaggacgagctggtctacagggtggaccggagcggcggtctggtgaacgctgagacggggatgaagtcggacatcctgatccaggtccccaccagctccaccaggagcgacgctgcgcaggccgtcaagaagatgaggatcatggaggaggacgaggacggcatggacgaggagtaaaaggcgggccggaggacgcggagctgcgcccaggccgcaggtctggcgccggcatcatcgagtgtcttttgaataagcgtgtagataagcccgtgaatgtggaaacgaggatgagatgatgttcttgtaacgctgctgtttgtcaagcatggacgaatgctctcatatcatcatatggtgtcaaagtgacaaagtctctcaatcgatgtcttgatgtcattatttttatctccctgaatgtttttacatgttttcctctattcattgtatcctttatgcatacacgaagggagaactttcgg

SEQ ID NO: 1828 - DNA, 3057 bp, Oryza sativa
aatccactccgcccttcatatgcgcgcaccgctcctcccgttgtttccatcgacagaagagagagttcagatcaaacgccgaagcaattcttccgcaagatttcgagtgatcccatctcaatccaagctaaaccgagagattttgatttgttgctgtagattgattgtgtgaggagaggaggagcagccatgaatccggacaacttcacgcacaagaccaacgaggcgctcgtggcggcgcacgagatagcgtcggaggcggggcacgcgcagctgacgccgctgcacctggtggcggcgctggcggcggacaagggcgggatactccggcaggcgatctcgcaggcgtccggcggggacgccggcgcgccggactcgttcgagcgcgtggtgagcggggcgctcaagaagctgccctcgcagtcgccgccgccggacagcgtgccggcgtccacggcgctgatcaaggtcatccgccgcgcgcagtccgcgcagaagaagcgcggggactcccacctcgccgtcgaccagctgctgctgggcctcctggaggactcgctaatctccgactgcctcaaggaggccggcgtgtccgcggcgcgggtgcgcgccgagctcgagaagctccgtggcggggagggccgcaaggtggagtccgcgtccggcgacaccaacttccaggcgctcaagacctacggccgcgacctcgtcgagcaggccggtaagctcgaccccgtcattggccgcgacgaggagatccgccgcgtcgtgcgcatcctgtcgcgccgcacgaagaacaaccccgtactcatcggcgagcccggcgtcggcaagacggccgtcgtggagggcctcgcgcagcgcatcgtgcgcggggacgtgcccagcaacctgctcgacgtccgcctcatcgcgctcgacatgggcgcgctcgtcgccggcgccaagtaccgcggcgagttcgaagaacggctcaaggccgtgctcaaggaggtggaggaggccgagggcaaggtgatcctcttcatcgacgagatacacctcgtcctcggcgccgggaggacggagggctccatggacgcggccaacctgttcaagccaatgctcgcgaggggccagctccggtgcatcggcgccacgacgctggaggagtaccgcaagtacgtcgagaaggacgccgcgttcgagaggcggttccagcaggtgttcgtcgcggagccgagcgtcccggacaccatcagcatcctgcgaggcctcaaggagaagtacgaggggcaccacggtgtgaggatccaggaccgcgcgctcgtcgtcgccgcgcagctctcggcgaggtacatcatgggacgccacctgcctgacaaagcgatcgacctcgtcgacgaggcctgcgcgaacgtgagggtgcagctggacagccagccagaggagatcgacaacctcgagaggaagaggattcagctggaggtggagcaccacgcgctggagaaggagaaggacaaggcaagcaaggcccggcttgtcgaggtcaagaaagagctggacgatctgagggacaagctgcagccattgacgatgaagtacaggaaggagaaggagaggatcgacgagatcaggaagctgaagcagcgccgcgaggagctccagttcacgctgcaggaggccgagcgccggatggacctcgcccgcgtcgccgacctcaagtacggcgcgctccaggagatcgacgtcgccatcgcgaagctcgagagcgagacgggggagaacctgatgctcaccgagaccgtcggccccgagcagatcgccgaggtggtgagccgctggaccggcatcccggtgacccggctcggccagaacgacaaggagaggctcgtcggcctcgccgacaggctgcaccagagggtggtcggccaggcggaggccgtgagcgccgtcgccgaggcggtgctgaggtcgcgcgccggacttggccggccgcagcagcccaccggctcgttcctcttcctcggtcccaccggcgtcggcaagaccgagctcgccaaggccctcgccgagcagctgttcgacgacgagaacctgctcgtccgcatcgacatgtccgagtacatggagcagcactccgtcgctcgcctcatcggagcaccacctggctacgtcggccatgaggaaggtgggcagctgacggagcaagtgcggcggcggccgtacagcgtgatcctgttcgacgaggtcgagaaggcgcacgtcgcggtgttcaacactctgctccaggttctcgacgacgggaggctcaccgacgggcaaggccgcacggtggacttcaggaacaccgtgatcatcatgacctccaacctcggcgccgagcacctcctcgccggcatggtcggcaagaactccatgaaggtcgcccgtgaccttgtcatgcaggaggtgaggaggcacttccgtcctgagctcctgaaccggctcgacgagattgtgatattcgatcccctgtcccacgagcaactcaggaaggtcgcccgtctccagatgaaggacgtcgccgtccggctcgccgagaggggtgtcgccctggccgtcaccgacgccgcgctggacgtcattctgtctctgtcctatgatccggtttatggcgcgaggccgatcaggaggtggatcgagaagagggtggtgacgcagctgtccaagatgctgatccaggaggagatcgacgagaactgcacggtgtacatcgacgcggcgccgcacaaggacgagctggcctacagggtggacaaccgcggggggttggtgaacgccgagacggggcagaagtcggacatcctcatccaggtgcccaacggcgccgccaccgggagcgacgccgcgcaggcggtgaagaagatgaggatcatggaggacgaggacggcatggacgaagagtagtaagtagtagagcgcgtatgtgcgtgttgcgcccccgggcagaggcagaggagggcgccgatcgagctgtgtgaatgaatgtggggtgtctccgttgaataagctgtgaaatatggtgtttttccgatg

SEQ ID NO: 1829 - DNA, 2744 bp, Brachypodium distachyon
agcaggcagccatgaatcccgacaacttcacgcacaagaccaacgaggcgctggtggcggcacacgaggcggcgtcggaggccgggcacgcgcagatcacgccgctgcacctggcggcgtccctggcgggggacaagtccgggatcctgcggcaggcgatcgcgcaggcgtccggcggggacccggccgcgggggactcgttcgagcgcgtgctgagcggcgcgctcaagaagcttccctcgcagtccccgccgccggactccgtgccggcgtccacggcgctcatcaaggccatccgccgcgcgcagtccgcgcagaagaagcgcggggactcccacctggccgtcgaccagctgctgctcggcctcctcgaggactcccagatctccgactgcctcaaggaggccggcgtgtcagcgtcccgtgtgcgcgccgagctcgagaagctccgcggcggggacagccgcaaggtcgagtccgcgtccggcgacaccaacttccaggcgctcaagacgtacggccgcgacctcgtggagcaggccgggaagctcgaccccgtcatcggccgcgacgaggagatccggcgcgtggtgcgcatcctgtcgcgccgcaccaagaacaacccggtgctcatcggcgagcccggcgtcggcaagacggccgtcgtggagggcctcgcgcagcggatcgtgcgcggggacgtgcccagcaatctcctcgacgtccgcctcatcgcgctcgacatgggcgcgctcgtcgccggcgccaagtaccgcggcgagttcgaggagcggctcaaggccgtgctcaaggaggtggaggaggccgaggggaaggtgatcctcttcatcgacgagatacacctcgtcctcggcgctggcaggacggagggctccatggacgccgccaacctgttcaagccgatgctcgccaggggccagctccggtgcatcggcgccaccacgctggaggagtaccggaaatacgtcgagaaggacgccgcgttcgagaggcggttccagcaggtgtatgtcgccgagcccagcgtggccgacaccatcagcatcctcagagggctcaaggagaagtacgaaggccatcacggtgtcaggatccaggaccgcgccattgtcgtcgccgcccagctctcgtcaagatacatcatgggccggcacctgcctgacaaggccatcgacctggtagacgaggcgtgcgcgaacgtgagggtgcagctggacagccagccggaggagatcgacaacctcgagcggaagaggattcagctggaggtggagctccacgcgctggagaaggagaaggacaaggccagcaaagcccggctggtcgaggtccggaaagagctcgacgacctgcgggacaagctgcagccactgacgatgaagtacaggaaggagaaggagcggatcgacgagatccggaagctgaagcagcggcgggaggagctgcagttcacgctgcaggaggccgagcggcgcatggacctggcccgcgtcgccgacctcaagtacggcgcgctcatggagatcgatgccgccatcgccaagctggagggggagaccggggagaacctgatgctcaccgagaccgtcggccccgagcagatcgccgaggtggtcagccggtggaccggcatccccgtgacccggctcgggcagaacgacaaggagaggctcgtcggcatggccgaccggctgcacacgagggtcgtcgggcagacggaggccgtgaacgccgtcgccgaggcggtgctgaggtcgcgggccggcctcggcaggccgcagcagcccaccgggtccttcctcttcctcggcccgaccggcgtcggcaagacggagctcgccaaggcccttgcagagcagctgttcgacgacgagaacctgctcgtccgcatcgacatgtccgagtacatggagcagcactccgtcgcccgcctcatcggagcaccacctggctacgttgggcatgaggaaggagggcaactgacggagcaggtgaggaggaggccgtacagcgtgatcctgttcgacgaggtggagaaggcgcacgtggcggtgttcaacacgctcctccaggtgctcgacgacggccggctgaccgacgggcaaggcaggacggtggacttccggaacaccgtgatcatcatgacctccaacctcggcgccgagcacctcctcgccgggatggtggggaagaactccatgaaggtcgctcgcgatctcgtcatgcaggaggtgaggaggcacttccggccggagctgctgaaccggctggacgagatcgtggtgttcgaccctctgtcccatgagcagctcaggaaggtcgcccgtcttcagatgaaggacgtggccgtccgcctcgccgagaggggcatcgccttggccgtcaccgacgccgcgctggacgtcatcttgtccctggcttacgacccagtgtatggggcgaggccgatcaggaggtggatcgagaagagggtggtgacgcagctgtccaagatgctgatccaggaggagatcgacgagaactgcacggtgtacatcgacgcgtcggccaacaaggacgagctggcctacagggtggaccggagcggcgggctggtgaacgccgagacgggacagaggtcggacatcctcatccaggtgcccaacggcgccgtcggcggcggcgaggccgcgcaggccgtcaagaagatgaggatcatggaggaggacggcatggacgaagac

SEQ ID NO: 1830 - DNA, 2764 bp, Brachypodium distachyon
agcaggcagccatgaatcccgacaacttcacgcacaagaccaacgaggcgctggtggcggcacacgaggcggcgtcggaggccgggcacgcgcagatcacgccgctgcacctggcggcgtccctggcgggggacaagtccgggatcctgcggcaggcgatcgcgcaggcgtccggcggggacccggccgcgggggactcgttcgagcgcgtgctgagcggcgcgctcaagaagcttccctcgcagtccccgccgccggactccgtgccggcgtccacggcgctcatcaaggccatccgccgcgcgcagtccgcgcagaagaagcgcggggactcccacctggccgtcgaccagctgctgctcggcctcctcgaggactcccagatctccgactgcctcaaggaggccggcgtgtcagcgtcccgtgtgcgcgccgagctcgagaagctccgcggcggggacagccgcaaggtcgagtccgcgtccggcgacaccaacttccaggcgctcaagacgtacggccgcgacctcgtggagcaggccgggaagctcgaccccgtcatcggccgcgacgaggagatccggcgcgtggtgcgcatcctgtcgcgccgcaccaagaacaacccggtgctcatcggcgagcccggcgtcggcaagacggccgtcgtggagggcctcgcgcagcggatcgtgcgcggggacgtgcccagcaatctcctcgacgtccgcctcatcgcgctcgacatgggcgcgctcgtcgccggcgccaagtaccgcggcgagttcgaggagcggctcaaggccgtgctcaaggaggtggaggaggccgaggggaaggtgatcctcttcatcgacgagatacacctcgtcctcggcgctggcaggacggagggctccatggacgccgccaacctgttcaagccgatgctcgccaggggccagctccggtgcatcggcgccaccacgctggaggagtaccggaaatacgtcgagaaggacgccgcgttcgagaggcggttccagcaggtgtatgtcgccgagcccagcgtggccgacaccatcagcatcctcagagggctcaaggagaagtacgaaggccatcacggtgtcaggatccaggaccgcgccattgtcgtcgccgcccagctctcgtcaagatacatcatgggccggcacctgcctgacaaggccatcgacctggtagacgaggcgtgcgcgaacgtgagggtgcagctggacagccagccggaggagatcgacaacctcgagcggaagaggattcagctggaggtggagctccacgcgctggagaaggagaaggacaaggccagcaaagcccggctggtcgaggtccggaaagagctcgacgacctgcgggacaagctgcagccactgacgatgaagtacaggaaggagaaggagcggatcgacgagatccggaagctgaagcagcggcgggaggagctgcagttcacgctgcaggaggccgagcggcgcatggacctggcccgcgtcgccgacctcaagtacggcgcgctcatggagatcgatgccgccatcgccaagctggagggggagaccggggagaacctgatgctcaccgagaccgtcggccccgagcagatcgccgaggtggtcagccggtggaccggcatccccgtgacccggctcgggcagaacgacaaggagaggctcgtcggcatggccgaccggctgcacacgagggtcgtcgggcagacggaggccgtgaacgccgtcgccgaggcggtgctgaggtcgcgggccggcctcggcaggccgcagcagcccaccgggtccttcctcttcctcggcccgaccggcgtcggcaagacggagctcgccaaggcccttgcagagcagctgttcgacgacgagaacctgctcgtccgcatcgacatgtccgagtacatggagcagcactccgtcgcccgcctcatcggagcaccacctggctacgttgggcatgaggaaggagggcaactgacggagcaggtgaggaggaggccgtacagcgtgatcctgttcgacgaggtggagaaggcgcacgtggcggtgttcaacacgctcctccaggtgctcgacgacggccggctgaccgacgggcaaggcaggacggtggacttccggaacaccgtgatcatcatgacctccaacctcggcgccgagcacctcctcgccgggatggtggggaagaactccatgaaggtcgctcgcgatctcgtcatgcaggaggtgaggaggcacttccggccggagctgctgaaccggctggacgagatcgtggtgttcgaccctctgtcccatgagcagctcaggaaggtcgcccgtcttcagatgaaggacgtggccgtccgcctcgccgagaggggcatcgccttggccgtcaccgacgccgcgctggacgtcatcttgtccctggcttacgacccagtgtatggggcgaggccgatcaggaggtggatcgagaagagggtggtgacgcagctgtccaagatgctgatccaggaggagatcgacgagaactgcacggtgtacatcgacgcgtcggccaacaaggacgagctggcctacagggtggaccggagcggcgggctggtgaacgccgagacgggacagaggtcggacatcctcatccaggtgcccaacggcgccgtcggcggcggcgaggccgcgcaggccgtcaagaagatgaggatcatggaggaggacggcatggacgaagacgtctgaagcaaaaaaagaaa

SEQ ID NO: 1831 - DNA, 3134 bp, Hordeum vulgare
cggcacgagggagcaatcccacaaacgctcggtgatcccaattcccaatcaatcttccaaacgcgacagtccgttcgatcattgtagattgtgagtgcgagcagcagcagcagccatgaatccggacaacttcacgcacaagaccaacgaggcgctggtggcggcgcacgaggcggcgtcggaggccggccacgcgcagatcacgccgctgcacctggcggcggcgctggcggccgacaagtcgggcatcctgcgccaggcggtcgcgggggcgtccggcgggaacgcggccgcgggggactcgttcgagcgcgtgctcaccgccgcgctcaagaagctgccgtcccagtcgccgccgccggactccgtgccggcctccaccgcgctcatcaaggccatccgccgcgcgcagtccgcgcagaaaaagcgcggggactcgcacctcgccgtcgaccagctgctcatgggcctcctcgaggactcgcagatcgccgactgcctcaaggaggccggcgtgtccgcctcgcgggtgcgcgccgagcttgagaagctccgcggcggcgactcgcgcaaggtcgagtccgcctccggcgacaccaacttccaggcgctcaagacgtacggccgcgacctcgtcgaggtggccggcaagctcgaccccgtcattggccgcgacgaggagatccgccgcgtcgtgcgcatcctctcgcgccgcaccaagaacaaccccgtcctcatcggtgagcccggcgtcggcaagacggcggtcgtggagggcctcgcgcagcgcgtcgtgcgcggggacgtgcccagcaacctgctcgacgtccgcctcgtcgcgctcgacatgggcgcgctcgtcgccggcgccaagtaccgcggcgagttcgaggagcggctcaaggccgtgctcaaggaggtggaggaggccgagggcaaggtcatcctcttcatcgacgagatacacctcgtcctcggcgccgggaggacggaggggtccatggacgcggccaacctcttcaagccgatgctcgccagaggccagctccggtgcatcggtgccaccacgctggaggagtaccgcaagtacgtcgagaaggatgccgcgttcgagaggcggttccagcaggtgtacgtcgccgagccgagcgtcgccgacaccatcagcatcctcagagggctcaaggagaagtacgaggggcaccacggagtgcgcatccaggaccgagccatcgtcgtcgctgcgcagctctcggcgaggtacatcatgggccggcacctccctgacaaggccatcgacctggtggacgaggcgtgcgcgaacgtgagggtgcagctggacagccagccggaggagatcgacaacctggagaggaagaggattcagctggaggtggagctccacgcgctggagaaggagaaggacaaggccagcaaggcccggctggtggaggtgaggaaggagctcgacgacctgagggacaagctccagccgctgacgatgaagtacaggaaggagaaggagaggatcgatgagatccgcaagctgaagcagaggcgcgaggagctgcagttcacgctgcaggaggccgagcggcgcatggacctggcccgcgtcgccgacctcaagtacggcgcgctccaggagatcgacgccgccattgccaagctggagggcgagaccggcgagaacctgatgctcacagagaccgtcggcccggagcagatcgcggaggtggtgagccggtggaccggcattcccgtgacccggctcgggcagaacgacaaggagcgtctcgtcggcatggcggacaggctgcacacgagggtggtcgggcagaccgaggccgtgaacgccgtcgccgaggcggtgctgaggtccagggcagggcttgggcggccgcagcagcccaccggctcgttcctcttcttgggcccgaccggcgtgggcaagaccgagctcgccaaggcgctcgccgagcagctgttcgacgacgagaacctgctcgtccgcatcgacatgtccgagtacatggagcagcactccgtcgctcgcctcatcggagcaccacctgggtatgttggacacgaggagggcgggcagctgacggaacaggtgaggaggaggccatacagcgtgatcctgttcgacgaggtggagaaggcgcacgtggccgtgttcaacacgctcctccaggtgctcgacgacggccggctgaccgacgggcaaggcaggactgtggacttcaggaacaccgtgatcatcatgacctccaacctcggcgccgagcacctcctcgccgggatggtgggcaagaactccatgaaggtcgcccgcgacctcgtcatgcaggaggtgaggaggcacttcaggccggagctgctgaaccggctggacgagatcgtggtgttcgacccgctgtcccacgagcagctgaggaaggtcgctcgcctgcagatgaaggacgtggccgtccggctcgccgagcggggcgtcgccctggccgtcaccgacgccgcgctggacgtcatcctgtctctggcctacgatccagtgtatggcgctcggccgatccggaggtggatcgagaagcgggtggtgacgcagctgtccaagatgctgatccaggaggagatcgacgagaactgcaccgtgtacatcgacgccgccaacaaggacgagctggcctaccgggtggaccgcaccggcgggctggtgaacgccgagacgggccagaggtccgacatcctcatccaggtgcccaacggcgccctcgccggcggcggcggcgaggccgccaaggccgtgaagaagatgagggtcatggaggacggggacgaggacggcatggacgaagacgcctgaactctgaagtgaagcccgtgtcggagcgtgcagtggtgcaagtgtgaccttgtgcgtctgtcatcagatatactccataagcgtgaagtagatgagtgagcaagaggcaggcgcttcctgtttatttctggttgctcgtgtgagtgttgggtggttggtttctataagtgtcggctctcagtctcagctggtgaggccttgctaatccatcttctccttccgttccctgtgtttctgatttgattaaggaaacagtttcagaagaaaa

SEQ ID NO: 1832 - DNA, 3096 bp, Triticum aestivum
  misc_feature (753)..(753): n is a, c, g, or t
  misc_feature (771)..(771): n is a, c, g, or t
  misc_feature (1017)..(1017): n is a, c, g, or t
  misc_feature (1026)..(1026): n is a, c, g, or t
  misc_feature (1560)..(1560): n is a, c, g, or t
  misc_feature (1590)..(1590): n is a, c, g, or t
  misc_feature (1794)..(1794): n is a, c, g, or t
tcggcacgagagcaatcccacaaacactcgccgatcccaatcaatcttccaacccaaaatcttgtcagttcgatccattgtagagtgcgagcgcaagcagcagcagcggccatgaacccggacaacttcacgcacaagaccaacgaggcgctggtggcggcgcacgaggcggcgtcggaggccggccacgcgcagatcacgccgctgcacctggcggcggcgctggcggcggacaagtcgggcatcctgcggcaggccgtcgcgggggcgtccggcgggaacgcgtccgcgggggactcgttcgagcgcgtgctctccggcgcgctcaagaagctgccgtcgcagtcgccgccgccggactccgtgccggcctccacggcgctcatcaaggccatccgccgcgcgcagtcggcgcagaagaagcgcggggactcgcacctcgccgtcgaccagctgctcatgggcctcctcgaggacgcgcagatcgccgactgcctcaaggaggccggcgtgtccgcctcgcgggtgcgcgccgagctcgagaagctccgcggcggggacaactcgcgcaaggtcgagtccgcctccggcgacaccaacttccaggcgctcaagacgtacggccgcgacctcgtcgaggtggccggcaagctcgaccccgtcatcggccgcgacgaggagatccgccgcgtcgtgcgcatcctctcgcgccgcaccaagaacaaccccgtcctcatcggcgagcccggcgtnggcaagacggccgtcgtngagggcctcgcgcagcgcgtcgtgcgcggggacgtgcccagcaacctgctcgacgtccgcctcgtcgcgctcgacatgggcgcgctcgtcgccggcgccaagtaccgcggcgagttcgaggagcggctcaaggccgtgctcaaggaggtggaggaggccgacggcaaggtcatcctcttcatcgacgagatacacctcgtcctcggcgccgggaggacggaggggtccatggacgcggccaacctnttcaagccnatgctcgccaggggccagctccggtgcatcggcgccaccacgctggaggagtaccgcaagtacgtcgagaaggacgccgcgttcgagcggcggttccagcaggtgtacgtggccgagccgagcgtcgccgacaccatcagcatcctgcgagggctcaaggagaagtacgaggggcaccacggcgtgcgcatccaggaccgcgccatcgtcgtcgcggcgcagctctcggcgaggtacatcatgggccgccacctgccggacaaggccatcgacctggtggacgaggcgtgcgccaacgtgagggtgcagctggacagccagccggaggagatcgacaatctggagcggaagcggattcagctggaggtggagctgcacgcgctggagaaggagaaggacaaggccagcaaggcccggctggtggaggtgaggaaggagctggacgacctgagggacaagctgcagccgctgaccatgaagtacaggaaggagaaggagcggatcgacgagatccggaagctgaagcagcggcgngaggagctgcagttcacgctgcaggaggcngagcggcgcatggacctggcacgcgtcgccgacctcaagtacggcgccctccaggagatcgacgccgccattgcgaagctggagggcgagaccggcgagaacctgatgctcaccgagaccgtcggccccgagcagatcgcggaggtggtgagccggtggaccggcatcccggtgacccggctcgggcagaacgacaaggagcgnctggtcggcatggcggacaggctgcacacgagggtggtcgggcagacggaggccgtgaacgccgtcgccgaggcggtgctgaggtccagggcggggcttgggcggccgcagcagcccaccgggtcgttcctcttcctgggcccgaccggcgtgggcaagaccgagctcgccaaggccctcgccgagcagctgttcgacgacgagaacctgctcgtccgcatcgacatgtccgagtacatggagcagcactccgtcgctcgcctcatcggagcgccacctggctatgtcgggcacgaggagggcgggcagctgacggagcaggtgaggaggaggccgtacagcgtgatcctgttcgacgaggtggagaaggcgcacgtggcggtgttcaacacgctcctccaggtgctggacgacggccggctgaccgacgggcaaggcaggacggtggacttccggaacaccgtgatcatcatgacctccaacctcggcgccgagcacctcctcgccgggatggtgggcaagaactccatgaaggtcgcgcgcgacctcgtcatgcaggaggtgaggaggcacttcaggccggagctgctgaaccggctggacgagatcgtcgtcttcgacccgctgtcccacgagcagctgaggaaggtcgctcgcctgcagatgaaggacgtggccgtccggctcgccgagcgcggcgtcgccctggccgtcaccgacgccgcgctggacgtcatcctgtcgctggcctacgatccagtgtatggcgctcggccgatcaggaggtggatcgagaagcgggtggtgacgcagctgtccaagatgctgatccaggaggagatcgacgagaactgcacggtgtacatcgacgccgccaacaaggacgagctggcctaccgggtggaccgcagcggcgggctggtgaacgccgagacggggcagaggtccgacatcctcatccaggtgcccaacggcgccctcggcggcggcggcggcgaggcggccaaggccgtgaagaagatgagggtgatggaggacggggacgaggacagcatggacgaggatgtttgaactcttgaagctgaaatgaagcttgctgaagtgcctgtcggatggagtgtgttgatgagttgcggtgaggctctgtgacgcgtgtgtcgtgtggccggaagctgttacggcttcgggaataatcttccttctgtgtttttgtgagtcggttgaaagcgaagagaatagagtgtcttgtgaattgccttccgaattggtcgtttcttgcccaaaaaaatcgtgtacctaagc

SEQ ID NO: 1833 - DNA, 3011 bp, Triticum aestivum
ccacgcgtccgaagacaccaaggcgaatcatccaaccaacgaatcccccccaatcaccattgccagttccgttgcggttaatccgtagctcgcagaagaggaagacatgaatcccgacaagttcacgcacaagaccaatgaggcgctcgcggcggcgcacgagatggcgtccgaggccggccacgcgcagctcacgccgctgcacctcgccgcggcgctcgcggcggacaggtcgggcatcctccgccaggccatcgcccacgcgtccggcggcaacgacgccgcggccgattcgttcgagcgcgtcgcgtccgccgcgctcaagcggctgccctcgcagtccccgccgcccgacaccgtcccggcctccacctcgctggtcaaggccgtccgccgcgcgcagtcggcgcagaagtcgcgcggcgactcgcacctcgccgtcgaccagctgctcatgggcctcctcgaggacccgcagatctccgacgcgctcaaggaggccggtatctccgccgcgcgggtgaaggccgaggtcgagaagctccggggaggcgacaaccggcgcgtggagtccgcgtcgggggacaccaacttccaggccctcaagacgtacggccgcgacctcgtggaggtggcgggcaagctggacccggtcatcggccgcgacgaggagatccggcgcgtggtgcggatcctgtcgcggcgcaccaagaacaaccccgtcctcatcggcgagcccggcgtgggcaagaccgccgtggtggaggggctcgcgcagcgcgtcgtgcgcggcgacgtccccagcaacctcctggacgtgcgcctggtcgcgctggacatgggcgcgctcgtggccggcgccaagtaccgcggcgagttcgaggagcggctcaaggccgtgctcaaggaggtggaggaggccgaggggaaggtgatactgttcatcgacgagatacacctggtgctcggcgccgggcggacggaggggtccatggacgcggccaacctgttcaagccgatgctggcgagggggcagctcaggtgcattggcgcgacgaccctcgaggagtacaggaagtacgtggagaaggacgcggcgttcgagaggcggttccagcaggtgttcgtggcagagcccagcgtccccgacaccgtcagcatactgagagggctcaaggagaagtacgaggggcaccatggtgtgaggattcaggaccgcgcgctcgtcattgccgcgcagctctcgtcgaggtacatcatgggtcgtcatttgcctgataaagcaatcgatttggttgacgaggcctgtgcaaatgtgagggtgcaacttgacagccagcctgaagagattgacaacctcgagaggaagagaatccagttggaagtcgagctccatgccctcgagaaggagaaggacaaggctagcaaagctcggctagttgatgtgaggaaagagttggacgatctgcgagacaagctgcagccgctgcagatgaagtatcgcaaggagaaagagaggatcgacgagatcaggagcctgaagcagcgccgcgaagagctgcagttcactctgcaggaggccgagcgccggatggatttggcccgcgtggctgatctcagatacggtgctctgcaggaggttgacgctgccattgctaagctggagggtgagaccggcgagaacttgatgttaacagagactgtcggcccggaccagattgccgaggtggtgagccgctggactggcattcctgtcaccaggctcggacagaatgagaaggcgaggctgatcgggctggctgatagactgcatcagagggtggttggacagtatgaggccgtcaatgcagtcggagaggctgttttgcggtcgagggctggccttggacggccacagcagcctactggttcattcctcttcctcggaccgaccggtgtcggaaaaaccgagctcgccaaggctctagctgagcagctgtttgatgacgagaacctgctcgtccgcatcgacatgtctgaatacatggagcagcattcggttgcccggctaatcggagccccacctggatatgttggtcatgaagaaggggggcagctgaccgagcaagtgaggaggaggccatacagtgtcatcctcttcgacgaggttgagaaggcgcatgtggcggtgttcaacactctgctccaggtcctggacgatgggcggttgaccgacgggcaaggcaggacggttgattttaggaacacggtgatcatcatgacctcaaaccttggcgcggagcacctcctcgccggaatggtgggcaattcgatgaaggttgctcgtgatctggtcatgcaggaggtgaggaggcatttccgcccggagctgctgaaccgtctggacgagatcgtcatcttcgaccctctgtcgcatgagcagctgcggaaggtcgctcggcttcagatgaaagatgtggcagtccgtcttgccgagaggggcgttgctctggccgtcaccgacgccgccctggacgtcatcctgtcactgtcttacgatccggtctatggcgccaggccaatccggagatggatcgagaagaggatagtgacggagctctccaagatgttgatccgcgaggagatcgacgagaactccacggtgtacatcgacgctgcgcccagcaaggacgagctgacctatggcgtcgacaagcacggagggctggtgaacgcgcgcacgggccacaagtccgacatcctcatccaggttcctagcggagctgttgggggcgatgcggcgcacgccgtgaagaagatgaagatcatgcaggacggcggagaggtggacgacatggaggaagagtagatggaaaccgcatcgattgatccctttctgactgtagttccaagtggctgcaccaggcagtcgtatgagctctgtttttgtttttggaccgtgctgatttaggtagttcggaatcgtatctgttgaattgggggtgaaatgaattgtagttgaggatgaagtg

SEQ ID NO: 1834 - DNA, 2978 bp, Brachypodium distachyon
gaagccatgaatcccgacaagttcacgcacaagaccaatgaagcactcgcggcggcgcacgagatggcgctggatgccggccacgcgcagctcacgccgctgcacctcgccgcggcgctcgcggccgacaggtccggcatcctccggcaggccatcgcccacgcgtccggcggcaacgactccgcggccgaatcattcgagcgcgtcgccgccgccgcgctcaagaggctgccttcgcaggcccctccgccggacgctgtcccaccgtccacctctctggtcaaggccatccgccgcgcgcagtccgcgcagaagtcgcgcggtgactctcacctcgccgtcgaccagctgctcatcggcctcctcgaggactcgcagatctccgacgcgttgaaggaggccggcgtgtcggccgcgcgggtgaaggctgaggtcgagaagctccgcggaggggacaaccgccgtgtggagtccgcttcgggggacaccaatttccaggctctcaagacatacggccgcgacctcgtcgaggtggccggcaagctcgacccggtcatcggccgagacgaggagatccgccgcgtggtgcggatcctgtcgcggcgcacgaagaacaaccccgtcctcatcggcgagcccggcgtggggaagaccgccgtggtggaaggcctcgcgcagcgcatcgtgcgcggggacgtgccgagcaacctcctcgacgtgcgcctcgtcgcgctcgacatgggcgcgctcgtcgccggtgccaagtaccgtggtgaattcgaggagcggctcaaggccgtgctcaaggaggtggaggaggcagaggggaaggtgatactgttcattgacgagatacacctcgtgctcggcgccgggaggacggaggggtccatggatgcggccaacctgttcaagccaatgctcgcgaggggacagcttaggtgcattggcgcgaccacgctcgaggagtacaggaagtacgtcgagaaggatgcggcgttcgagaggcggttccagcaagtctttgtggcagagcccagtgtcaccgacaccgtcagtatactgagagggctcaaggagaagtacgaggggcaccatggtgtaagaattcaggaccgtgcacttgtggtcgccgcgcagctctcgtcaagatacatcatgggtcgtcatttgcctgataaagccatcgatttggttgacgaggcctgcgcaaacgtgagggtgcaacttgacagccagccggaagagattgacaacctcgagaggaagaggatccagctggaagtcgagcttcatgccctcgagaaggagaaggacaaagctagcaaagctcggctaattgaggtcaggaaagagttggacgacttgagggacaagctgcatccgctgcagatgaagtatcgcaaggagaaagagagaatagatgagatcaggaacctgaagcaacgtcgtgaagaactgcagttcactctgcaagaggctgagcgccgaatggatttggcccgcgtggctgacctcagatatggtgctctgcaagagatcgatgttgccattgctaagctagagggggaaactggtgagaacttgatgttaacagagactgttggcccagaccagattgctgaggtcgtgagccgctggactggcattcctgttactaggcttgggcaaaatgagaaggagaggctggtggggctggatgacagactgcaccaaagggttgttggacagcatgaagccgtcagtgcagttgcagaggctgttttaaggtcgagggctggtcttggacggccacagcagcctactggttcattcctctttcttggaccaaccggtgttggtaaaactgagcttgccaaggctcttgctgagcaactgtttgatgatgaaaacctgcttgtccgcattgacatgtctgaatacatggagcagcattcagttgctcggttaattggagcaccacctggttacgtaggtcacgaggaaggagggcaactgacagaacaagtgaggaggaggccatacagtgttatcctctttgatgaggttgagaaggcacatgtagcagtattcaatactctgctccaagtccttgatgatgggaggttaacagatgggcaaggcaggacagttgacttcaggaacaccgtgatcatcatgacttcaaaccttggcgcagagcacctccttgcgggaatgatgggcaactcgatgaaggttgctcgtgatatggtgatgcaggaggtgaggagacatttccgtccagagctactgaaccgtctggatgagattgtgatcttcgaccctctgtcgcatgagcaactgcggaaggtcgctcggtttcaaatgaaagacgttgccgtccgtcttgcagagaggggcattgctttggccgtgactgatgctgcccttgacatcatcctgtcgctgtcttatgatccggtctacggcgctaggccaatcaggagatggattgagaagaggatagtaaccgagctctccaagatgttgatccgcgaagagattgacgagaactccaccgtgtacatagatgccgctcctggcaaggaagaactgacctatagggtcgacaagaatggaggatttgtgaacgtgcagacgggccagaaatctgatatcctgatccaggtacccagtggcgctattgggagcgatgctgcacatgccgtgaagaagatgaagatcatgcaggacggtggagatgtggatgacatggaagaagaataaacaccagaacgattgatttctttctgtagttttaagtggctgcgctgcagcaggcaattgtaagaactgcttttgtgaaaggaccatgcaaatttgctgttcatagaaggttcagaatggtctttatctgttgaaaataggcaacatgcactccttgtaaggacataatgaaatcaaaattgtggatgtgccttcagtaacccagtgtaactctgaggttcttgtcgttc

SEQ ID NO: 1835 - DNA, 3031 bp, Sorghum bicolor
aaaaaaaaaagcaaacgccaagcggatcattggagcgaggaatttgactaacaccttacgaatctcccaatcaccacagcggaaagagcctacgtgatgaatcctaacaagttcacgcacaagacgaatgaggcgctggccttggcgcacaatatcgcctcagaggccgggcacgcccagatcacgccgctgcatctcgcggcggcgctgatcgcagacaggcccggcgtcctccgccaagccatcgcccacgcgtccggcggcaacgacgtcgctgctgccgattccttcgagcgcgtcctggcttccacgctcaagaggctgccctcgcagtcgcctccgccggatactgtcccggcttccaccgcgcttgtcaaggtcatccgccgcgcgcagtccgcgcagaaggtgcgcggggactcccacctcgccgtggaccagttgctggtaggcctcctcgaggatccccaggtctgggatgcactcaaggaggctggcgttgttgcggcgcgggtgaaggccgaggtcgacaagctccgcggcggcgacaaccgccgtgtggagtctgcatctggggacaccagcttccaggcggtcaagacgtacggccgcgacctcgtcgaggtggcgggcaagctcgaccctgtcattggccgcgacgaagagatccgccgcgttgtgcgtatcctgtcgcggcgcacgaagaacaatcccgtactcatcggcgaacccggcgtaggcaagaccgccgtcgtggaggggctcgctcagcggatcgtgcgcggcgatgtcccgagcaacctcctcgacgtgcgcctcgtcgcgctcgacatgggtgccctcgttgccggtgccaaataccgcggcgagttcgaggagcggctcaaggccgtgctcaaggaggtggaagagtcagatgggaaggtgattctattcatcgacgagatacacctcgtcctcggcgctgggaggacggatgggtccatggatgcggccaacctgttcaagccaatgctcgcgagggggcaactcaggtgcattggtgcgacgacgctggaggagtaccggaagtatgttgagaaggatgccgcgttcgagaggcggttccagcaggtgtacgtggccgagcccagcgtttccgacactgtcagtatcctgagaggcctcaaggagaagtatgagggacaccatggtgtcagaatccaggaccgtgcgctcgtcattgccgcgcagctctcgtcaaggtatatcatgggtcgacatctgcctgacaaagctatcgatttggttgacgaggcctgcgcaaatgtgagggtgcagctcgacagccagccggaagagatcgacaatcttgagaggaagaggattcaactcgaagtcgagctccacgccctcgagaaggagaaggacaaggccagcaaagctcggctagttgaggtgaggaaagaattggacaatttgagggacaaactgcagccgctgcaaatgaggtaccgcaaggagaaagagaggatagatgagatcaggaagctgaagcatcgtcgtgaagaacttctgttcagcctccaagaggctgagcggcggatggatttggctcgtgtggctgacatcagatatggtgctctccaggagattgatgctgccattgccaagctagagggtgagactggagagaacttgatgcttactgagactgttggcccagagcagatagctgaggtggtgagccgctggactggcattccagtgactaggcttggacagaatgataaggagaggctggttggactggccgataggcttcatcgaagggtcattggacagcatgaagccgtcaatgctattgcagaggctgttctgaggtccagggctggtcttgggcggacacagcagcctactggctcattcctcttccttggaccgactggtgtaggcaagactgaacttgccaaggctcttgctgagcagctgtttgatgatgagaagttgcttgttcgccttgatatgtctgaatatatggagaaacattcagtttctcgactaattggtgcaccacctggctatgttggccatgaggaaggagggcaacttactgaacaagtgaggaggaggccgtacagtgttattctctttgatgaggttgagaaggcacatgtggcagtgtttaacactctgctccaggttctagatgatggaaggttgactgacggtcaaggcaggacggtcgacttcaggaacactgtgattatcatgacctcaaacattggcgctaagcacctccttgccgggatggtgggcaataactcgatgaaggctgctcgcgatctggttatgctagaggtgaggaagcatttccgtcccgagctgctgaatcgtctggatgagatcgtgatcttcgatcccttgtcccatgaacaattgaggatggtcgctcggctgcaggtgaaagaggtggcctaccgtcttgccgaaaggggtgttgccttggctgtgactgatgctgcattggacttgatcttgtcactctcttatgatccggtctatggtgccaggcccatcaggagatggattgagaagaaagtagtgacggagttgtccaagatgttgatcaaggaagagatagatgagaactccacggtgtccatagacgcttctcccagcaaagatgaactgatttacaaggttgacatgaacggaggactggtgaatgcgcagacagggcacaagtctgacatcctgatccaggttcctaatggaggtatcaacggtggggcagcacacactgtgaagaagatgaggttgatggaggatgaccaggacgatgatgacatggaagaagagtgactgggaaattttgcgacatagttgtagacaatttagtatagatcttagatgccccgagacgaactagttgaaggtgcagaagtgccaaccccagcttgtgtagatgaaagtgaactagtttgagatgtaatcgaatcctggaccttaagattccatcacatttcattccagttgtgttggttgtcta

SEQ ID NO: 1836 - DNA, 2993 bp, Sorghum bicolor
aaaaaaaaaagcaaacgccaagcggatcattggagcgaggaatttgactaacaccttacgaatctcccaatcaccacagcggaaagagcctacgtgatgaatcctaacaagttcacgcacaagacgaatgaggcgctggccttggcgcacaatatcgcctcagaggccgggcacgcccagatcacgccgctgcatctcgcggcggcgctgatcgcagacaggcccggcgtcctccgccaagccatcgcccacgcgtccggcggcaacgacgtcgctgctgccgattccttcgagcgcgtcctggcttccacgctcaagaggctgccctcgcagtcgcctccgccggatactgtcccggcttccaccgcgcttgtcaaggtcatccgccgcgcgcagtccgcgcagaaggtgcgcggggactcccacctcgccgtggaccagttgctggtaggcctcctcgaggatccccaggtctgggatgcactcaaggaggctggcgttgttgcggcgcgggtgaaggccgaggtcgacaagctccgcggcggcgacaaccgccgtgtggagtctgcatctggggacaccagcttccaggcggtcaagacgtacggccgcgacctcgtcgaggtggcgggcaagctcgaccctgtcattggccgcgacgaagagatccgccgcgttgtgcgtatcctgtcgcggcgcacgaagaacaatcccgtactcatcggcgaacccggcgtaggcaagaccgccgtcgtggaggggctcgctcagcggatcgtgcgcggcgatgtcccgagcaacctcctcgacgtgcgcctcgtcgcgctcgacatgggtgccctcgttgccggtgccaaataccgcggcgagttcgaggagcggctcaaggccgtgctcaaggaggtggaagagtcagatgggaaggtgattctattcatcgacgagatacacctcgtcctcggcgctgggaggacggatgggtccatggatgcggccaacctgttcaagccaatgctcgcgagggggcaactcaggtgcattggtgcgacgacgctggaggagtaccggaagtatgttgagaaggatgccgcgttcgagaggcggttccagcaggtgtacgtggccgagcccagcgtttccgacactgtcagtatcctgagaggcctcaaggagaagtatgagggacaccatggtgtcagaatccaggaccgtgcgctcgtcattgccgcgcagctctcgtcaaggtatatcatgggtcgacatctgcctgacaaagctatcgatttggttgacgaggcctgcgcaaatgtgagggtgcagctcgacagccagccggaagagatcgacaatcttgagaggaagaggattcaactcgaagtcgagctccacgccctcgagaaggagaaggacaaggccagcaaagctcggctagttgaggtgaggaaagaattggacaatttgagggacaaactgcagccgctgcaaatgaggtaccgcaaggagaaagagaggatagatgagatcaggaagctgaagcatcgtcgtgaagaacttctgttcagcctccaagaggctgagcggcggatggatttggctcgtgtggctgacatcagatatggtgctctccaggagattgatgctgccattgccaagctagagggtgagactggagagaacttgatgcttactgagactgttggcccagagcagatagctgaggtggtgagccgctggactggcattccagtgactaggcttggacagaatgataaggagaggctggttggactggccgataggcttcatcgaagggtcattggacagcatgaagccgtcaatgctattgcagaggctgttctgaggtccagggctggtcttgggcggacacagcagcctactggctcattcctcttccttggaccgactggtgtaggcaagactgaacttgccaaggctcttgctgagcagctgtttgatgatgagaagttgcttgttcgccttgatatgtctgaatatatggagaaacattcagtttctcgactaattggtgcaccacctggctatgttggccatgaggaaggagggcaacttactgaacaagtgaggaggaggccgtacagtgttattctctttgatgaggttgagaaggcacatgtggcagtgtttaacactctgctccaggttctagatgatggaaggttgactgacggtcaaggcaggacggtcgacttcaggaacactgtgattatcatgacctcaaacattggcgctaagcacctccttgccgggatggtgggcaataactcgatgaaggctgctcgcgatctggttatgctagaggtgaggaagcatttccgtcccgagctgctgaatcgtctggatgagatcgtgatcttcgatcccttgtcccatgaacaattgaggatggtcgctcggctgcaggtgaaagaggtggcctaccgtcttgccgaaaggggtgttgccttggctgtgactgatgctgcattggacttgatcttgtcactctcttatgatccggtctatggtgccaggcccatcaggagatggattgagaagaaagtagtgacggagttgtccaagatgttgatcaaggaagagatagatgagaactccacggtgtccatagacgcttctcccagcaaagatgaactgatttacaaggttgacatgaacggaggactggtgaatgcgcagacagggcacaagtctgacatcctgatccaggttcctaatggaggtatcaacggtggggcagcacacactgtgaagaagatgaggttgatggaggatgaccaggacgatgatgacatggaagaagagtgactgggaaattttgcgacatagttgtagacaatttagtatagatcttagatgccccgagacgaactagttgaaggtgcagaagtgccaaccccagcttgtgtagatgaaagtgaactagtttgagatgtaatcgaatcctggaccttaag

SEQ ID NO: 1837 - DNA, 2881 bp, Cucumis sativus
gtttttttcgcggatatgaatcctgataaattcacccacaagaccaatgaggctctagctggagctcatgaattggcattgaattctggccatgctcaattgacaccgcttcatttggcggttgctttggtttctgatccgagtgggatattgagccaagcgattgctagttccggcggtgaaaatgctcataaagaagtggagacggttttcaagcgggcgttgaagaagctaccatctcaatctcctgcacctgatgaagtgccggcgagtactactctgattaaggtgattcgaagagcacaagctgcgcagaaatcgcgaggagacacgcatttagccgttgatcaattggttcttggccttctggaggattctcagattggggatttgcttaaggaagctggtgtcaccactgcgaaagttaaatctgaggtcgagaaacttcgtggaaaagaaggaaagaaagtggagagtgcatctggagacacaaccttccaggcactcaagacttatggacgagacctggtagaacaagcggggaaactcgacccagttattggccgtgatgaggaaattcgtagagtcgtgaggattttatcaagaagaactaagaataacccagttcttattggggagcctggtgttggtaaaactgcagtggttgaaggattagcccagcggattgtaagaggagatgtcccaagtaatcttgctgatgtgaggctcatagctttggatatgggtgctctggtggcaggggctaagtacagaggagaatttgaagagagattgaaggcagtattgaaggaggttgaagatgcagaagggaaagtcatattgtttattgacgagattcatcttgttcttggtgctggaagaactgaagggtctatggatgctgccaatcttttcaagccaatgctggctagagggcagttacgttgcattggggcaactactcttgaagagtacaggaagtatgttgagaaggatgcagcattcgagagaaggtttcaacaagtttatgtggctgaaccgagtgtgcctgacactatcagtattcttcgaggattgaaagagagatacgaaggtcaccatggtgttagaattcaagaccgagctcttgtcgttgcagcacagctatcgagtcgatatattactgggcgacaccttcctgataaggcaattgatttagttgatgaagcttgtgcaaatgtgagagtccagctcgatagccagcctgaagaaattgataacttggagaggaagcgaatgcagcttgaagttgaacttcatgctcttgaaaaggagaaggacaaggctagtaaagctcgtcttgttgaagtgaggagagagcttgatgatttgagagataagcttcaacctttgttgatgaaatatcgcaaggagaaagaaaggattgatgagattagaagacttaaacaaaggagggaggaactacaaatagctttgcaagaggctgagaggagatatgatttggcaagggctgctgatttgcgatatggagcaatccaagaagtagaatctgcaatagcacggatcgaagggaacaccgatgagaacctgatgttaactgaaactgttggaccggaacaagtagccgaagtggtgagccgctggactggaatacctgtcacaaggctcggccagaatgataaagagagacttgtcgggcttgctgacagactgcacaagagagtcgtggggcagaatcaagctgtggatgctgttgctgaggctgttctacgatcaagagccggattgggaaggccgcaacagccaactggatctttcttgttcctgggtccaaccggtgttggcaaaaccgagcttgcaaaggcgctcgctgagcaactttttgatgatgaaaacctcctggtgaggattgacatgtctgaatatatggagcaacactcagtttcacgcctcattggtgctcctcctgggtatgttggacatgaggaaggagggcaactcaccgaggcagtaaggcggaggccttacagtgttattctgtttgatgaagtggagaaagctcacatcgctgtcttcaacactcttctccaagttttagacgacggaagactgactgatggccaaggccgcactgtagattttagaaacacggtcattatcatgacttcaaatcttggagctgaacatctccttgctggattaatgggcaagtgcacgatgcaagttgctcgtgatagagtcatgcaagaggtgcggaaacacttcaggccagagttgcttaatcgtcttgacgaaatagttgtattcgatccactctcacacgaacagctgaggaaagttgctaggctgcaaatgaaagatgttgctgctcgcctggccgagagaggcgttgcattggctgtaaccgatgcggccctcgactatgtcttagcagagagctacgatccagtgtatggtgccagaccaataagaagatggctggagaaaagggtggtgacggaactgtccagaatgttgatcaaagaagaaatcgatgagaattcaactgtgtacatagatgcagcggctgatgggaatagcttggcgtatagagtggagaagaacggtggttttgttgatgcagcgactggcaaaaaatctgatgttttgattcaaatcaacaatgttccaagaagtgatgctgctcagactgtgaagaagatgaagatcgaagaaactgatgaagatgaaatggaagagtgatttgatgggggttctctgtgaaagagtttgccatcataatctgtgtttttttcttcttttttgtgttttgataaaccaacaagtgtacttaatgtctgtggaaagttgttcaagtaaataaaaaggtttttcttccttc

SEQ ID NO: 1838 - DNA, 3058 bp, Vitis vinifera
cgcatacgaagtcgagcgtcttcagcgcttttcttttcagttcttcacaaagtttttgtaggtaacaagaagctaaagaatgaatccagagaaattcacccacaagacaaatgagactcttgctggggctcatgagcttgctatgaactctggccatgctcagctcacaccacttcacgttgctgtggctttgataactgatcccaatggcatcctccggcaagccataatcggtgctggtggaaatgaggaggctgccaactctgttgaaagagtcttcaataaagctctgaagaaactcccatctcagagtcctcctccagatgaaatcccagtaagcactactctaatcaaagtggttcgaagagcccaatcttcacaaaagtcacggggtgacacccatttagcagttgatcaattgattcttggccttcttgaggattcccaaattggtgatttgcttaaagaagccggggttagtacttctagagtgaaatctgaggttgagaagcttcgagggaaagaaggtaagaaggtggaaagtgcttctggggacaccacattccaggcattgaagacttatgggcgtgaccttgttgagcaagctggaaagcttgatcctgtcattggccgggacgaagagattcggagggtcatcaggattctttcaaggaggaccaagaacaaccctgttcttattggagaaccaggtgtgggtaagactgctgttgttgaaggattagctcagagaattgtaagaggggacgttcccagtaatctcgctgaagtgaggcttatagcattggatatgggtgctttggttgctggggcaaaatatagaggagaattcgaggagaggttgaaatctgttttgaaagaagtggaagaggcagaagggaaagtgattttattcattgatgaaattcaccttgttcttggtgctggtcggactgaaggatctatggatgctgctaacttgtttaagcccatgcttgccagaggtcagctacgctgcatcggagcaacgacccttgaggaatacagaaagtatgttgagaaagatgccgcttttgagaggcggttccagcaagtttatgtagctgagcccagcgtccctgacacaataagcattcttcgagggctaaaagaaaggtatgaagggcatcatggtgttcgaattcaggaccgagctcttgtagttgcagcccaactatcaagccgatacatcactggccgacatctgccagacaaggcaatcgacctggttgatgaagcttgcgccaatgtgagagttcaacttgatagccagcccgaagaaatcgacaatttggaaaggaagagaatgcaattagaagttgaacttcatgctcttgaaaaggagaaggacaaagccagtaaagctcgtcttgttgaagtccgcagagagcttgacgacttgagggacaagcttcaacccttgatgatgaagtacaaaaaggagaaagaaaggattgatgagcttcgcaggctaaaacagaaaagagaggagctcttgtttgctttacaagaggctgaaagaagatatgatttagccagagctgctgatttgcgatatggggcaattcaagaagtggaggctgctatagcaaaccttgaaggaaccactgatgagaacatgatgttaacggagactgttgggcctgagcagattgctgaggtggtgagccgctggactggcatccctgtcactaggcttggacaaaatgataaagaaaggttaattgggcttgcggagaggctgcatcagagagtggtgggacaggatcaggcagtcagtgctgtggcagaggctgtcttgagatcgagggctgggttaggaaggccacaacaacccactggttcgttcctcttcttgggtccaactggtgttggtaagactgagcttgccaaggccctggctgaacagctctttgatgatgaaaatcttttggtgagaattgacatgtccgagtatatggagcagcattcagtttcaagattgattggggctcctcctggatatgttggacatgatgaaggtgggcaactcacagaggcagtaagaaggaggccttatagtgttgtactgttcgatgaagtagagaaagcacatatcgccgtattcaataccctcctccaggttttagacgatggaaggttaactgatggccaaggccgcactgtagacttcacaaacacagtgatcatcatgacttcaaaccttggagctgagcatctcctctcgggtttagtaggcaagtgtacaatgcaagatgctcgtgaccgggtgatgcaggaggtgagaaggcacttcaggccagagttgcttaaccggctggatgaaattgtggtatttgatcccctctcacatgatcaactgagaaaggttgccaggctacaaatgaaggacgttgcaagccgcttggcagagaggggcattgctctggctgtgactgatgcagcattggatgttgttctagcagagagttatgatccggtttacggtgcaagacccattaggagatggctggagaagaaggtggtgactgagctatcaaagatgctcataagggaggagatcgatgaaaactcaactgtttatatagatgcgggagtgtcaggaaaggggttggcgtaccgagtagaaaacaatggggggctggtgaatgcatccaccggacaaaagtcagacgtgttgattcggatcccaaacgggccaagaagcgatgctgcccaagcggtgaagaagatgaagatcgaagaaatagaagacgaagaggatgagatggatctataaataaaagttttgtgggcttgcgagtagaaggtgtatggtttggcttggtgtgtgttttttttgtaatttgaattttgtaagtgctaaaatggggatctttcccttttgtgtacagatgcagtgacctgtaattggtctgctctgtttttgttaccaagttcaagttttcaagatcatcaatcgttcaccaataattcatcgttacttattatttaatgatttaaaaatatatttttcttcata

SEQ ID NO: 1839 - DNA, 2918 bp, Castanea mollissima
tttcaaaataatttccttcttttctttgaaacaaaaacaaacaattttgttgcttgacagatttcagagattacaaaaccagaatagcggaaaaatcttcttcgcaaagagcaagttctacatacccatcaacgaatttcagtatctctctgctaaaaagtctttataggtgctaagaagcaaaaaagatgaatcctgagaagaacacccacaagaccaatgagactttactcgctgctaatgagctagcaacgactggtgggcattcccagttcactcctctccatcttgctcttgctttgatctccgatgctaatggcatcttcaaacaagcaattgccaatgctggtggtgaagatgccaccaaggcagtggagagagtgttcagccaggcattgaagaaactcccatctcagtctcctcccccagatgaggttccagccagcacaagtctaatcaaagtattgcgccgtgcccaagcagcgcaaaaaacacgtggggacacgcatttagctgttgatcagctgattcttggccttcttgaggattctcaaattggggacttgttgaaagaagccggtgttcctgcggcgaaagtgaaatcagaggtcgagaagcttcgtgggaaggaaggaaggaaggtggagagcgcttctggggataccaattttcaggctttgaagacttatggaagggaccttgttgaggtggcaggaaagcttgatccagtcattggcagagatgaggagataaggagagttgttcgaattctctcaaggagaactaaaaacaatcctgtccttattggagagcctggtgttggtaaaactgctgtggtggagggtttggctcaaaggattatgagaggtgatgtccctagtaatcttgctgaagtaagactcatagcattggatatgggagcattgatagctggagcaaagtataggggtgagtttgaagagagattgaaggctgtattgaaagaagttgaagaggctgagggaaaagttatacttttcattgatgaaattcaccttgttcttggtgctggtagaactgaagggtctatggatgctgcaaacctcttcaaaccaatgcttgcgagagggcagctaaggtgcattggtgcaaccacacttgaggagtataggaaatatgtggagaaagatgctgcatttgagagaaggttccaacaggtgtatgtggcagagcctagtgttgctgacacaataagtatccttcgaggtttgaaagagaagtatgaaggtcatcacggtgtgaggattcaggacagggctcttgttgttgcagcccagctctcaagccgttacatcacagggcgtcatctccctgataaggcgattgatttggtggatgaagcatgtgcaaatgtgagagtccaacttgatagccagcctgaagaaattgataaccttgagaggaagcgaatacagctcgaagttgaacttcatgcgctcgaaaaggagaaggataaagctagtaaagcccgtcttgttgaagtacggaaagagcttgatgatttaagggacaagcttcaacctttgatgatgaaatataaaaaggagaaagaaaggattgatgagcttagacgactaaagcagaagcgagaagagctcttgtttgctgtacaagaggctgaaagaagatatgatttagctagagttgctgacttgaaatatggggcaatccaggaattggaagctgctatagcacggcttgaaggaaacgctgatgataacttgatgttaacagaaactgttggcccagagcatattgcagaggttgtcagccgctggactggcatacctgtcacaaggctaggccagaatgagaaggctaggttaattggtctagctgagaggttgcacaagagagtagttggacaggatcaagcagttggtgctgttgctgaggcagtattgaggtccagggctgggttaggaaggcctcaacaaccaacaggctcattcctattcctaggtccaactggtgttggcaaaactgaacttgcaaaggctcttgctgagcaactctttgatgatgaaaatctgttggtgaggattgacatgtctgagtatatggagcaacactcagtttcacggttaattggtgctccaccagggtatgttggacatgaggaagggggacagctcacagaggccgtgaggcgcaggccttatagtgtagtactctttgatgaagtggaaaaggcacacatctctgtatttaatactctgctccaagttttagatgatggaaggttaaccgatggccaaggccgtaccgttgattttaggaacactgtgattatcatgacatcaaaccttggagcagagcacctactttctggactaatgggcaaggtctcaatgcaagttgcacgtgatcatgtaatgcaggaggtaaggaagcacttcaggccagagttgctaaataggctggacgagattgtggtatttgatcctctctcacatgagcagctgagaaaggttgctcggttacaaatgaaggacgttgcaagtcggcttgctgagaggggagttgccttggctgtaactgacgctgctttggacgttgtattagcggaaagttatgatccggtttatggtgctagacctatcaggaggtggctggagaagaaggttgtgacagagctgtcaaaaatgcttataagggaagaaattgatgaaaactcaactgtgtacatagatgctgggcctaatgggagtggattggcgtataaggtggagaagaatggagggttggttaatgcagccactggtcaaaaatcagatgttttgatccaaatccctaatggggcaagaagtgatgctgctcaggcagtaaagaagatgaagatagaagaaattgatgatgatgatgatgagatggatggg

SEQ ID NO: 1840 - DNA, 2590 bp, Brachypodium distachyon
gaagccatgaatcccgacaagttcacgcacaagaccaatgaagcactcgcggcggcgcacgagatggcgctggatgccggccacgcgcagctcacgccgctgcacctcgccgcggcgctcgcggccgacaggtccggcatcctccggcaggccatcgcccacgcgtccggcggcaacgactccgcggccgaatcattcgagcgcgtcgccgccgccgcgctcaagaggctgccttcgcaggcccctccgccggacgctgtcccaccgtccacctctctggtcaaggccatccgccgcgcgcagtccgcgcagaagtcgcgcggtgactctcacctcgccgtcgaccagctgctcatcggcctcctcgaggactcgcagatctccgacgcgttgaaggaggccggcgtgtcggccgcgcgggtgaaggctgaggtcgagaagctccgcggaggggacaaccgccgtgtggagtccgcttcgggggacaccaatttccaggctctcaagacatacggccgcgacctcgtcgaggtggccggcaagctcgacccggtcatcggccgagacgaggagatccgccgcgtggtgcggatcctgtcgcggcgcacgaagaacaaccccgtcctcatcggcgagcccggcgtggggaagaccgccgtggtggaaggcctcgcgcagcgcatcgtgcgcggggacgtgccgagcaacctcctcgacgtgcgcctcgtcgcgctcgacatgggcgcgctcgtcgccggtgccaagtaccgtggtgaattcgaggagcggctcaaggccgtgctcaaggaggtggaggaggcagaggggaaggtgatactgttcattgacgagatacacctcgtgctcggcgccgggaggacggaggggtccatggatgcggccaacctgttcaagccaatgctcgcgaggggacagcttaggtgcattggcgcgaccacgctcgaggagtacaggaagtacgtcgagaaggatgcggcgttcgagaggcggttccagcaagtctttgtggcagagcccagtgtcaccgacaccgtcagtatactgagagggctcaaggagaagtacgaggggcaccatggtgtaagaattcaggaccgtgcacttgtggtcgccgcgcagctctcgtcaagatacatcatgggtcgtcatttgcctgataaagccatcgatttggttgacgaggcctgcgcaaacgtgagggtgcaacttgacagccagccggaagagattgacaacctcgagaggaagaggatccagctggaagtcgagcttcatgccctcgagaaggagaaggacaaagctagcaaagctcggctaattgaggtcaggaaagagttggacgacttgagggacaagctgcatccgctgcagatgaagtatcgcaaggagaaagagagaatagatgagatcaggaacctgaagcaacgtcgtgaagaactgcagttcactctgcaagaggctgagcgccgaatggatttggcccgcgtggctgacctcagatatggtgctctgcaagagatcgatgttgccattgctaagctagagggggaaactggtgagaacttgatgttaacagagactgttggcccagaccagattgctgaggtcgtgagccgctggactggcattcctgttactaggcttgggcaaaatgagaaggagaggctggtggggctggatgacagactgcaccaaagggttgttggacagcatgaagccgtcagtgcagttgcagaggctgttttaaggtcgagggctggtcttggacggccacagcagcctactggttcattcctctttcttggaccaaccggtgttggtaaaactgagcttgccaaggctcttgctgagcaactgtttgatgatgaaaacctgcttgtccgcattgacatgtctgaatacatggagcagcattcagttgctcggttaattggagcaccacctggttacgtaggtcacgaggaaggagggcaactgacagaacaagtgaggaggaggccatacagtgttatcctctttgatgaggttgagaaggcacatgtagcagtattcaatactctgctccaagtccttgatgatgggaggttaacagatgggcaaggcaggacagttgacttcaggaacaccgtgatcatcatgacttcaaaccttggcgcagagcacctccttgcgggaatgatgggcaactcgatgaaggttgctcgtgatatggtgatgcaggaggtgaggagacatttccgtccagagctactgaaccgtctggatgagattgtgatcttcgaccctctgtcgcatgagcaactgcggaaggtcgctcggtttcaaatgaaagacgttgccgtccgtcttgcagagaggggcattgctttggccgtgactgatgctgcccttgacatcatcctgtcgctgtcttatgatccggtctacggcgctaggccaatcaggagatggattgagaacgaggatagtaaccgagctctccaagatgttgatccgcgaagagattgacgagaactccaccgtgtacatagatgccgctcctggcaaggaagaactgacctatagggtc

SEQ ID NO: 1841 - DNA, 3025 bp, Glycine max
ctctaagcaattattgtatacattctcttctctctcccttttctcatcacacactaacttgctttcgaggttttcttcttctttctcgaattttcacataccgaacttctcgtctttcacatctccaggtttgaaatgaatcctgagaagtttactcacaagactaatgaagctcttgcgtcggcccacgagctcgcgatgagttcaggccacgcgcaattgactcccatccacttggcccacgcgctgatttccgatcccaacggcatcttcgtgctagcgataaacagcgcgggcggcggcgaggaatcggcacgcgccgtggagcgagtgttgaaccaggctctgaagaagctaccctgccagtcccctccgccggacgaggtgccggcgagcaccaacctcgtgagggccatcaggagagcacaggcggcgcaaaaatcacgtggcgacacgcatttggccgttgatcagttgatcctcggaatcctcgaagactcccaaatcggagacctgttgaaggaagcgggggttgcggtggcgagggtaaaatcggaagtggataagcttcgtgggaaggaagggaagaaggttgagagcgcttccggggatacgaatttccaagctttgaagacttatgggcgtgaccttgttgaacaagcggggaagcttgaccctgttattggccgtgacgaagagattagaagggttgtgaggattctatcacggaggactaagaacaacccggttctcattggagaaccgggtgtgggaaaaactgcggttgtggaagggttggcacagaggatagtaagaggggatgttccaagcaaccttgctgatgtgaggcttattgcgttggatatgggggcgttggtcgcgggtgccaagtatagaggcgagtttgaggagcggttaaaggctgttttgaaggaagtggaggaggctgaggggaaggtgatactcttcattgatgagattcatttggtccttggtgctggtagaactgaaggctccatggatgctgctaatctattcaaacctatgcttgctcgcggccagcttaggtgcattggtgccaccacgcttgaggagtacaggaagtatgtggagaaggatgctgcattcgagaggaggttccaacaggtttttgtggcggaacctagtgtggttgataccattagcattcttcgtggcttgaaagagagatatgaaggccatcacggtgttagaattcaggaccgtgctttggttatggcagctcaattgtctaaccggtatataactgggcgtcatcttcctgacaaggcaattgatttggttgacgaggcttgtgcaaatgttagggttcaacttgatagtcagcctgaggaaattgataaccttgaaaggaagagaatgcagctagaagtggaacttcatgctctggagaaagagaaagacaaggctagcaaagcccgtcttgttgaagtgcggaaagaacttgatgacttgagggacaagcttcagcctttgatgatgaagtaccgaaaagagaaagagagggttgatgagattcgaaggctcaagaagaaaagagaagagcttctttttgctttacaagaggctgagagaagatatgatctggctagagctgcagacctgcgatatggagcaattcaagaggtggaaactgcaatacaacaacttgaagggagcactgaagagaatctgatgttgactgaaactgttggaccggagcaaatagctgaggttgtgagccgctggaccggtataccagttacaaggcttggccaaaatgaaaaagaaagattgattggacttggtgacagattgcacagcagagttgtaggacaagaccaagctgttaatgctgttgctgaggctgtgttgagatctagagctgggctaggaagacctcaacaaccaactggttcattcctattccttggtccaactggtgttggtaaaactgagcttgcaaaggctcttgctgagcaactatttgataatgaaaaccagttggtgagaattgatatgtccgaatacatggagcagcactcggtttcaagattgattggtgcaccaccagggtatgttggacatgaggaaggtggacaactaactgaagccgtaaggcgaagaccttacagtgtggtgctttttgatgaagtggaaaaggcacatacatctgtgttcaatactcttcttcaagttttggacgatgggaggttaactgatggacaaggccgtactgtggactttagaaacactgtaattatcatgacctcaaatcttggagcagagcacctcctcagtggactttcaggaaaatgtaccatgcaagttgctcgggatcgggtaatgcaggaggtgagaaggcaatttaggccagaattgctgaatcgacttgatgaaattgtggtatttgaccccctttcacatgaccaattgaggaaggttgcaaggctacaaatgaaggatgtagctagtcgtcttgctgagaaaggaattgccttggcagtcactgatgcagcactagactatatacttgccgagagctatgatccggtgtatggtgctagaccaataaggaggtggcttgagaagaaggtggtgacagagttgtctagaatgcttgtaagagaggagattgatgagaattcaacggtttacatagatgctggacccaatgggggcgagttggtctaccgtgtagaaaagaatggaggggttgttaatcctacaactgggcagaagtccgatatcttgattcagatacctaatggacatgcacctaaaactgatgctgttcaagcagtcaagaagatgaagattgaggaaattgatgatgatgaaatggaagagtgaattttatgataaaatgtaattagtttgatggcgcaagctcctcttgaacttccttctttgtcttttatgtgttttgaatgggtgtgagtgaaaattgaagaagtcccttgtaacacctgctttttgtctgatcaataaattttctttctgtaaa

SEQ ID NO: 1842 - DNA, 3317 bp, Lotus japonicus
cggagaagtctagtagcttctggacttgtggcgcattcactgagaaacctcgagaaacattcagacgcatcgtctccgttaacaaatacaagcacctctcgtttccactctcaccgcttcaatcaaacaacgcacaaatcttcattctcacaccgccatcactcactcgtttgctttcctggtacccttttctcgctagcaagacctttcatctttcacaaacaaagttttggaaatgaatcctgacaaattcacccacaagacaaatgaagctcttgctggggctcatgaactggcaatgagttctggacatgctcagatgactcctctgcacctagcaagcaccttgatttctgaccctaatggcattttcttccaagcaatttccaattccagtggagaagaatctgcacgtgctgtggagagggttttgaaccaggctttgaagaagttaccttctcagtcccctcctcctgatgagattccggcgagcacgacgcttattaaggccattcggagagcacaggcggcgcagaagtccaggggtgatacacatttagcagtggatcagttgattttgggcattcttgaggattctcaaattggtgacttgttgaaggaagctggtgtggctgctgctaaggttaaatcagagcttgacaagcttcgtgggaaggtagggaagaaggttgagagtgcatctggtgatactacttttcaggctttgaagacttatgggagagaccttgtggagcaagcagggaagcttgatccagtaattgggcgtgatgaggagataagaagggttgtgaggattttgtcaaggaggactaagaataacccggttctgattggagagcctggtgttggtaaaactgctgtggtggaaggcttggcacagaggattgttagaggggatgttcccagcaatctttctgatgttaggcttattgcattggacatgggtgctttggttgctggtgctaagtataggggagaatttgaggagaggttgaaggcagttttgaaagaagtggaggaggctgaggggaaagttattctgttcattgatgaaattcatctggttcttggtgctggtaggactgaaggatcgatggatgctgccaacctttttaagcctatgcttgctcgcggccagcttaagtgtatcggtgccacaacgctcgaggagtataggaagtatgtggagaaggatgcagcatttgaaaggaggttccaacaggtttatgtggctgaacctagtgtgcctgacaccattagcatccttcgtggactaaaagagaggtatgaaggtcatcatggtgttcggattctggaccgtgctcttgttgtggcagctcaattgtctagtcggtacattacagggcgtcatcttcctgataaggcaattgatttagttgatgaggcttgtgcaaatgtgagagttcaacttgatagccagcctgaggaaattgataaccttgaaaggaagagaatgcagttggaagttgaacttcatgctttggagaaagagaaggacaaagctagtaaagctcgccttgtaaatgtgaggagagaacttgatgacttgagagacaagcttcaacctctgatgatgaagtatagaaaagagaaggagagggttgatgagattcgaaggctcaagcagaaaagagaagagcttctctttgctgcacaagaggctgaaagacgatacgatctagccagagctgctgacctgcgatatggtgcaattcaagaggtggaatctgcaattcagcagctcgaagggagcactgatcaggagaacttaatgttgacagaaactgttggtccagatcaaatatctgaggttgtgagccgctggaccggtattccagtgacaaggcttggccaaaatgagaaagaaaggttgattggacttggtgatagactgcacaacagagttgtagggcaagaccaggctgttaatgctgttgctgaggctgtattgagatcaagagctggactcgggagacctcaacaaccaactggttcattcctgtttttgggtccaactggtgttggcaaaactgaacttgcaaaggctcttgctgagcaactgtttgatgatgaaaaccagttggtgaggattgacatgtctgaatacatggaacagcattctgtctcaagactgattggtgcaccaccagggtatgttggacatgaggaaggtggtcagttaactgaagcagtgaggcgtaggccttacagtgtggtactttttgatgaagtggaaaaggcacacacatctgttttcaatacacttcttcaagttttggatgatggaagattaactgatgggcaaggccgtactgtggacttcagaaacactgtcgttatcatgacctcaaaccttggagcagagcacctcctaagtggactttcaggaaaatgttccatgcaagttgctcgtgataaagtaatgcaggaggtgagaaagcattttaggccagaattgttgaatcggcttgatgagattgtagtgtttgatcctctttcacatgagcaattgaggaaggttgcaaggttacaaatgaaggaggttgctagtagacttgctgagagaggaatagccatggcagtaacagatgcagcattagattatatacttgctgagagctatgatcctgtttatggtgctagaccaattaggaggtggcttgagaggaaagtggtgacagagctttccagaatgcttataagggatgaaattgatgagaactcaacagtgtacatcgatgctggcaccaagggtagtgagttggtctaccgtgtagagaagaatggtgggctggttaatgctgcaactggtcagaagtctgatatcttgattcagatacctaatggaccaaaaagtgatgctgctcaagctgtgaagaagatgaggattgaggaaattgatgatggtgagatggaagagtgaattttgtgacaactgtaattaggtttgatgaatggagtgtctctcaagtatttgctccttgtaaacctgtttttttgtctgtttttctaagtggttgtgatggaagaatgagaatctaatgtaatagctgtcttttctttaagcaataaattttgttgctgtacaaagtattactacctgttttctgtcacataattccatattagaatttaggaaggcgacattgatggccagttaaatgctactggcagttactgtttgttctgctgttgcagattcagccttggccttttgttttgtatacatctctctgattaattacataccagggaactggttttcttcctggcta

SEQ ID NO: 1843 - DNA, 3165 bp, Arabidopsis thaliana
atatacaaaagcagtcatgcctcctcgctctctcgcaattcacaaagtatccaaacatctaaagttatcaattttacaacattaccgctataatctgcttgattctctgcaaaaagagaagactttttaccgagaagaagtcctctggctcattgaagaaactcaacgaaacaaacccagttctcatatatcgttttaagggattacaaaagctaatcgaagatgaatccagagaaattcacacacaagacaaacgagacaattgctacagctcatgagctagctgtgaatgcaggacatgctcaattcactcctttgcatttagctggtgctttgatctctgatcccaccggtatatttcctcaagcaatctctagtgccggtggcgagaacgcagctcaatctgctgaaagagtgatcaatcaagccttgaagaagcttccttcacaatctcctccacctgatgatattccagcgagttctagtcttattaaggtcattcgtcgtgctcaagctgctcagaagtcacgaggtgatactcatttggctgttgaccagttgattatgggtcttcttgaagattctcaaatcagggatttgttgaacgaagtcggtgtagcgacggcgagggtaaagtctgaggttgagaagcttcgtgggaaagaagggaagaaagttgagagtgcttcaggggacacaaattttcaagctttaaagacttatggaagagatttggttgagcaagcagggaagcttgatcctgtgattggtcgtgatgaggagattagaagagtcgtgaggattctttcgaggagaacgaagaacaatcctgtgcttattggagagccaggagttggtaaaacagctgtggttgaaggtttagcacaaaggattgtgaaaggagatgtgcccaacagtcttactgatgtgagattaatttcgttggacatgggtgcgttagttgctggtgctaaataccgaggagagtttgaagaaaggttgaaatctgttttgaaagaagttgaggacgctgaaggcaaagtgattctctttattgatgagattcatttggttcttggtgctggcaaaactgaagggtcgatggatgcagctaatctgttcaagcccatgttagctagagggcagcttcgatgcattggtgctacaacgcttgaagaatacaggaaatatgttgagaaagatgctgcctttgagaggaggttccaacaagtctatgttgcggagccaagtgtgcctgacaccattagtatccttagaggactcaaggagaagtatgagggacatcatggtgtgcgaatccaagacagagctcttataaatgctgctcagctgtctgctcgttacataactggtcggcatttaccggataaagcaattgatttggttgatgaggcttgtgcgaatgtgagagtccagcttgatagtcaacctgaagagattgataaccttgaaaggaagaggatgcagctggaaattgaacttcacgccttggaaagggagaaggataaagccagcaaagctcgacttatagaggtgcggaaagagcttgatgacctgagagacaagcttcagcctctcacgatgaaatacagaaaggagaaagagagaattgatgagattcgaaggcttaaacagaaaagagaagagctcatgttttctttgcaggaggcagaacgaagatatgaccttgcaagagctgctgatctaagatatggcgcaattcaagaagtggaatctgcaattgcccaacttgaaggaacttcttctgaagagaatgtgatgctcacagaaaacgttgggcctgaacacattgctgaggttgtgagccgttggacagggattccagtgacgagacttggccaaaatgagaaggagaggttgattggtcttgctgataggttgcataagcgggttgtgggacagaatcaagcggtaaatgcagtttctgaggcaattctaaggtcaagggcaggacttggaaggccacaacagccaactggatcattcttattccttggaccaactggtgttggcaaaactgagctcgccaaggctcttgctgagcagctgtttgatgatgaaaacctcttagttcggattgatatgtcggaatatatggaacaacactctgtctctcgcctcattggggcaccaccagggtatgttggtcacgaggaaggtggacaactaactgaggctgtgaggaggcgaccttattgtgtcatactctttgatgaagtggagaaggctcatgttgctgtcttcaacactctgctccaagttttggatgatggtcgattgacagacgggcaaggcaggacagtcgatttcaggaactcggtgataatcatgacatcaaaccttggtgctgaacacctccttgcagggctaactgggaaagtaacaatggaagtggcccgggactgtgtgatgcgggaggtgaggaaacacttcagaccagagctcttgaacaggcttgacgagattgtggtgttcgaccccctttcacatgaccagttgaggaaagtagctcggcttcaaatgaaagacgttgctgtccggcttgctgaaagaggagttgctttggcagtcactgatgctgctttggactatatcttggcagagagttatgacccggtgtatggtgctaggcctataaggagatggatggagaagaaggtggtgacagaactgtcaaagatggttgtgcgtgaggaaatcgatgaaaactccactgtttacatagatgcaggcgctggtgatcttgtgtaccgggtagaaagtggaggtctagtggacgcttcaacaggcaagaagtcagatgtgctgattcatattgctaacgggccaaagagaagtgatgcagctcaggcggtgaagaagatgaggatcgaggaaatagaagatgacgataatgaggaaatgatcgaggattaaagtcttgacctccaacgtttgagttcttttgaggtgttgtgattgtatgacttgagctttcatgctctgttttggttttgactcttttggtagactataatggtgtggaactgtaaaaaagtctactttattatgttttcgtatatgtaaatcattttacataagaaatccattgtacgtcccataatcttttggggttttttcata

SEQ ID NO: 1844 - DNA, 3106 bp, Populus trichocarpa
cctccatcgcttcgtttttgcttcactccaagcagaacaaaaaagagaggatcaaactcaattcggaaacagattcaacaatcgaagattcagctttagttttagggcaaggagctagctgaaagaaagacatccgtttcgttagctgatcaggacgttgaagttaaagaatcaatggatcctggaaagttcacacacaagaccaatgaggctcttgcaacagctcacgaattggcagtgggtgctggtcatgcccagataaccccattacatcttgctgtggcccttatttcagaccctagtggaatcttgagacaagcggttgccaatgccggtgatggtgagaacactgctcaggcagcagaaagagttttcaatcaagtcctcaagaaactcccatctcagtctccacctcctgatgaagttccgcccagcaccagtcttattaaggtgataaggcgttctcaagcgttacaaaaatcacgcggggactcctatttagctgttgatcagatgatcttaggccttctcgaggactcccaaataagagatttgttgaaagaagtcggagtttccgcttccacagtgaaatcggaggtagagaaactccgaggaaaggaagggaagaaggtggagaatgcttccggggatactaattttcaggcattgaagacttatgggagagatcttgtggaaggtgcgggaaagcttgatcctgttattggaagagatgaggagatcaggagggttgtcaggattctgtcacggagaacgaagaacaaccctgtccttattggagagccaggagttggcaaaaccgcagttgctgaaggtttggcccaaaggattgtgagaggggatgttccaagtaatcttgctgatgtcaggctcattgccttggatatgggtgcccttgttgccggcgcaaaatatagaggggaatttgaggagaggttaaaggccgtgttgaaagaagtggaggaagctgaggggaaggtgattctgttcattgatgaaattcatcttgttctaggcgcgggtcgaacagaggggtccatggacgctgctaacctttttaagccaatgcttgcaagaggtcagctcaggtgcattggtgccacaaccctggaagagtacaggaagtatgtggagaaagatgctgcgtttgagaggaggttccaacaagtctatgtggcggagcctagtgttccagacacaataagcattcttcgaggattgaaagagaagtatgagggtcatcatggtgttcgaattcaggacagagcccttgtggttgcagctcaattatcaagtcgatacattacaggtcgtcatctgcctgataaggcaattgatttagtcgatgaagcttgtgcaaatgtgagagtccaacttgatagccagcctgaagaaattgatagccttgaaaggaagagaatgcaactagaagttgaacttcatgctcttgagaaggagaaggataaagctagcaaagctcgactggctgaagtcgtaaaagaacttgacgacttgagagacaagcttcagcccttgttgatgaaatacaaaaaggagaaagaaaggattgatgagatcaggcggctcaagcagaagagagaggagatacatttctccatacaagaggctgaaagaagatatgatttagccagagttgctgatttgcgctatggggcgctggaggaagtggaagctgccatagcacgtcttgaaggatcaaccactgacgagaacctgatgctgacagaaactgttggaccagaacacattgcagaagtagtgagtcggtggactggcattcctgtcacaaggcttggccagaatgagaaggagaggctaatcgggcttgcagacaggttgcatcatagagtggtaggacaggaccaagcggtcaatgctgttgcagaggctgtgctgaggtctagggctggtttaggcaggcctcaacagccgactggctcattcctattcttgggtccaactggtgttggcaagactgagcttgccaagactcttgctgaacagctctttgataatgaaaaccaactagtgaggatcgatatgtcagagtacatggagcaacactcagtatctcgacttattggtgctcctcctgggtatgtgggacatgaggaaggtgggcagctgacagaggccgtgaggcggaggccttatagcgttgtgttgtttgatgaagtggagaaagctcacatttctgtctttaatactcttcttcaagttcttgatgatggaaggttaacagatggtcaaggccgcactgtagatttcagaaacacagtgattatcatgacttccaaccttggagcggagcaccttctgtctggactgctgggcaagtgttccatgcaagttgctcgagacagagtgatgcaagaggtgagaaagcagttcaggcctgagttactaaatcggcttgatgagatagtggtttttgatccactctctcacgaccaactgagaaaggttgcaaggttacaaatgaaggacgttgctagccggcttgctgagaggggtattgctttggctgttacagatgctgccctggattatattttggcagaaagctatgatcccgtctatggtgcacgacccataaggagatggctggagaggaaggtggttacagagctatcgagaatgctcgtgagagaagagattgatgagaactctactgtgtacatagatgcaggcccagatggacaggacttggtttatcgtgtggagaagaatggcgggctcgtcaatgcaaccactgggcagaagactgatgttttgattcaaattcctaaagccccaagggatgatgctgcccagaaagtgaaaaagatgaaaattcaagagattgtcgacaacgacgacgacgacgagatgattgagtgaattgctgcatgtttcaagtctcttaaataacttgtttgcttgaacatggagttcaagttatagtatataatcaagagtgctacctccatgtcttaattttctgaagcctctgctttagaatttgaacatcacttttggtacttgggaatttggtgtgttaatattttttcaagataaatgtattttt

SEQ ID NO: 1845 - DNA, 3118 bp, Arabidopsis lyrata
atatacaaaagcactcatgcctcctcgctctctcgcaattcacaaagtttccaaacatctaaaggtttcaattttacaacattatcgttacaatctacttgattctctgcaaaaaaagaagaagaagtcgtctgattcattgaagaaactctgcgaatcaaacccagttctcatatcgtttaagggattacaagggctaattcgaagatgaatccggagaaattcacacacaagacaaacgagacgattgctacagctcatgagttagctgtgaatgcaggacatgctcaattcactcctctgcatttagctggtgctttgatctctgatcccactggtatattccctcaagcaatatctagtgccggtggcgagaacgcagcacaatctgctgaaagagtgatcaaccaagccttgaagaagcttccttcacaatctcctccacctgatgatattccagcgagttctagtcttatcaaggtcatacgtcgtgctcaagctgctcagaagtcacgcggtgacagtcatttggctgttgatcagttgattatgggtcttcttgaagattctcaaatccgggatttgttgaatgaagttggtgttgcaaccgcgagggtaaagtctgaggttgagaagcttcgtgggaaagaagggaagaaggtggagagtgcttcaggggatacaaatttccaagctttgaagacttatggaagagatttggtcgagcaagcagggaagcttgatcctgtgattggtcgggacgaggagattagaagagttgttaggattctttcgaggagaacaaaaaacaatcctgtgcttattggagagccaggagttggtaaaacagctgtggttgaaggtttagcgcaaaggattgtgaaaggagatgtccccaacagtcttactgatgtgagattgatttctttggacatgggtgcattagttgctggtgctaagtaccgaggagagtttgaagaaagattgaaagctgttttgaaagaagttgaggaagctgaaggcaaagtgattctctttattgatgagattcacttggttcttggtgctggcaaaactgaaggttcaatggatgcagctaatctgttcaagcccatgttagctagagggcaacttcgatgcattggtgctacaacgcttgaagagtacaggaaatatgttgagaaagatgctgcctttgagaggaggttccagcaagtctatgtcgctgagccaagtgtgcctgatactatcagtattcttagagggcttaaagagaagtatgagggacatcatggtgttcgtatccaggacagagctcttataaatgctgctcagctgtctgctcgttacataactggtcggcatttaccggataaagcgattgatttggttgatgaggcttgtgcgaatgtgagagtccagcttgatagtcaacctgaagagattgataaccttgaaaggaagaggatgcagctggaaattgaacttcacgccttggaaagggagaaggataaagccagcaaagctcgacttatagaggtgcggaaagagcttgatgacctgagagacaagcttcagccactcacgatgaaatacagaaaggagaaagagagaattgatgagattcgaaggcttaaacagaaaagggaagagctcatgttttctttgcaggaggcagaacgaagatatgaccttgcaagagctgctgatctaagatatggggcaattcaagaagtggaatctgcaattgcccaacttgaaggaacttcttctgaagagaatgtgatgcttacagaaaacgttgggccggaacatattgctgaggttgtgagccgttggacggggattccagttacgagactcggccaaaatgagaaggagaggttgattggtcttgctgataggttgcacaagagggttgtgggacagaatcaagcggtaaatgcagtttctgaggcaattctaaggtcaagggcaggacttggaaggcctcaacagccaactggatcattcttatttcttggaccaactggtgttggcaaaactgagctcgccaaggctcttgctgagcagctgtttgatgatgaaaacctcttagttcggattgatatgtcggaatatatggaacaacactctgtttctcgcctcattggggcaccacctgggtatgttggtcacgaggaaggtggacaactaactgaggctgtgaggaggcgaccctattgtgtcatactctttgatgaagtggagaaggctcatgttgctgtcttcaacactctgctccaagtgttggatgacggtcgattgacagacgggcaaggcaggacagtcgatttcaggaactcggtgataatcatgacatcaaaccttggtgccgagcacctcctttcagggctaactgggaaagtaacaatggaagtggctcgggaatgtgtgatgcgggaggtgaggaaacacttcagaccagagctcttgaacaggcttgacgagattgtggtgttcgatcccctttcacatgaccagttgaggaaagtagcccggcttcaaatgaaagatgttgctgtccggcttgccgaaagaggagttgctttggcagtcactgatgctgctttggactatattttggcagagagttatgacccggtgtatggagccaggcctataaggagatggatggagaagaaggtggtgacagaactgtcaaagatggttgtgcgtgaggaaatcgatgaaaactccactgtttacatagatgcaggcgctggtggatctgatcttgtgtaccgggtagaaagtggaggtctagtggacgcttcaacagggaagaagtcagatgtgctgattcatattgctaacgggccaaagagaagtgatgcagctcaggcagtgaaaaagatgaggatcgaggaaatagatgatgatgaggaaatggtggaggattaaagtcttgacctttagggcctccaacggttaagagttcttttgaggtgttgtgtttgcttttggtagactataatggtgtggaactgtaaaaaagtctactttttattatgttttcgtatatgtaaaccattttacataagaaatcttttgtacccataatcttttaggctttttt

SEQ ID NO: 1846 - DNA, 3092 bp, Populus trichocarpa
caagcagaaaaaaaaagagaggatcaaactcaattcggaaacagattcaacaatcgaagattcagctttagttttagggcaaggagctagctgaaagaaagacatccgtttcgttagctgatcaggacgttgaagttaaagaatcaatggatcctggaaagttcacacacaagaccaacgaggctcttgcaacagctcacgaattggcagtgggtgctggtcatgcccagataaccccattacatcttgctgtggcccttatttcagaccctagtggaatcttgagacaagcggttgccaatgccggtgatggtgagaacactgctcaggcagcagaaagagttttcaatcaagtcctcaagaaactcccatctcagtctccacctcctgaagaagttccgcccagcaccagtcttattaaggtgataaggcgttctcaagcgttacaaaaatcacgcggggactcctatttagctgttgatcagatgatcttaggccttctcgaggactcccaaataagagatttgttgaaagaagtcggagtttccgcttccacagtgaaatcggaggtagagaaactccgaggaaaggaagggaagaaggtggagaatgcttccggggatactaattttcaggcattgaagacttatgggagagatcttgtggaaggtgcgggaaagcttgatcctgttattggaagagatgaggagatcaggagggttgtcaggattctgtcacggagaacgaagaacaaccctgtccttattggagagccaggagttggcaaaaccgcagttgctgaaggtttggcccaaaggattgtgagaggggatgttccaagtaatcttgctgatgtcaggctcattgccttggatatgggtgcccttgttgccggcgcaaaatatagaggggaatttgaggagaggttaaaggccgtgttgaaagaagtggaggaagctgaggggaaggtgattctgttcattgatgaaattcatcttgttctaggcgcgggtcgaacagaggggtccatggacgctgctaacctttttaagccaatgcttgcaagaggtcagctcaggtgcattggtgccacaaccctggaagagtacaggaagtatgtggagaaagatgctgcgtttgagaggaggttccaacaagtctatgtggcggagcctagtgttccagacacaataagcattcttcgaggattgaaagagaagtatgagggtcatcatggtgttcgaattcaggacagagcccttgtggttgcagctcaattatcaagtcgatacattacaggtcgtcatctgcctgataaggcaattgatttagtcgatgaagcttgtgcaaatgtgagagtccaacttgatagccagcctgaagaaattgatagccttgaaaggaagagaatgcaactagaagttgaacttcatgctcttgagaaggagaaggataaagctagcaaagctcgactggctgaagtcgtaaaagaacttgacgacttgagagacaagcttcagcccttgttgatgaaatacaaaaaggagaaagaaaggattgatgagatcaggcggctcaagcagaagagagaggagatacatttctccatacaagaggctgaaagaagatatgatttagccagagttgctgatttgcgctatggggcgctggaggaagtggaagctgccatagcacgtcttgaaggatcaaccactgacgagaacctgatgctgacagaaactgttggaccagaacacattgcagaagtagtgagtcggtggactggcattcctgtcacaaggcttggccagaatgagaaggagaggctaatcgggcttgcagacaggttgcatcatagagtggtaggacaggaccaagcggtcaatgctgttgcagaggctgtgctgaggtctagggctggtttaggcaggcctcaacagccgactggctcattcctattcttgggtccaactggtgttggcaagactgagcttgccaagactcttgctgaacagctctttgataatgaaaaccaactagtgaggatcgatatgtcagagtacatggagcaacactcagtatctcgacttattggtgctcctcctgggtatgtgggacatgaggaaggtgggcagctgacagaggccgtgaggcggaggccttatagcgttgtgctgtttgatgaagtggagaaagctcacatttctgtctttaatactcttcttcaagttcttgatgatggaaggttaacagatggtcaaggccgcactgtagatttcagaaacacagtgattatcatgacttccaaccttggagcggagcaccttctgtctggactgctgggcaagtgttccatgcaagttgctcgagacagagtgatgcaagaggtgagaaagcagttcaggcctgagttactaaatcggcttgatgagatagtggtttttgatccactctctcacgaccaactgagaaaggttgcaaggttacaaatgaaggacgttgctagccggcttgctgagaggggtattgctttggctgttacagatgctgccctggattatattttggcagaaagctatgatcccgtctatggtgcacgacccataaggagatggctggagaggaaggtggttacagagctatcgagaatgctcgtgagagaagagattgatgagaactctactgtgtacatagatgcaggcccagatggacaggacttggtttatcgtgtggagaagaatggcgggctcgttaatgcaaccactgggcagaagactgatgttttgattcaaattcctaaagccccaagggatgatgctgcccagaaagtgaaaaagatgaaaattcaagagattgtcgacaacgacgacgacgacgagatgattgagtgaattgctgcatgtttcaagtctcttaaataacttgtttgcttgaacatggagttcaagttatagtatataatcaagagtgctacctccatgtcttaattttctgaagcctctgctttagaatttgaacatcacttttggtacttgggaatttggtgtgttcatattttttcaagataaatgtatttttaagtaagtatttac

SEQ ID NO: 1847 - DNA, 2878 bp, Manihot esculenta
aaatggatccgggaaaatttacccataagacgaatgaggctcttgcttcggctcatgagctggcaatcagtgctggccatgcccagataacacctctgcatcttgctgttgctctgatttcggaccctggtgcaatctttagccaggcaatctccaatgctggtggtgaatctgcctcgcaggcagcacaaagagtattcaataatgccatgaaaaagcttccatctcagtctcctcctcctgatgaagttccaccaagtactagtcttattaaagtgataaggcgtgcccaagcatcacaaaaggcacaaggtgactcccatttagcagttgatcagctcatcttaggtctccttgaggattcccaaattggggacttgttaaaagaatcgggaatagctgctgcaaaagtaaaatctgaggttcagaaacttcggggaaaagaagggagaaaggtggagagtgcttctggagatagtacatttcaagccttgaagacttatgggagagatcttgtggaacaagctggaaagcttgaccctgtcattggaagagatgaagagataaggagagttgttaggattttatcacggagaaccaagaataatccagttcttattggcgagcctggagttggtaaaactgctgttgttgaaggtttggctcaaaggatcgtgagaggagacgtgccaaataaccttgctgatgtgaggcttattgcattggatatgggtgctttagttgctggtgcaaaatatagaggagaatttgaggagcgattgaaggctgtattgaaggaagtggaagaggctgaagggaaagtgatactatttattgatgaaatacatcttgttcttggagctggtcgaacagaggggtctatggatgctgctaaccttttcaagcccatgcttgctagagggcagctcaggtgcattggtgcaacaacactagaagaatacaggaagtatgtggagaaagatgctgcatttgagagaaggttccagcaagtttacgttgcagaacctagtgttaacgacacaatcaacattcttcgaggtttgaaagagaagtatgagggtcaccatggtgttcgaattctagatcgagctctcgtagttgctgcacagttgtcaagtcgatacattactggccgtcatctgcctgataaggcaattgatttagttgatgaagcctgtgcaaatgtaagagtccaacttgacagtcaacctgaagaaattgataatctggaaaggaagaaaatccaacttgaagtggaactccatgcgcttgagaaggagaaggacaaagttagcaaagctcgacttgctgaggtggtaaaagaacttgatgacttgagagacaagcttcaacctctgatgatgaaatacaaaaaagagaaggagaggatagatgaaatcaggcgtctcaagcagaagaaagaggagatacagtttgcaatacaagaggcagaaagaagatatgatttagctagagttgctgatttgcgatatggggcattggaggaagttgatgctggcatagctcggcttgaaggaagcacagatgagaacttgatgctgacagagacagttaaaccagaacatatcgctgaagttgtgagccgatggactggcattcctgttacaaggcttggtcaaaatgagaaagagaggctaattgggcttgcagagaggttgcatcaaagagtggtggggcaagaccaggcagttgatgctgttgcagaggctgtgcttagatcaagggctggcttgggaaggccacagcaaccaactggttcattccttttcttgggtccaactggtgttggtaaaactgagcttgctaaggccttagctgaacaactttttgacgatgagaatcagttggtgagaattgacatgtccgagtatatggagcaacactctgtcgctcgactaattggtgctcctcctgggtatgtgggacatgaggaaggtgggcagcttacggaggctgtgagacgaagaccttacagtgttgtcctgtttgatgaagtggaaaaagctcacctttctgtgtttaatactctcctacaagttctggatgatggacggctgactgatggccaaggtcgcactgtagactttaggaacacagtaattataatgacttccaacctcggagcagagcatctgctatcgggattgatgggcaaatgttcaatgcaagtcgctcgagatcgtgttatgcaagaggtgaggaggcatttcaggccagagttgctaaatcggcttgatgagattgtggtgtttgacccactttctcatgaccaattgataaaagttgccaggttacaaatgaaggatgtagcagtccgtcttgctgagaggggaattgcattggcagtgactgatgctgcattagattacatattagcagagagttatgatcctgtatatggtgctcgaccaatcagaagatggcttgagaagaaggtggttacagagctgtcaagaatgctcgtaagagaggagattgatgaaaattcaaccgtctacatagatgcagggtcaaaaggaaatgacttggtttatacagtggaaaagaatggaggactggttaatgcagccacaggacagaaggcagaggtgttgattcagatacctagtgtcccaaggaatgatgcagcacaggcagtaaagaagatgaagattgaagaaatcatcgacgatgatgaagagatgatggagtaaatgacaatcggggatcgtacaaaaaataagttgtttttttgctgtattatcttcgtctagagacgttagtaaggtagggggaagattccctctgctgtttaatagcaagtgttaattactggtggatctgtgttctgattttg

SEQ ID NO: 1848 - DNA, 3346 bp, Ricinus communis
acattcttactctgtaacccaatcaaacgcaaagaacccaaatccaactaaatcttttttttttctccaaaaacactctttgcattgcaaatacaaacgcaagaaatccttataacagagctcttgaagtttgttcacttctttttgttcttgttaaataacagaggttttgtcagatagtagataaatggatcctggaaagtttacccacaagacaaatgaagctctcgcttcagctcatgagctagcaattagtgctggtcatgcccaattaacccctcttcaccttgctgttgctttgatcactgatcctaatgcaatctttagccaagcaatctcaaatgctggcggtgaaagtgcttctcaagcagcacaaagagtgttgaataatgctataaaaaagcttccatctcaatctcctcctcctgatgaaatcccaccaagtaccagtcttattaaagtgataaggcgtgcccaagcattacaaaaatcgcgaggggactctcatttagctgttgatcagctcattttaggtcttcttgaggattcccagataggggatttgttgaaagaatcagggatagctgctgggaaagtcaaatcagaggttgagaaactccgaggcaaggaaggaaagaaggtggagagtgcaaccgcagatactaattttcaagcattgaagacttatgggagagatctcgtggaacaagctggaaagcttgatcctgtaattggaagagatgaagaaataaggagggtggttaggattctatcacgaagaactaagaacaacccggttctaattggagagccaggagttggtaaaactgctgtagtagaaggtttggctcaaagaattgtgagaggagatgtgccaaataatcttaatgatgtgaggctaattgcattggatatgggtgctttagttgctggagcaaaatatagaggagagtttgaagaacgattgaaggctgttttgaaggaagtggaagaggccgatgggaaggtgatattgtttattgatgaaattcatcttgttcttggagctggtcgaacggagggttctatggatgctgctaaccttttcaagccaatgcttgctagaggtcagcttaggtgcattggtgcaactacattggaagaatataggaagtatgtagagaaagatgctgcatttgagagaaggttccagcaagtttatgtttctgaacctagtgttgttgacacaatcaacattcttcgtgggttgaaagagaagtacgagggtcatcatggtgttagaattttagatcgagctcttgtggttgctgcgcaattgtcaagtcgatacattacagggcgtcatctacctgataaggcaatcgatttagttgatgaagcatgtgcaaatgtgagagtgcagcttgatagtcagcctgaagaaattgataatctggagagaaaaaaaattcaactagaagttgaacatcatgcacttgagaaggagaaagacaaagccagcaaagctcgactctctgaggttgtaaaagaacttgatgatttgagagataagcttcagcctctgattatgaaatataaaaaggagaaggagaggattgatgaaatccgtcgactgaagcagaagagagaggagatacaatttgcaatacaagaggcagaaagaagatatgatctagccagagttgctgatctcaaatatggggcattggaggaagttgatgctgcaatagcacggcttgaaggaagcagtactgatgagaacctgatgttaactgaaacagtgaagcctgaacatattgctgaggttgtgagccgatggactggcattcctgttacaaggcttggtcagaatgagaaagagaggctgattgggctcgcagaaaggttgcatcagagagtggttggacaggaccaggcagtttccgctgtggcggaggctgtgcttagatcaagagctggcttgggaaggccacagcaaccaactggttcattccttttcttgggtccaaccggtgttggtaagaccgagcttgctaaggctttagctgagcagctctttgatgatgaaaaccaaatggtgagaatcgatatgtccgagtacatggagcaacactctgtctcgcgattgattggcgccccaccaggatatgtgggacacgaggaaggtggacaactgacggaggctgtgaggcgaaggccttatagtgttgtactgtttgatgaagtggagaaagcacacttgtctgtgttcaatacccttcttcaagttttggatgatggaaggctaaccgatggacaaggccgcacagtagattttaggaatacagttatcatcatgacttccaaccttggggcagagcacctgctgtcaggattaactggcaaaacttcaatagaagctgctagggatcgagtgatgctggaggtgaggaagcacttcaggcctgaattactaaatcggctggacgagattgtggtattcgatccactttctcatgaccaattaaagaaagttgccaggttgcaaatgaaggatgtagctctccgacttgccgaaatggggattgcattggcagtcactgatgctgcattggattacatactagctgagagttacaatcctgtgtatggtgcgcgaccgattaggagatggcttgagaagaaggtggtgacacagttatcaagaatgctcctaagagaggaaattgatgagaacacaactgtgtatatagacgcagcatcaaatcaggacgacctggattaccgggtggagaagaatggcggactagttaacgcagcaactgggcggaaggctgaggtgctgattcaaataccaagtgttcctaagagcgatgcagctcaggcagtgaagaagatgaggattgaagaaattgtcgacaatgacgaagacgaaatgcacgagtaaagtagtggtgtggctgcagggaagaagcagaggcgctgctgcctgaaaaaagaagttgtttctgccctgcattttctcatctgtgaagagtttatagggtgtttttttttccttgccctttttgcatgtggttgtacatagaagcaggcatctggttcatgtttgtaaagctccttttcactctgatgaatgaatgatttgcctgtgccctggaaaaacaactctgaattctgatgttgctaattttgaatatatttatcctgctaaaaccacttgtggtgtgggccaatttgatgaacttagcatttttacttaaattattacaaaaggacaaagtaacagtgtccttgtctgtcttacttcgacttttcctccctctccagtctctatattaaaagaaagaacaaagcgaaagttccc

SEQ ID NO: 1849 - DNA, 3080 bp, Ricinus communis
atcaaacgcaaagaacccaaatccaactaaatcttttttttttctccaaaaacactctttgcattgcaaatacaaacgcaagaaatccttataacagagctcttgaagtttgttcacttctttttgttcttgttaaataacagaggttttgtcagatagtagataaatggatcctggaaagtttacccacaagacaaatgaagctctcgcttcagctcatgagctagcaattagtgctggtcatgcccaattaacccctcttcaccttgctgttgctttgatcactgatcctaatgcaatctttagccaagcaatctcaaatgctggcggtgaaagtgcttctcaagcagcacaaagagtgttgaataatgctataaaaaagcttccatctcaatctcctcctcctgatgaaatcccaccaagtaccagtcttattaaagtgataaggcgtgcccaagcattacaaaaatcgcgaggggactctcatttagctgttgatcagctcattttaggtcttcttgaggattcccagataggggatttgttgaaagaatcagggatagctgctgggaaagtcaaatcagaggttgagaaactccgaggcaaggaaggaaagaaggtggagagtgcaaccgcagatactaattttcaagcattgaagacttatgggagagatctcgtggaacaagctggaaagcttgatcctgtaattggaagagatgaagaaataaggagggtggttaggattctatcacgaagaactaagaacaacccggttctaattggagagccaggagttggtaaaactgctgtagtagaaggtttggctcaaagaattgtgagaggagatgtgccaaataatcttaatgatgtgaggctaattgcattggatatgggtgctttagttgctggagcaaaatatagaggagagtttgaagaacgattgaaggctgttttgaaggaagtggaagaggccgatgggaaggtgatattgtttattgatgaaattcatcttgttcttggagctggtcgaacggagggttctatggatgctgctaaccttttcaagccaatgcttgctagaggtcagcttaggtgcattggtgcaactacattggaagaatataggaagtatgtagagaaagatgctgcatttgagagaaggttccagcaagtttatgtttctgaacctagtgttgttgacacaatcaacattcttcgtgggttgaaagagaagtacgagggtcatcatggtgttagaattttagatcgagctcttgtggttgctgcgcaattgtcaagtcgatacattacagggcgtcatctacctgataaggcaatcgatttagttgatgaagcatgtgcaaatgtgagagtgcagcttgatagtcagcctgaagaaattgataatctggagagaaaaaaaattcaactagaagttgaacatcatgcacttgagaaggagaaagacaaagccagcaaagctcgactctctgaggttgtaaaagaacttgatgatttgagagataagcttcagcctctgattatgaaatataaaaaggagaaggagaggattgatgaaatccgtcgactgaagcagaagagagaggagatacaatttgcaatacaagaggcagaaagaagatatgatctagccagagttgctgatctcaaatatggggcattggaggaagttgatgctgcaatagcacggcttgaaggaagcagtactgatgagaacctgatgttaactgaaacagtgaagcctgaacatattgctgaggttgtgagccgatggactggcattcctgttacaaggcttggtcagaatgagaaagagaggctgattgggctcgcagaaaggttgcatcagagagtggttggacaggaccaggcagtttccgctgtggcggaggctgtgcttagatcaagagctggcttgggaaggccacagcaaccaactggttcattccttttcttgggtccaaccggtgttggtaagaccgagcttgctaaggctttagctgagcagctctttgatgatgaaaaccaaatggtgagaatcgatatgtccgagtacatggagcaacactctgtctcgcgattgattggcgccccaccaggatatgtgggacacgaggaaggtggacaactgacggaggctgtgaggcgaaggccttatagtgttgtactgtttgatgaagtggagaaagcacacttgtctgtgttcaatacccttcttcaagttttggatgatggaaggctaaccgatggacaaggccgcacagtagattttaggaatacagttatcatcatgacttccaaccttggggcagagcacctgctgtcaggattaactggcaaaacttcaatagaagctgctagggatcgagtgatgctggaggtgaggaagcacttcaggcctgaattactaaatcggctggacgagattgtggtattcgatccactttctcatgaccaattaaagaaagttgccaggttgcaaatgaaggatgtagctctccgacttgccgaaatggggattgcattggcagtcactgatgctgcattggattacatactagctgagagttacaatcctgtgtatggtgcgcgaccgattaggagatggcttgagaagaaggtggtgacacagttatcaagaatgctcctaagagaggaaattgatgagaacacaactgtgtatatagacgcagcatcaaatcaggacgacctggattaccgggtggagaagaatggcggactagttaacgcagcaactgggcggaaggctgaggtgctgattcaaataccaagtgttcctaagagcgatgcagctcaggcagtgaagaagatgaggattgaagaaattgtcgacaatgacgaagacgaaatgcacgagtaaagtagtggtgtggctgcagggaagaagcagaggcgctgctgcctgaaaaaagaagttgtttctgccctgcattttctcatctgtgaagagtttatagggtgtttttttttccttgccctttttgcatgtggttgtacatagaagcaggcatctggttcatgtttgtaaagctcct

SEQ ID NO: 1850 - DNA, 3451 bp, Pinus taeda
gagattcggccgaggattattctttgctatctttctgcaatgagggtcgttggcctggtaattccaatcggcgagtattaatttctccttcctttcaattcaatcgtgcaaatctaaagaataactggctttctttcattcggcgattttcagttagtgaagctaaagaatcagtgaagctaaagatcctgcgctgcaagcggactgttttttgaaaattttcctaagaggtgcaaggaagagaaaaggatctccataataccgcacaaaaccgatttcacagagcgcaatataaaatgaatcccgagaaatttacacacaaaacaaatgaggctctagccgcgggtctagagatcgctacagaatctggtcacgcccagtacactcctgtacatttggccatagctcttaccgaggacaaagggggtattctccgtcaagcgatttcatctgctacaggtggagaggaaactgtggaagcagtacagagagtccttcgacaagccctgaagaaactcccatcccaagatcctgcccccgacagtattcctcctaacacttcgttaataaagtccatcaggcgtgctcagtcttcacaaaagagcaagggggactctcatttggcagtagatcatcttattcttggagtgctagaagactcccaggtttcagattgctttagagaggcaggtgtgagtatagcgagagtgaaatctgaagtggagaagctcagaggagagggcaaaaaggtagatactgcgtctggtgatactaattttcaggccttgaaaacatatggccgcgatttggttgaagatgctgggaagcttgatcctgtcattggtagagatgaagaaattcggagagtagttagaattttgtctcggaggaccaagaacaatcctgtgctcattggagagcctggtgttggaaagactgctgtggtggaagggctggcacaaagaattgttcgaggggatgtaccaagcaatttgctagaagtgagagtgatagccttggatatgggagctctagtggctggtgccaaatacagaggcgaattcgaagagcgacttaaagctgtattgaaagaagtagaggaagctcatggaaaagttattctctttattgacgaaatacatttggttctgggtgccgggcgtactgagggatcaatggatgctgccaatttatttaaaccgatgcttgctcggggccaacttaggtgcattggagcaacaactctggaagagtaccggaagtatgtggagaaagatgctgcgtttgagcgacgattccagcaagtttatgtagctgaacctagtgtggcagacactattagtatccttcgtggtttaaaagaaaagtacgaaggtcatcatggtgtgagaatattggacagagcacttgtagttgctgcccagttatcaagtagatatatcactgggcgacatcttccagacaaagcaattgatcttgtggatgaagcatgtgcaaatgtaagagttcaactagatagtcaacctgaagaaattgacacccttgaaaggaaaaggattcaactagaagttgagttgcatgcccttgaaaaggagaaggataaagccagtaaagctcgtttggctgaggttcacaaggagcttgatgatttgagagataagttgcaaccgttgaaaatgaaataccaaaaagaaaaagagagagtagatgaaattcggcggctgaagcaaaaacgtgaggaattgcagattactttggaagaagcaaagcgtaggatggatttggcacgagttgcagatcttcaatatggggcccttcaagaaatagagactgcaatttctagacaagaagctgggatgggagaaaatctcatgttaacagagagtgtgggacctgatcagattgcagaggttgtgagtcgctggactggtatccctgttacaagacttggtcagaatgaaaaggagcgactgataggtctggcagacaggttgcatgaaagagttgttggacaagatgaggcggttcaagcggttgccgaagctgtgttaagatcgcgggctggacttggaagacctcaacagccgactggatctttcctattcttggggcccactggagttggcaaaacggaacttgcaaaggctcttgcagctcaattgtttgatgatgaaaatcagctggtccgtattgatatgtctgaatatatggagcaacattcagttgcaaggctcataggtgctcctcctggttatgttggttatgaagaaggggggcaactgacagaagcagtaaggagaagaccctatagtgttgttctttttgatgaagttgagaaagcacacacttcagtcttcaacactttgcttcaaatgcttgatgatggtagacttacggatggacaaggtcgcaccgttagtttctcaaacacagtcattatcatgacatccaaccttggagcagagcacttgcttgctgcattgtctggccgcacaacaataaaagccgcaagagagaacgtcatgcaagaagttagaagacatttcaggccagagttattgaatagacttgatgagatagttgtatttgatcctctttctcatgatgagctcaagaaagttgctagactacagatgaaagatgtagcaattcgtcttgcagagagaggtgttgctttaggggttacagatgccgctctggatcttgttcttcaggaagcctatgatcctgtttatggtgctcgccccttgcgacgatggttggaaagaaaagttgtcactcagctatctcggatgctcatcagtggggagattgatgagaacagtacagtatacattgatgcagtgcctgagcagcagacattatcttatcgcgtggacaggaatgggggaatcgttaaccaaaacactggtgcaaaatcggatatcttgatagaaattccgaattctgcctattttaatgctgatgcatctcaggcagtaaagaaaatgagaattgaagaaatagacgatgatgagccaatggaagattagacggtgaatgatggcatcttctaggaactttcagcttattttttgtgatgatgctagtataacttgagtttgagtgccttgtaatgtgtttttgagtgagattaagctatatggcaatacttaaaaggtttcgatataaacttattgctatatattgataaagaatcgtttttttccttctcaatcacttttttgctgttaataacattattagggtgtgtgttcaaagtttcaaaccagttgtaaggttgctgcatatgatgacttttacaaaaattagaacacgttgaatccttccatcatttgcaactgctttttctgcaaacctgtttcatccagtttgcaaaaaagagtttcaggatctgtactccatgggttaatataattaattttgaaaggcgtggatgtgtgtagttttt

SEQ ID NO: 1851 - DNA, 3045 bp, Nicotiana tabacum
accaagcactcgaatttcgccaaatcacattgaaggaattgctaattttcttgcgtttctattcgtttattgccgtaagattgtctataggtgactcattatgaatcctgaaaaattcacccacaagactaacgaggcccttgctggggcactcgagctagcactatccgcagggcatgctcaatttacgcctctgcatatggctgtggccttaatatctgatcacaatggtatttttcgacaagcgattgtcaatgctggtgggaatgaagaagtagctaattcagtggagcgggtattgaatcaagcgatgaagaagctaccttctcaaacaccggctcctgacgaaatcccacctagcacttcccttatcaaggtgttacgccgagcacaatcgtcgcagaagtctcgtggtgacagccatttagcagtggatcagttgattttaggactgctagaagactcccaaattggagatcttttgaaagaagctggagtgagtgcatcaagagtgaaatcagaggtagagaaacttagaggaaaggaaggaagaaaagtcgaaagtgcttcaggggacaccacattccaagcactcaacacttatggccgtgatcttgtggaacaagcaggaaagcttgatcccgtgattggtagggatgaagaaattagaagagtcgttcggattttatcaaggaggactaagaacaacccggttcttattggagagcccggtgtgggtaaaacagcagttgttgaagggctagcacagaggattgtacgtggtgatgttccaagtaatttagctgatgttaggcttatagcattggatatgggagcgctagttgctggagctaagtacagaggtgaatttgaagagaggctgaaggctgtgctgaaagaagttgaagaagcggaagggaaagtaatacttttcattgacgagatacatttagtcctcggtgctggtcggacagaagggtctatggatgctgctaatctgtttaagccaatgctagccagaggtcaattacggtgcattggtgcaactacactcgaggagtacaggaagtatgttgagaaggatgctgcatttgagaggcgtttccagcaggtgtatgttgctgagcctagtgttgctgacactattagtattctccgtgggttgaaggagaggtatgaagggcatcatggtgtcaaaattcaggacagagctcttgtagtggctgcccagctctcatctcggtacattacaggtcgacatctgccagataaggctattgacctagttgatgaagcttgtgcaaatgttagagttcagcttgatagtcaacctgaggaaattgacaatcttgagaggaagagaattcagctagaggttgaacttcacgctctcgagaaggaaaaagacaaagctagcaaagcacgtctcatagaagtgaggaaagaacttgatgatttgagagacaaactccaacctttgatgatgaggtacaagaaagagaaggaaaggatagatgagctgcgcaggctcaagcaaaagcgcgatgagctcatctatgctttacaagaagctgaaaggagatatgatctggcgagggcagcagatctgagatatggggcaattcaagaagtggaaactgcaatagcaaatcttgagagtacctcagctgaaagtacaatgctaacagagactgtgggtcctgatcagattgcggaagttgtgagtcgttggactggtattccggtctcaaggcttggtcagaatgagaaagagaaactgattggtcttggcgatagattgcaccaaagagtggtcgggcaagatcatgcagttagagctgttgctgaagccgtgttaaggtccagagctggtttaggaaggccacagcaaccaactggttcattccttttcttggggccaactggtgttggaaagacagagctcgctaaagctcttgcagagcagctctttgatgatgataaactgatgatcagaatagacatgtccgagtacatggaacaacactctgtttcccggctgattggtgctccaccaggttatgttgggcatgatgagggaggacaacttactgaagctgttaggaggcggccttacagtgttgtgctatttgatgaagttgagaaagcccatcctgcagtgtttaatacattgcttcaagttctggatgatggaaggttaacagatggtcaaggccgcacagttgatttcaccaactccgtgattattatgacttcaaacttgggagcagagtatctgttgtctggattaatgggcaaatgtaccatggagacagctcgtgaaatggtcatgcaggaggtgcgaaagcagtttaagcccgagctgctgaatcggctggatgagattgttgtgtttgatcctctgtcccacaagcagttgaggcaagtatgccgctaccagatgaaggacgttgcactacggctggctgagaggggtattgcattgggcgttactgaggcagctctagatgtcatactcacagagagttatgacccggtttatggtgcaagacctattaggagatggttggagaggaaggtggtgaccgagctatccaagatgctcgtgaaggaggagattgatgagaactcaacggtttacatagatgctggggtcagcgggaaagatctaacctacagggtggagaagaatggagggcttgtgaatgctgccaccgggcaaaaatctgatatattgattcagcttcctaatggtcccaggagtgatgctgtccaagcagtcaagaagatgaggattgaagaaattgaagatgacgaaatggaagattgaagaagttgaaaattaatcaaaaaaagatgaaacagagactactaacattgcaatagcttcaactttgaggatactacttgtatatgtgttgattttatgaacgtatttttgttgtcttacagggtctgaaacagggttttatccttctatcatgtaagtgtaaactttctacttgttgtctttattaatgtactcacttcggtgaaaatttctct

SEQ ID NO: 1852 - DNA, 2985 bp, Mimulus guttatus
tcaaatctttgttaaaccaacgcagaaattctcgatttttcaaactcatcgtttcttctttccacttcccgctaaagaatctctcgagaggtatatctaacaatgaatccagacaagttcactcacaagacgaacgaagtgctagccgcagctcatgggctagcactcaacgccggccatgctcagttcaccccgctgcacttcgccgctgctctgatctccgaaccccacggaatattccggcaagcaatctccggcgcaggcggcagtgaggaatccgcaaatgcagccgagcgagtaatcaaccaagccattaaaaaactccccacacagaaccctccaccagacgacatacctgcaagcacttccacaatcaagatcattcgtcgagcccagtccctccaaaaatcccgcggtgatacacatttagctgtcgatcaattaatcctcggccttctagaagattcccaaatccaagacctgttaaaagaagctggagtaactaccacgaaagtgaaatcggaagttgaaaaattacgtggcaaagaagggaaaaaagttgagagcgcttctggggattcgaattttcaagccttgaaaacctatggtcgagatcttgttgaacaggctggaaaactcgatccagtgatcggtagagacgaagaaattcgaagggttgttaggattctctccaggaggacgaagaacaatccggttctcatcggtgagcccggtgtgggtaagacagctgtcgtcgagggattggctcagaggattgtcaatggtgatgtaccgagtaatcttttcgatgtgaggcttatagcattggatatgggagctctaatcgccggagcgaaataccgaggagagttcgaggagagattgaagtctgttttgaaggaagttgaagaagccgaaggaaaagtgattcttttcattgacgagattcatcttgttcttggtgctggacgaaccgagggttcgatggatgcggctaatttgttcaaaccgatgcttgctagaggtcaattgaggtgcattggagctacaactttggaggagtatcgaaagtacgttgaaaaggatgccgcttttgagagacgttttcagcaggtttatgtggcggagccgagtgtgccagatacgataagtattttgaggggtttaaaagagaagtatgagggccatcatggtgtgaagattcaagatcgggctcttatagttgcgtctcaattgtctgctcggtacatcacagggagacatttaccggacaaagcgattgacttggtcgacgaggcttgtgcgaatgtgagagtccagctcgatagtcagcccgaagaaatcgataatctcgagaggaagaggattcatttggagattgagcttcatgctcttgagaaggagaaagacaaagctagtaaagctaggctcgttgaagtgaagaaagaattggatgatttgagagataagctacagcccttgtcaatgagatacaaaaaagagaaggaaagaatcgacgagctaaggcgactaaaacagaagcgggacgagctcttacacgcactaaaagaagccgaaaggcgatatgatctcgcgagagctgccgacttgagatacggagcgatacaggatgtggaagcttccattgccacgctggaatcgggcgccaccgaagactcaatgttgactgaaaccgtgggccccgatcaaatcgctgaggtcgtgagccggtggaccggcatacctgtcactcgtctcggccagaatgacaaggagaggttgatcggccttggcgatagactgcacaaacgagtcgtgggacaggaccaagcggtgacagctgtcgccgaggctgttttgagatctagggccgggctcggtaggccccagcagcccaccggatctttcctcttcttgggccccacaggtgtgggaaaaaccgagcttgcaaaggctttggctgaacagctgtttgatgatgataatttgatgataaggattgatatgtcggagtacatggagcagcattcagtcgctcgattgattggagctcctccaggctatgtgggacacgaagaagggggccaactcaccgaaggcgtgaggagaaggccatacagtgttattcttttcgatgaagtcgaaaaagcccatcccacggtgttcaacactttgctacaagttttggatgacggaagacttacggatggtcaaggtaggacggttgactttacgaatacagtcattattatgacgtcgaatcttggagcagagtaccttttacgaggtttgatggggaagagcaccatggaaagtgctcgcgagatggttatgcaagaggttagaaagcacttcaagcccgagttactcaatcggctcgatgaaatcgtggtattcgatcccctctcgcacgatcaacttaggaaagtgtgccgactccagttaaaagatgttgcgagtcgtttggctgagaggggtattgctttgggtgtgacagaaacagcacttgacgtgatcttggccgaaagttatgatccggtttatggtgcgaggccgataaggaggtggctggagaagaaggtggtgactgagctttcgaagatgctagtgagagaggaaattgacgagaactcgacggtgtatattgatgctttgttggacgggaaagagttgacttatcgtgtggagaagaatggagggcttgtgaattctgcgacgggggagaaatctgatgtgctgattcagctgcccaacgggcgccgctcgacggacgccgctcaagctgtgaagaggatgaagattcaagaaattgatgatgatgatcttgagatgcttgagtaaaatgtttttggtgtagtaatactttaataatggtttgtagtagttagtacttgaagagtgtttcaccaagtggtgttttattagctttttttagtaactgcaatgactttgagtcgaatatatatttagtaaataatttttagc

SEQ ID NO: 1853 - DNA, 3253 bp, Solanum lycopersicum
aaacttcgagaactctctattttcctcaacataaacacctctctccgttctcacttctcaaccgaaaaaaactacagaagaagaaacactcgaaactcgaaatcacgcatttgattctatcccaagaacaaatcaaaaggaattctcttgttatctgttaaaagtttattgaaagacagtaattcatcatgaatcctgaaaaatttactcacaagacaaatgaggctattgctgaggcacatgaactggctgtatcagcagggcatgctcagttgacacctctgcatatggctttggctttattatctgatcacagtggtatattctggcaagcaattgtcaatgctgctggtagtgaagagactgccaatggtgttgaaagagtgttcaatcaagctaagaagaaaattccttctcagtcaccagcacctgatcaagttccagcaagtacttcgcttattaaggtgctacgacgagcacagtcgttgcagaagtctcgtggtgacagccatttggcggttgatctgttgattttaggccttctggaagattcccaaattgcagatcttttgaaagattctggtcttagtgcagcaagagtgaaatcagaagttgagaaacttagaggaaaagatggaaagaaagtggaaagtgctacaggggatactacatttcaagcacttaagacctatggtcgtgatcttgtggaacaggcaggaaaacttgatcctgtgattggtagggatgaagaaattcgaagagtaattcggattctttcgaggaggacaaagaacaatccggtgcttattggtgagcctggtgttggtaaaacagctgtagttgaagggctagcacaaaggatagttcgaggggatgttccaagcaatttggctgatgttaggcttatagcattggatatgggagcactcattgctggagcaaagtacagaggtgaatttgaagagagattgaaggctgttctgaaggaagtggaagatgcagaagggaaagtaattctcttcattgatgagatccacttggttttaggtgctggtaggactgaaggatcaatggatgctgccaatttgttcaaaccgatgcttgctcggggccaattaaggtgcattggtgcaacaaccctggaagagtacaggaagtatgtggagaaagatgctgcattcgaaaggcgtttccagcaggtatatgtcgctgagcctagcgttcccgacactataagtatccttcgagggttgaaggagaagtatgaaggccatcatggtgtcaagattcaggatagggctctcgttattgcagcccagctttcagctcgatacattacaggtcgacatttgcctgataaggctattgacttagttgatgaggcttgtgcaaatgtgagggtgcaacttgatagccagccagaagaaattgataatcttgaaaggaagaggattcagctagaagttgaacatcatgctcttgaaaaggaaaaagacaaggctagcaaggctcgacttgttgaagtgaggaaagagctcgatgacttgagggacaaactccaacctttgatgatgaggtataagaaagagaaggaacgggttgatgagcttcgaaggcttaagcaaaagcgcgatgaacttacatatgctttacaagaagctgaaaggagatatgatcttgctagagcagcagatcttagatacggtgccatccaagaagtagaatctgcaatagcaaatcttgagagtagcacagatgagagtacaatgttgacagagactgtcggacccgatcagattgcggaagtagttagtcgctggactggaattcctgtctctaggcttggccagaatgagaaggagaaattgattggtcttgctgatagattgcacctaagagttgtcgggcaagatcaagctgttaaagctgttgctgaggctgtgttgaggtctagagctggattaggaaggccacagcaaccaactggttcattccttttcttggggccaactggtgttggaaagactgaacttgctaaagctcttgctgagcagctatttgatgatgacaaattgatggtcagaattgacatgtccgaatacatggaacaacattctgttgcccggttgattggtgctccaccaggttatgttggacatgaggaaggagggcaacttacggaagctgtaaggaggcgcccttacagtgttgtgctatttgacgaagtggaaaaagctcaccctgcagtgtttaatgccttgcttcaagtgttggatgatggaagattaactgatggtcaaggtcgtactgttgatttcaccaacactgtgatcattatgacctcaaatttgggagcagagtatctcttgtcaggattaagtggcaagtgtaccatggagaaggcccgtgaaatggtcatgcaggaggtgaggaagcaatttaagcccgagttactcaacaggctcgatgagattgtggtgttcgatcctttatcacacgagcagttgaggcaagtctgccgtcaccaactgaaagatgtggcaagccgtttagctgagaggggtattgctttgggtgttacagaggccgccttagatgtcatacttgctcagagttatgatccggtgtatggtgcaaggcctattaggaggtggttggagaagaaagttgtaacggagttatcaaagatgcttgtgaaggaggagattgatgagaattcgaccgtgtacatagatgctggacgtggcggaaaagatctaacatatagggtggagaataatggagggcttgtgaatgctgctactggtcaaaaatctgatgtactgattcagctacctaatgggccaaggaatgatgctgctcaagcagtgaagaaaatgaggattgaagaaatagatgacgaagatgatgaaatggcagattaaagagaggttgaaaataacaccatgaaagttgaagatatatgaattattactttttgtttaaaataccctgtatagggttagtccaattttacatcattaagaagtgaacgttcacaagttctctgttgattttgttgtgttgtttctttatgcagcttgaaaatgtctaaatagtaaattgtatttctctgattttctgaaaaataatcttttctccatctttgtgttctgattttcttcaaatttgagcggaaaaagttcaaaatcaactcaatattgtaacaatgattaacaatttgtgtgaattgaccgattctagttgtgttgta

SEQ ID NO: 1854 - DNA, 3139 bp, Solanum phureja
actctctgttttccttaacataaacacctctatcctttctcacttctcaaccgaaaaaaactaaagaagaaagaaacactcgaaactcaaaaacatacatttgattctctccgaagtacaaatcaaaagaaattcgcttgttatctgttaaaagtttattgaaagacagagtaattcatcatgaatcctgaaaaatttactcacaagacaaatgaggctattgctgaggcacatgaactggctgtgtcagcaggccatgctcagttgacacctctgcatatggctttggctttattatctgatcacagtggtattttctggcaagcaattgtcaatgctgctggtagtgaagagacagctaatggtgttgaaagggtgttcaatcaagctaagaagaaaattccttctcagtcaccagcacctgatcaagttccagcaagtacttcacttattaaggtgctgcgacgagcacaatcgttgcagaagtctcgtggtgacagccatttggcggttgatctgttgattttaggccttttggaagattcccaaattgttgatcttttgaaagactctggtcttagtgcagcaagagtgaaatcagaagttgagaaacttagaggaaaggatggaaagaaagtggaaagtgctacaggggataccacattccaagcacttaagacctacggtcgtgatcttgtggaacaagcaggaaaacttgatcctgtgattggtagggatgaagaaatccgaagagtaattcggattctatcgaggaggacaaagaacaatccggtgcttattggtgagcctggtgttggtaaaacagctgtagttgaagggctagcacaaaggattgttcgaggtgatgtcccgagtaacttggctgatgttaggcttatagcattggatatgggagcactcgttgctggagcgaagtacagaggtgaatttgaagagaggttgaaggctgttctgaaggaagtggaagacgcagacgggaaagtaattctcttcatcgatgagatacacttggttttaggtgctggtaggactgaaggatcaatggatgctgccaatttgttcaagccaatgcttgctaggggccaattaaggtgcattggtgcaacaactctggaagagtacaggaagtatgtggagaaagatgctgcattcgaaaggcgtttccagcaggtatacgtcgctgagcctagcgttcccgacactataagtatccttcgagggttgaaggagaagtatgaaggccatcatggtgtcaaaattcaggatagggctcttgttattgcagcccagctttcggctcgatacattacaggtcgacatttgcctgataaggctattgacttagttgatgaggcttgcgcaaatgtgagggttcagcttgatagtcagccagaagaaattgataatcttgaaaggaagaggattcagctagaagttgaacaccatgctcttgaaaaggaaaaagataaggctagcaaagctcgacttgttgaagtgaggaaagagcttgatgatttgagggacaaactccagcctttgatgatgaggtataagaaagagaaggaacggattgatgagcttcgaaggcttaagcaaaagcgcgatgaactcacatatgctttacaagaagctgaaaggagatatgatcttgccagagcagcagatcttagatatggtgccatccaagaagtggaagctgcaatagctaatcttgagagtagcacagatgagagtacaatgttgacagagactgttggacccgatcagattgcggaagtagttagtcgctggactggtattcctgtctcaaggcttggccagaatgagaaggagaaattgattggtcttgctgatagattgcaccaaagagtggttgggcaagatcaagcagttaaagctgtttctgaggctgtgttaaggtctagagctggactaggaaggccacaacaaccaactggttcattccttttcttggggccaactggtgttggaaagactgagcttgcgaaagctctcgctgagcagctctttgatgatgacaagttgatggtcagaattgacatgtccgaatacatggaacaacattctgttgcccgattgattggtgctccaccaggttatgttggacatgaggaaggaggacaacttaccgaagctgtaaggaggcgcccttacagtgttgtgcttttcgacgaagtggaaaaagctcatccaactgtgtttaatgccttgcttcaagtgttggatgatggaagattaactgatggtcaaggtcgtactgttgatttcaccaacactgtgatcattatgacctcaaatttgggagcggagtatctcttgtcaggattaagtggcaagtgcaccatggagaaggcccgcgaaatggtcatgcaggaggtgaggaagcaatttaagcctgagttactgaacaggctcgatgagattgtagtgttcgatcctttatcacacgatcagttgaggcaagtctgccgtcaccaactgaaggatgtggcaggccgtttagctgagatgggtattgcattgggtgttactgaggccgcattagatgtcatactagcacagagctatgatccggtgtatggtgcaaggcctattaggaggtggttggagaagaaagttgtaacagagttatcaaagatgcttgtgaaggaggaaattgatgagaactcgaccgtgtacgtagatgccggacgtggcgggaaagatctaacttatagggtggagaataatggagggcttgtgaatgctgctactgggaaaaaatctgatgtactgattcagctacctaatgggcaaaggaatgatgctgctcaagcagtgaagaaaatgaggattgaggaaatagatgacgaagatgatgaaatggcagcagattaaagagaggttgaataacaccatgaaagttgaatatatatgacttgttacttttgtttaaaatcccatgtgtggggttagtccaattttacatctttaagaagtgaatgcatgttcacaagttctgttgattttgttgtgttgttgctttatgtaacttaaaaatgtctaaatagaaaattgtatttctctgattttctgaaaaaataatctttttctatct

SEQ ID NO: 1855 - DNA, 678 bp, Arabidopsis lyrata
  misc_feature (88)..(88): n is a, c, g, or t
gatctccgtctccgatcaattaacaggtatcgtcttcttcttcttcttatcgattgaattttcaatatcaaatgttaaatccactgtntcgtgatatctccgtctccgatcaattaacagatctacataagcttgtgaagagagatgtcaggaagaggaaagggaggaaaaggattgggaaagggaggagcgaagaggcataggaaggttctgagggataacattcaaggtataaccaagcctgccattcgtcgtcttgctcgcagaggtggtgtcaagcgtatcagtggtctcatctacgaagagaccagaggtgtcctcaagatcttcctcgagaatgtcatccgtgacgccgttacctacactgagcacgccaggaggaagacggtgactgccatggatgttgtctacgctttgaagaggcaaggacgcactctctacggtttcggcggttaatcgaacggttgagattttagtaggagacggaattagtgtgttgtttctgttatcatccacttgtttagtagtaaaaagtaaaacaaggagctgtgtcttgttaagccaatttgatgttccatgtagctagctaaaattcagcaatctctgattggattcttaaatgaaaattctgtttgaaaaccatgatttctactacctaacttaaaatttcactgccga

SEQ ID NO: 1856 - DNA, 547 bp, Arabidopsis lyrata
ttactgaataattttccttttgttcttcacagatcactgtgaagagatgtcaggaagaggaaagggaggaaaaggattgggaaagggaggagcgaagaggcacaggaaggttctgagagataacattcaaggtatcaccaagcctgccattcgtcgtcttgctcgtagaggtggtgtcaagcgtatcagtggtctcatctacgaagagaccagaggtgtcctcaagatcttcctcgagaatgtcatccgtgacgccgttacctacactgagcacgccaggaggaagacggtgactgccatggatgttgtctacgctttgaagaggcaaggacgcactctctacggtttcggcggttaatctggagattagcaagtttgggaatttcttgtttctgagatgtgtgttttaggtttgattagtcaaaaagtaaatccaggagttagttcgttttttttcttgttcttgttgttgttagccaatgtgatgtactagttcaaaatctttgcaaactttctgctaagaaaatcttatgcgaatgatccattt

SEQ ID NO: 1857 - DNA, 471 bp, Arabidopsis lyrata
tcacagatctttgggtatcaagtgaaagtgtgaagagatgtcaggaagaggaaagggaggaaaaggattgggaaagggaggagcgaagaggcataggaaggttctgagggataacattcaaggtataaccaagcctgccattcgtcgtcttgctcgcagaggtggtgtcaagcgtatcagtggtctcatctacgaagagaccagaggtgtcctcaagatcttcctcgagaatgtcatccgtgacgccgttacctacactgagcacgccaggaggaagacggtgactgccatggatgttgtctacgctttgaagaggcaaggacgcactctctacggtttcggcggttaatctggagattagcaagtttgggaatttcttgtttctgagatgtgtgttttagttgttgttgttagccaatgtgatgtactagttcaaaatctttgcaaactttctgctaagaaaatctaatg

SEQ ID NO: 1858 - DNA, 442 bp, Arabidopsis lyrata
gagaaaaatcaaagtttcctgagaaaatgtcaggtcgtggaaagggaggcaaaggattgggcaaaggaggagccaaacgtcacaggaaggttctaagagacaacatccaaggaatcactaagccggcgattcggagattggctcgtagaggtggcgttaagcgtattagtggtctgatctacgaggagacacgtggcgtactcaagatctttttggagaatgttattcgtgacgccgttacttatactgagcacgctcggagaaagacggtgactgctatggatgtcgtttatgctcttaagagacaaggaagaactctctatggattcggcggctagggtttttgattgttgtttttaaatgttaattttcagaatttggtcttaacaccgaaaaaattaaaaaaaaatgaaggatgttgttgcaatttcgtcattgtagt

SEQ ID NO: 1859 - DNA, 528 bp, Arabidopsis lyrata
ctcaaattcatctcaatctcactgttgaatcttcaaatccaaagttttcccgagaaaaatcaaagtttcctgagaaaatgtcaggtcgtggaaagggaggcaaaggtttgggcaaaggaggagccaaacgtcacaggaaggttctgagagataacatccaaggaatcactaagccggcgattcggagattggctcgtagaggtggagtcaagcgtatcagtggtctgatctacgaggagacacgtggcgttctcaagatctttttggagaatgttatccgtgacgccgttacttacactgagcacgctcggagaaagacggtgactgctatggatgttgtttatgctcttaagagacaaggaagaactctctatggattcggcggctagggtttttgattgttgtttttgtgtttttctacgttgcttagaaatgttaattttcagaatttggtgttaattccgaaaaaaacaaaaaaatgaaggatgttgttttgcaataataacagtttctctatgcttgtttagt

SEQ ID NO: 1860 - DNA, 987 bp, Arabidopsis lyrata
  misc_feature (1)..(4): n is a, c, g, or t
  misc_feature (7)..(9): n is a, c, g, or t
nnnnttnnntcaaccataacacattctcactacagattttcattaacctcaaaagttttgattccaagatcaatgttcttaatcctccctattttcccaaataaacacacaactaacctaatttcaagggagaacaaaactagcattctccttaatcacatgtatatctatcacatacaatgttaaccaaacgaagcaaataattttgtgaaagaaaacacaactttcccagagcgctcctttaacttgatgaatcttaccaatagcgtatcaatggctcagatgtcatcagacataataacgcggatagtaaacagatcccacggtttacaatcattagatttaaatcacgcggatagatgataacaaccgtcgataaaatcagatccaacgactctcaactccctaaacttttgtaaaagcactcttcatctcgtctcgtctcatgtatattaataatctcaatttcatttctatcaatcaaacacgatttggcaaaatcaaagaatctttattctaagtttgaatttgattttctcgagaaaatgtcaggccgaggaaagggaggaaaaggattgggaaagggaggagccaagagacatcggaaagttctccgagacaacatccaagggattaccaaacctgcgattcgtcgattggcgagaagaggaggtgtgaaacgtatcagtggtttgatctacgaagagactcgcggcgttctcaagatctttctcgagaacgtgattcgtgacgccgttacttacacggagcacgctcgccggaaaacagttacggcgatggacgtcgtttacgctctcaagagacagggacggactttgtatggattcggcggctaagtcgttatgatttcaatttcggattttgtataaccttcgatttctagggatttcagatttgtaatttcgcagttttatgatgactgaattgaaaaaggaattatcttcgagtttaatttttaatcatata

SEQ ID NO: 1861 - DNA, 590 bp, Arabidopsis lyrata
aatttcacatcttgtctcacccaaatcaacttaaccgttcttcttcctctagcatcaaattctctcgagaaaatctaaatcttcgttgaaaaaatgtcgggccgtggaaagggaggaaagggtttgggtaaaggaggagccaagcgtcacaggaaggtactgagagacaacatccaaggaatcaccaagccggcgattcgaagattggctcgtagaggtggagtcaagcgtattagtggtctgatctacgaggagactcgtggggtcctcaagatctttctcgagaacgtgattcgtgatgctgttacttacaccgagcacgctaggaggaagactgtgaccgccatggatgttgtttacgctctcaagaggcaaggaaggactctttacggtttcggcggttaattggggtttttcagatccgcgtttgtgttttctgggtttcttacttaggccgtttgtgttttacttttgctttaggtatggcgtttagtagtttgcggtagtgttctcgttatgtgtaattacgccttttcttcttgcttcagcagtctctggtgaaatataatcgaattaagtttcaatttatc

SEQ ID NO: 1862 - DNA, 628 bp, Arabidopsis lyrata
aaaaaaaaaaaaagacaattcaactctaacctcgattcttcttcatcacaaactttctcaatcggaaaaaaatgtcgggtcgtggaaagggaggaaaaggtttgggcaaaggaggagcgaagcgtcacaggaaggttctgagagacaacatccaaggaatcaccaagccggcgattcggagactggctcgtagaggtggagtcaagcgtatcagtggtctgatctacgaggagactcgtggcgtcctgaagatctttctcgagaacgtgattcgtgacgctgttacttacaccgagcacgccaggaggaagactgtgaccgccatggatgttgtttacgctctcaagaggcaaggaaggactctttacggattcggcggttaagggtcttcttagattcgcgtttgcgtttctgggtttcttttccggaaatttctaatcaaatcatgttctacttagcgtttgcgtttgaattatgtttgggtacggcgtttatgtgttgcggtagcgtttcgttttatatgtaattacgccttttatcttatgtttttagcgatgcaatgtcgaagtaatccaaggttaagtttctggaaaaatatattcgaattttattttttttttttggtaac

SEQ ID NO: 1863 - DNA, 491 bp, Arabidopsis lyrata
aaaaaaaaactaaatttctcgagaaaatgtcgggtcgtggaaagggaggaaaaggtttgggcaaaggaggagcgaagcgtcacaggaaggttctgagagacaacatccaaggaatcaccaagccggcgattcggagactggctcgtagaggtggagtcaagcgtatcagtggtctgatctacgaggagactcgtggcgtcctgaagatctttctcgagaacgtgattcgtgacgctgttacttacaccgagcacgccaggaggaagactgtgaccgccatggatgttgtttacgctctcaagaggcaaggaaggactctttacggattcggcggttgaacgggggtttttttttgtgtgtttgtagatctgtttctgaaaattaggtttcatgaactcaatgtgggtattttagtaaatgtagtttcctttttttgctatttggcttttgtagtgtgttttcatttgcaaaattctcaacaatggaatcac

SEQ ID NO: 1864 - DNA, 438 bp, Artemisia annua
aaaaaatgtcaggaagaggcaaaggaggaaaaggattaggcaaaggaggagcgaaacgacatcgtaaagtgctccgagacaacatccagggaatcaccaagcccgctattcgtcgtttagcgaggagaggcggcgtgaagaggataagcgggttgatttacgaagagacacgtggcgttctgaagatatttttggagaatgtgataagagatgcggtgacttacactgagcatgcgagaaggaagactgtcactgctatggatgttgtttatgcgctcaagaggcaaggcaggactctttatggttttgggggttaaattagtaattaggtgctgtttggttacatggattagatctggtgttttattattatgttttgttgatgggttatattttaattaatgaaaatgaagattaatttcgacaaatgtcgagcgt

SEQ ID NO: 1865 - DNA, 496 bp, Artemisia annua
aaaaaaatgtcaggaagaggaaagggaggaaagggattaggcaaaggaggagcaaagcgtcacaggaaagtcctccgcgacaacatccaaggtatcaccaagcctgccatccgtcgtcttgctcgtcgtggaggtgtgaagcgtatcagcggtctgatttacgaggagacacgtggcgtcctcaagatctttttggagaatgtgatccgtgatgccgtcacctacactgagcacgctcgccgtaagacagtgactgcaatggatgtggtgtacgcgttgaagaggcaaggaaggaccctttacgggtttgggggttagagttgaaattagggtttgttgttatggttaggatgtggaagttgttatgtggttaagattgttatgttttagatctggttaggtgcttgtgtagatggggtttgttacatcttgtaattgaatctctgtttcggattaatatgagttttagtattttctgtttaaaaaaaaaaaaaaa

SEQ ID NO: 1866 - DNA, 467 bp, Artemisia annua
aaaaaaaatgtcaggaagaggaaagggaggaaagggactaggcaaaggaggagcaaagcgtcatcgtaaagtactccgcgacaacattcaaggtatcaccaaacctgctattaggagattagccagacgtggtggtgtgaagcgtatcagcggtcttatctacgaggagacacgtggcgtgttgaagatatttttggagaatgtgatccgtgatgctgttacttacactgaacacgctcgccgtaaaactgtcactgctatggatgttgtttatgccttgaagagacaaggccgtaccctctatggttttggtggctagatagatttaacttagggtttcatatgtgtatctgtttttgttatattatgtaataattgaaggttgattcagaattaatatctatgttatcgttttgtttcatcttcttgttttttagtttgtgtatttaatggggtgtttggattag

SEQ ID NO: 1867 - DNA, 463 bp, Artemisia annua
caaactttcattcataatcaaccaaaactcaaaaaagaaagacaataatgtcaggacgtgggaagggaggaaagggactaggcaaaggcggagcgaagcgtcacaggaaagtgttacgagacaacattcaaggaatcacgaaacccgcgataagacggttggcgagacgaggaggagtgaagaggataagcgggttgatttacgaagagacgagaggtgttttgaagatctttttggagaatgttatccgtgacgctgttacgtacactgagcatgcgagaaggaagactgttactgctatggatgttgtttatgctcttaagagacaaggcaggactttgtatggtttcgggggttagatagttctttaaaatgatgttgttgttacgatgttctttgtatggttttatggatctattgtgtaattgaaactttgtcaatgaaatgaatctcactttagctt

SEQ ID NO: 1868 - DNA, 506 bp, Artemisia annua
gacaatcaatcttctcacacatagtttcagatctcgttactacacaaaaccaaacgaaaatgtcaggaagaggaaagggaggaaagggactaggcaaaggaggagcaaagcgtcacaggaaggttctccgtgacaacatccaaggtatcaccaagcccgccatccgtcgtctggctcgtcgtggtggagtcaagcgtatcagtgggcttatctacgaagagacacgtggcgttctcaagatctttttggagaatgtgattcgtgatgctgtgacctacactgagcatgctaggaggaagactgttactgctatggatgttgtctatgctctcaagaggcaaggccgtaccctttatggtttcggcgggtagatctagggtttctagggttagggtttcgaagttggggcttattgtgttgtttagtgattaatgattaatatctgattaatcattttaatttgtatttcgtattttatgttttaatgaaatgaaatttgaattctg

SEQ ID NO: 1869 - DNA, 613 bp, Artemisia annua
acgagtgcgttttcattctctgttgcaatttcattctgcacaattcctttctaccaaacatccccaaattcattcaaaatcaaaaaatgtcaggaagaggaaagggaggaaagggattaggcaaaggaggagcaaagcgtcatcgcaaggttcttcgcgacaacatccagggtatcaccaagcctgccatccgtcgtctggctcgtcgtggaggtgtgaagcgtatcagcggtctgatttacgaagagacacgtggcgtcctcaagatctttttggagaatgtcatccgtgatgctgtcacctacactgagcacgctcgccgtaagacagtgactgcaatggatgtggtttatgctttgaagaggcaaggaaggactctctacgggtttgggggttagagtggaaattagggtttgttagggtttggttatggtgtttgttaatctttcagatgtggttaggtggttgttatgctttagatctggttagttggttatgtgtagaggtgttctgttatatcttgtaactggagcttggtttggaattaatatgatgttatcgtttggctaaaaaaaaaaaaaaaaaacatgttggatctagaattgtcgagcgt

SEQ ID NO: 1870 - DNA, 570 bp, Artemisia annua
agtggtatcacgcagtactccgacggggaaacacacacaaataacaatcaattaaaccaaacaccccaaattcattcaaaatcaaaaaatgtcaggaagaggaaagggaggaaagggattaggcaaaggaggagcaaagcgtcacaggaaagtcctccgcgataacatccagggtatcaccaagcctgccatccgtcgtctggctcgtcgtgggggtgtgaagcgtatcagcggtctgatttacgaagagacacgtggcgtcctcaagatctttttggagaatgtgatccgtgatgccgtcacctacaccgagcacgctcgccgtaagacagtgactgcaatggatgtggtttatgctttgaagaggcaaggaaggactctctacgggtttgggggttagagtggaatttagggtttgttagggtttggttatggtgtttgttaatctttcagatgtggttaggtggttgttatgctttagatctggttagttggttatgtgtagaggtgttctgttatatcttgtaactggagcttggtttggaattaatatgatgttatcgtttggtc

SEQ ID NO: 1871 - DNA, 614 bp, Artemisia annua
acatagtttcagatccgtcactacacaaaaccaaacgaaaatgtcaggaagaggaaagggaggaaaaggactaggcaaaggaggagcaaagcgtcacaggaaggttctccgtgacaacatccaaggtatcactaaacccgccatccgtcgtctggctcgtagaggcggagtgaagcgtatcagtgggcttatctacgaagagacacgtggcgttctcaagatctttttggagaatgtgattcgtgatgctgttacctacactgagcatgctaggaggaagactgttactgctatggatgttgtctatgctctcaaaaggcaaggaaggactttgtatggatttggtggttaggtgtgtttgggattgggttttaagtcttgctgtcaagaaagaaatgtgtttagggttatttctgttgagatttggatggtttagttagcgtttcgttggtattgaatgtagttagtgtttgtggttagatgttttaatgatgaatcaagtaatgaagttgattttcttatcaatttgagtttgttttttgctgaattgatgttgtgttgctgaattgattttcgtatcaaattgagtttgtttcgtaccaaaacgcactcgt

SEQ ID NO: 1872 - DNA, 458 bp, Artemisia annua
atcaaaaacccaattaactttcattcaatcaattaaaaaacttaaaaaatgtcaggacgtgggaagggaggaaagggattaggcaaaggcggagcgaagcgccacaggaaagtgttaagagacaacattcaaggaatcacaaagccggctattcgccgtttagctcgtagaggtggagtcaagaggatcagcgggttgatttacgaagagaccagaggtgttttgaagatctttttggagaatgttatccgtgacgctgtcacctacactgagcacgctcgccgtaaaactgtcactgctatggatgttgtttatgctctcaagagacaaggcaggactttgtatggtttcgggggttaggttgattagtattatgttgtcgttacgatgttctttgtacggttttatggttgtattgtgtaattgaaagttcatcaatccaatgaatctgaatttag

SEQ ID NO: 1873 - DNA, 704 bp, Artemisia annua
acgagtgcgtaagcagtggtatcaacgtctagtactccaacggggacacacaaaaaacaatcaattaatccaaacacccctaaattcattcaaaatcaagaaatgtcaggaagaggaaagggaggaaagggattaggcaaaggaggagcaaagcgtcatcgcaaggttcttcgcgataacatccagggtatcaccaagcctgccatccgtcgtttggctcgtcgtggtggtgtgaagcgtatcagcggtctgatttacgaggagacacgtggcgtcctcaagatctttttggagaatgtgatccgtgatgccgtcacctacaccgagcacgctcgccgtaagacagtgactgcaatggatgtggtttatgcgttgaagaggcaaggaaggactctttacgggtttgggggttagacttgaaattagggtttgttgttatggttaggctgtggttgttgttatgtgtttaagtttgttatgttttagatctggttaggtgcttgtgtagatggggtttgttacatcttgtaattgaatctctatttcggattaatatgaatttaagtattttctgttccaaaaaaatggcaccaaaggcagcagagaagaaacccgcagcggagaagaagccagcagcagaaaggcaccaagcccaaagccgagaagaagctcccagcaaaggacacgtcaggagacaagaagaa

SEQ ID NO: 1874 - DNA, 473 bp, Artemisia annua
ccgacggggacacacacaaataacaatcaattaatccaaacatccccaaacaaaaaatgtcaggaagaggaaagggaggaaagggattgggcaaaggaggagcaaagcgtcatcgcaaggttcttcgcgataacatccagggtatcaccaagcctgccatccgtcgtttggctcgtcgtggaggtgtgaagcgtatcagcggtctgatttacgaggagacacgtggcgtcctcaagatctttttggagaatgtgatccgtgatgccgtcacctacaccgagcacgctcgccgtaagacagtgactgcaatggatgtggtttatgctttgaagaggcaaggaaggactctctacgggtttgggggttagggttgaaattagggtttgttgttatggttagggtgctagtattgggaagatcttgttgttgatatatctttgtgtgattgcaatttggaatggaatatcagttta

SEQ ID NO: 1875 - DNA, 481 bp, Artemisia annua
aaaaaacatttcaaaatctcaatttgttcaacgatgtcgggccgtggaaagggaggaaaaggactaggcaaaggcggagcgaaaagacacaggaaggtgctcagggacaacatccaggggatcacgaagcctgcgattaggcggttggccagacgaggaggcgtgaagaggataagcgggttgatttacgaagagacgcgaggcgttctgaagatatttttggagaatgtgattagagatgcggtgacttatactgagcatgctagaaggaagactgttactgctatggatgttgtttacgcgcttaagaggcaaggaaggactttgtatggcttcggcggttaaggaataaggattgttgttatgagttagttgtgtttttaggtgtttggttatgttggtttagtgtttagatttggtgtttgagtatgtagatttaatgttgtgatgttggaatgaaatgaatttggtgttttgtttt

SEQ ID NO: 1876 - DNA, 428 bp, Artemisia annua
aaaaaatgtcaggacgtgggaagggaggaaagggactcggcaaagggggagcgaagcgtcacaggaaagtgttgagagacaacattcaaggaatcacaaagccggctattcgtcgtttagctcgtaggggaggagtgaagaggatcagcggcttgatttacgaagagaccagaggtgttttgaagatcttcttggagaacgtcatccgtgatgctgtcacctacacggagcacgctcgccgtaaaactgtcactgctatggatgttgtttatgctctcaagagacaaggcaggactttgtatggttttgggggttaggttgattagtattatgttgtcgttacgatgttcgttgtatggttttatggatgatgtattgtgtaattggaagttcatcaatcgaatgaaatgaatgaatgttattggtta

SEQ ID NO: 1877 - DNA, 475 bp, Artemisia annua
aaatgtcaggaagaggaaagggaggaaagggattgggcaaaggaggagcaaagcgtcatcgcaaggttcttcgcgataacatccagggtatcaccaagcctgccatccgtcgtctggctcgtcgtggtggtgtgaagcgtatcagcggtctgatttacgaggagacacgtggcgtcctcaagatctttttggagaatgtgatccgtgatgccgtcacctacaccgagcacgctcgccgtaagacagtgactgcaatggatgtggtgtacgcgttgaagaggcaaggaaggactctttacgggtttgggggttagagttgaaattagggtttgttgttatggttaggatgtggaagttgttatgtggttaagtttgttatgttttagatctggttaggtgcttgtgtagatggggtttgttacatcttgtaattgaatctctgttgcgaattaatatgaattttagtattttctgt

SEQ ID NO: 1878 - DNA, 620 bp, Artemisia annua
aaatcaatttcatttctaattaaaacagaacataaaaagagatgtcaggacgtggaaagggaggaaaggggttaggcaaaggaggagcaaaacgacaccgtaaagtcctccgcgacaacatccaaggaatcactaaacccgctattcgtcgtttggcacgcagaggtggagtgaagcgtatcagtggtttgatttacgaggagacacgtggcgtgttgaagatatttttggagaatgtgattagagatgctgttacttacactgagcacgccagaaggaagactgtgactgctatggatgttgtgtacgcgctcaagaggcaaggaaggacgctttatgggtttggtggttagaggtggtgtttggttgaggggttgtgggattaagacttgattagggatagtgtttggatttgtgtgttggtgtttggttttgtggatgtaaagatgttggttgtttagatgtttgatttgtgatggaatgaattcaagttttagttatatgttttttactgtttgacttgtgttttatttggttgtttagatgtttgattttagttaattgctaccaacaagcagattgtttatgaaattttctgttgtttcgaaaactcgcgatat

SEQ ID NO: 1879 - DNA, 560 bp, Artemisia annua
agtactccgacggggatcacaatcaattctcacacacatagtttcagatcccgttaccaaacagaacagtaaaaatgtcaggaagaggaaagggaggaaaaggactaggcaaaggaggagcaaagcgtcacaggaaggttctccgtgacaacatccaaggtatcactaaacccgccatccgtcgtcttgctcgtcgtggtggagtcaagcgtatcagtgggcttatctatgaagagacacgtggcgtgttgaagatctttttggagaatgtgatccgtgatgctgttacctacactgagcacgctaggaggaagactgttactgctatggatgttgtctatgctctcaagaggcaaggaaggactttgtatgggtttggtggttaggtgtgtttgggattgggttttaagtcttgctgtcaagaaagaaatgtgtttagggttgattctgtttggaatttggatggtttagttagtgtttcgttggtattgaatgtagttagtgtttgttgttagatgttttaatgatgaatcaagtaatgaagttgattttcgtaaaaa

SEQ ID NO: 1880 - DNA, 469 bp, Artemisia annua
ataaaaaaaagagagagatgtcaggaagagggaaaggaggaaaaggattaggcaaaggaggagcaaaacgacatcgtaaagtgctccgagacaacatccaggggatcaccaagcctgctattcgtcgtttagcacgtagaggaggagtgaagaggataagcgggttgatttacgaggagacacgtggcgttctcaagatctttctagagaatgttatccgtgatgctgtcacctacactgagcacgctcgccgtaagacagtgactgcgatggatgttgtttatgctttgaaaagacaaggccggactctctacggtttcggtggttaagtcaattagctgctgatggttagatggatttagatctggtgtttggttagatggattagatctgtttattgtattaggtttaattattatgtgttatgtttttaagtgggatgtatgatattttaatcaatgaatatgaa

SEQ ID NO: 1881 - DNA, 488 bp, Artemisia annua
aaaaaaatgtcaggaagaggaaagggaggaaagggattaggcaaaggaggagcaaagcgtcatcgcaaggttcttcgcgataacatccagggtatcaccaagcctgccatccgtcgtttggctcgtcgtggaggtgtgaagcgtatcagcggtctgatttacgaagagacacgtggcgtcctcaagatatttttggagaatgtcatccgtgatgctgtcacctacaccgagcacgctcgccgtaagacagtgactgcaatggatgtggtttatgctttgaagaggcaaggaaggactctctacgggtttgggggttagagttgaaattagggtttgttagggtttggttatggtgtttgttaatctttcagatgtggttaggtggttgttatgctttagatctggttagttggttatgtgtagaggtgttctgttatatcttgtaactggagcttgatttggaattaatatgaatgttatcgtttggt

SEQ ID NO: 1882 - DNA, 488 bp, Artemisia annua
tatcataaaaagtgagagagaaatgtcaggaagagggaaaggagggaagggattaggcaaaggaggagcgaaacgacatcgtaaggtgctccgagacaacatccagggaatcaccaagcctgccattcgtcgtttagcacgtagaggaggtgtgaagaggataagcgggttgatttacgaggagacacgtggcgttctcaagatatttctagagaatgttatccgtgatgctgtcacctacactgagcacgctagaaggaagacggtcactgcgatggatgttgtttatgctttgaagagacaaggccgtactctctacggtttcggtggttaatttaattagctgctgtttggttagatggatttagatctggtgtttggttagatggattagatctggtttattgtattaggttttattattagtaagtgttgttgatgtattaaagtggatgtatgatattttaatcaatgaacatgaagctctt

SEQ ID NO: 1883 - DNA, 521 bp, Artemisia annua
agcactgtagacggtccagactcctacggggaaacacaccaaatccaattctaaaaaatgtcaggaagagggaaaggaggaaagggattaggcaaaggaggagcaaaacgacatcgtaaggtgcttcgtgataatattcaaggaatcactaagccagcgataaggaggttagcgagaagaggcggagtgaagaggataagcgggttgatttacgaggagacacgtggcgttctgaagatatttttggagaatgtgattagagatgcggtgacgtacactgagcatgcgagaaggaagacagtcactgctatggatgttgtttatgctttgaagagacaaggaaggactctttatggtttcggtggttaaattattaattaggtggtgtttggttagatggataatggattagatctggtttattattgtgttatgttttgttatggttgtgtagtttaatttaagatgtgtttaatgaatggaatttaaatcctgtttcggttgttctaaatgtcgagcgt

SEQ ID NO: 1884 - DNA, 687 bp, Artemisia annua
tctcaatccaacgtctccccttactttccagaaaacacaaaaaagtcccacctaccggtatataaacccacgcccctaattccacacaacacaatccatcaatccaaacacccccagattcaatttaataaaaaatgtcaggaagaggaaagggagggaaggggttaggcaaaggaggagcgaaacgacatcgtaaagtgctccgcgacaacatccagggaatcaccaaacctgccatcaggaggttagcgagaagaggcggtgtgaagcgtattagcgggttgatttacgaagagacacgtggcgtgttgaagatatttttggagaatgtgattcgggatgctgtgacttacactgagcatgcgagaaggaaaacagtgacagctatggatgttgtttatgctctgaagaggcaaggaaggactctttatggctttgggggttagactttgttgttgttatggatgtcttttaggtgctagtaatcagaagatcttattttgttgatatatctttttgtaattggaatttggaatggactatcagtttattttctgttgttacacttttcaacttgggatttatatttatatatgtggaacttgttagaaaattattgctgtaatgtaactggttcgacaattattgttatttataaaacaaggtacctgatttgttggctccaaa

SEQ ID NO: 1885 - DNA, 556 bp, Artemisia annua
actccgacgggacacacacaaataacaatcaattaaaccaaacatccccaaattcattcaaaatcaaaaaatgtcaggaagaggaaagggaggaaagggtttgggcaaaggaggagcaaagcgtcatcgcaaggttcttcgcgataacatccagggtatcaccaagcctgccatccgtcgtcttgctcgtcgtggtggtgtgaagcgtatcagcggtctgatttacgaagagacacgtggcgtcctcaagatctttttggagaatgtgatccgtgatgctgtaacctacactgagcatgctcgccgtaagacagtgactgcaatggatgtggtttatgctttgaagagacaaggccgtactctctacgggtttgggggttagagttgaaattagggtttggttatggtgtttgttaatctttcagatgtggttaggtggttgttatgctttagatctggttagttggttatgtgtagatgagttctgttatatcttgtaactggagcttgatttggaattaatatgaatgttttcgtttagttttatctcgttata

SEQ ID NO: 1886 - DNA, 480 bp, Artemisia annua
acacaaacaacaatcaattaatacataaacccccaaattcaaaatcaataaaatgtcaggaagaggaaagggaggaaagggattaggcaaaggaggagcaaagcgtcacaggaaagttctccgtgacaacatccaaggtatcaccaagcctgccatccgtcgtcttgctcgtcgtggaggagtgaagcgtatcagcggtctgatttacgaagagacacgtggcgtgttgaagatctttttggagaatgtgattcgtgatgcagtcacctacaccgagcacgctcgccgcaagactgtgactgcaatggatgtggtttatgctttgaagaggcaaggaaggaccctctacgggtttgggggttaggttcacattagggtttgttgtaatggttagggtggtagtaatgagaagatcttgttgttgatatatctttgtgtaattgcaatttggaatggaatatcagtttattttgatgccaa

SEQ ID NO: 1887 - DNA, 556 bp, Artemisia annua
ccgacggggatcacaatcaattctcacacacatagtttcagttacagatctcgttactacacagaaccaagcaaaaatgtcaggaagaggaaagggaggaaaaggactaggcaaaggaggagcaaagcgtcacaggaaggttctccgtgacaacatccaaggtatcaccaagcccgccatccgtcgtcttgctcgtcgtggtggagtgaagcgtatcagtgggcttatctacgaagagacacgtggcgttctgaagatctttttggagaatgtgatccgtgatgctgttacctacactgagcatgcgaggaggaagactgttactgctatggatgttgtctatgctctcaagaggcaaggaaggactttgtatgggtttggtggttaggtgtgtttgggattgggttttaagtcttgctgtcaagaaagaaatgtgtttagggttgattctgtttggaatttggatggtttagttagtgttttgttggtgttgaatgtagttagtgtttgttgttagatgttttaatgatgaatcaagtaatgaagttgattttcg

SEQ ID NO: 1888 - DNA, 561 bp, Artemisia annua
tggccattacggccgggggaaccgtccattttcatttcattatcccgcttcaaaaaaattcaaaaaaaccccaaaaccataactgtttataaaaacccaactccacatttcaccaaaaacataaaactttttcattcaatcaaaaacccagaaaggaaatcatgtcaggacgtgggaagggaggaaagggactaggcaaaggcggagcaaagcgtcacaggaaagtgttaagagacaacattcaagggattacgaaacccgcgattagacggttggcgagacgaggaggagtgaagaggataagcgggttgatttacgaagagaccagaggtgttttgaagatctttttggagaatgtgattcgtgacgctgttacttacactgagcatgctagaaggaagactgttactgctatggatgttgtttatgctctcaaaagacaaggcaggactctctacggcttcgggggttaggtcaattagtacgatgttgtttgtacggttttatggatgtattgtgtaattggaactttgtcaatcaaatcaaaatgaatgttattgg

SEQ ID NO: 1889 - DNA, 558 bp, Artemisia annua
gtggtatcaacgcagtactccgacggggacacacaatcacacaaaacccaaatccaaacacaccccaattcaaaaaaaatgtcaggaagaggaaagggaggaaagggactaggcaaaggaggagctaagcgtcacaggaaggttctccgtgacaacatccaaggtatcactaagcctgctatccgtcgtcttgctcgtagaggtggagtgaagcgtatcagtgggcttatctatgaagagacacgtggcgtgttgaagatctttttggagaatgtgatccgtgatgctgttacctacactgagcatgctaggaggaagactgtgactgctatggacgttgtctatgctctcaagaggcaaggaaggactttgtatggatttggtggttaggtgtgtttgggattgggttttaagtcttgctgtcaagaaagaaatgtgtttagggttatttctgttgagatttggatggtttagttagcgtttcgttggtattgaatgtagttagtgtttgtggttagatgttttaatgatgaatcaagtaatgaagttgattttctt

SEQ ID NO: 1890 - DNA, 492 bp, Artemisia annua
tactccgacggggacaatcaattctaacacacatagtttcagatctcgttactacacaaaaccatacgaaaatgtcaggacgtgggaagggaggaaagggactaggcaaaggcggagcaaagcgtcacaggaaagtgctaagagacaacattcaaggaatcacaaaacccgcgataagacggttggcgagacgaggaggagtgaagaggataagcgggttgatttacgaagagacgagaggtgttttgaagatctttttggagaatgttatccgtgatgctgttacgtatactgagcacgctagaaggaagactgttactgctatggatgttgtttatgctttgaaaagacaaggcaggactttgtacggcttcgggggttaaaaagttgttttagaattagtactttgttgtcatgatgttcttggtacggttttatggatctgttgtgtaatcgaaagtttatacatgaaatgaatgttattggttattg

SEQ ID NO: 1891 - DNA, 638 bp, Artemisia annua
atcacgcagtactccgacggggacattcaaatcaaaaccaatttttatataaaaagaatatataaaaatgtcagggagagggaaaggagggaagggattggggaaaggaggagcgaaacgacatcgtaaggttctacgagacaacatccagggaatcacaaagcctgccattcgtcgtttagcacgtagaggaggtgtgaagaggataagcgggttgatttacgaggagacacgtggcgttctcaagatctttctagagaatgttatccgtgatgctgtcacctacactgagcacgctcgccgtaagacagtgaccgcgatggatgttgtttatgctttgaagagacaaggccgtactctctatggttttggtggttagattaattacctgctgtttggttacatgatttagatctggtgtttattaggttttattattattattataaatgtattgttgattagaagtgatgtattattgtaatgatgttcagtcaacgaaattcaagttcttattcggtttatgtaatctaatatttctctcacgcatcggttctattacaagttatcgaatctatgaatctattcactcttttttatattatttttttttattgttccatatatgtctgctttaa

SEQ ID NO: 1892 - DNA, 539 bp, Artemisia annua
aaatcactcatacacaaatcactcatcacatcttttagattttgaaaatgtcaggacgtggaaagggaggaaaaggattaggcaaaggaggagcaaaacgacaccgtaaagtactccgtgacaacattcaaggaatcactaaaccggctattcgtcgtttagcacgtagaggtggagtgaagcgtatcagtggtttgatttacgaggagacacgtggcgtgttgaagatctttttggagaatgtgattagagatgctgttacttacactgagcacgccagaaggaagactgttactgctatggatgttgtttatgcgctcaagaggcaaggaaggactttgtatgggtttggtggttaaggaggtgtttggttgggggattaaagaaggaagttaggatgtttggatttgtgttttggtgttggtttagtgtttggttatgtgaatgtaaagatgttggctgtttagatgtttgatttgtgatatttgatggaatgaatggagttttggttaccatggattagctccaccattgccccc

SEQ ID NO: 1893 - DNA, 491 bp, Artemisia annua
taccccaacggggacaacacaatccattaatccaaacatccccaaattcattcaaaatcaaaaaatgtcaggaagaggaaagggaggaaagggtttgggcaaaggaggagcaaagcgtcatcgcaaggtgctccgtgacaacatccaaggtatcaccaagcctgccatccgtcgtctggctcgtcgtggtggtgtgaagcgtatcagcggtctgatttacgaggagacacgtggcgtgttgaagatctttttggagaatgtgatccgtgatgccgttacctacaccgagcacgctcgccgtaagacagtgaccgctatggatgtggtttatgctttgaagagacaaggccgtactctctatgggtttgggggttaggttgaagttagggtttgttgttatggttagggtgttagtaatgagaagatcttgttgatatatctttgtgtaattgcaatttggaatggaatatcagtttaattttcatgccaaa

SEQ ID NO: 1894 - DNA, 488 bp, Artemisia annua
ggtatcaacgcagtactccgacggggacaccaatccatttcaaaatccaaaaaaaaaaatgtcaggaagaggtaaaggaggcaaaggactaggaaagggaggcgcaaagcgtcaccgaaaagttctccgtgacaacattcaaggaatcacgaagcccgcgataaggcggttggcgcgtagaggtggagtgaaaaggatcagcgggttgatttatgaagagacgcgtggtgtgttgaagatatttttggagaatgtgattagagatgcggttacgtatactgagcatgccagaaggaagactgttactgctatggacgttgtttatgcgctgaagcgtcaaggaaggacactttatggttttggtggttaattaggttttgtgtagagatgtttcgaatgttatgtgatgccgagtttaagctgtttgtattttggaattatgttagatctatggaatttaagtagtttattatcgaaatgtcgagcgt

SEQ ID NO: 1895 - DNA, 531 bp, Artemisia annua
tcaacgcagtactccgacggggacacaaacaacaatcaattaatcccaacacccccaaattcattcaaaatcaaaaaatgtcaggaagagggaagggaggaaaggggttgggcaaaggaggagcaaagcgtcatcgtaaggtgctccgtgacaacatccaaggtatcaccaagcctgccatacgtcgtttggctcgtcgtggtggtgtgaagcgtatcagcggtttgatttacgaggagacacgtggcgtgttgaagatctttttggagaatgtgatccgtgatgcagtcacctacactgagcacgctcgccgtaagacagtgactgcaatggatgtggtttatgctttgaagagacaaggaaggaccctctacgggtttgggggttagatttgaaattagggtttgttgttatggttagggtgctagtattgggaagatcttgttgatatatctttgtgtaattgcaatttggaatggaatatcagtttaattttcatgtccaaaaaaaaaaaaaaaagtcggactagaa

SEQ ID NO: 1896 - DNA, 473 bp, Artemisia annua
tcaacgcagtactccaacggggacaccaatccaattcaaaatccaaaaaaaaaaatgtcaggaagaggtaaaggaggcaaagggctaggcaagggaggcgcaaagcgtcaccgaaaagttctccgtgacaacattcaaggaatcacgaagcctgcgataaggcggttggcgcgtagaggtggagtgaagaggatcagcgggttgatttacgaagagacgcgaggtgtgttgaagatatttttggagaatgtgattagagatgcggttacgtatactgagcatgccagaaggaagactgttactgctatggacgttgtttatgcgctgaagcgtcaaggaaggacgctatatggttttggtggttaattaggctttgtgtagagatgtttcgaatgttctgtgattgcgagtttaagatgatttgtattttgaaattatgttcatctatgaaatttaagtagcttgttatcaaa

SEQ ID NO: 1897 - DNA, 507 bp, Artemisia annua
agcactgtagaagcatggtatcaacgcagtactccgacggggacaccaatccatttcaaaatccaaaaaaaaaatgtcaggaagaggtaaaggcggcaagggactaggaaagggaggcgcaaaacgtcaccgaaaagttctccgtgacaacattcaaggaatcacgaagcccgcgataaggcgtttggcgcgtagaggtggagtgaagaggatcagcgggttgatttacgaagagacgcgaggtgtgttgaagatatttttggagaatgtgattagagatgcggttacgtatactgagcatgcccgaaggaagactgttactgctatggacgttgtttatgcgttgaagcgtcaagggcgtacgctttatggttttggtggttaattaggctttgtgtagagatgtttcgaatgttctgtgattgcgagtttaagatgatttgtattttgaaattatgttcatctatgaaatttaagtagtttgttgaccaaaaaaaaaaaaaaaaa

SEQ ID NO: 1898 - DNA, 516 bp, Artemisia annua
aatccaaacatccccaaattcattcaaaatcaaaaaatgtcaggaagaggaaagggaggaaagggattgggcaaaggaggagcaaagcgtcatcgcaaggttcttcgcgataacatccagggtatcaccaagcctgccatccgtcgtctggctcgtcgtggaggagtgaagcgtatcagcggtctgatttacgaagagacacgtggcgtcctcaagatctttttggagaatgtgatccgtgatgccgtcacctacaccgagcacgctcgccgtaagacagtgactgctatggatgtggtttatgctctgaagaggcaaggaaggactctttacgggtttgggggttaggttcacattagggtttggttatggtgtttgttaatctttcagatgtggttaggtggttgttatgctttagatctggttagttggttatgtgtagatgagttctgttatatcttgtaactggagcttgatttggaattaatatgaatgttttcgtttagttttatctcg

SEQ ID NO: 1899 - DNA, 545 bp, Artemisia annua
tcaaattagcttatatataaaaaaaaatcgatctctaaaaagatgtcaggaagagggaaaggagggaagggattaggcaaaggaggagcgaaacgacatcgtaaggtcctccgagacaacatccagggtatcaccaagcctgccattcgtcgtttagcacgtagaggaggagtgaagaggataagcggcttgatttacgaggagacacgtggcgttctcaagatatttctagagaatgttatccgtgatgctgtcacctacactgagcacgctagaaggaagacagtcactgcaatggatgttgtttatgctttgaagagacaaggccgtactctctacggtttcggtggttaaattaattagcttctgtttggttacatggattatttagatcttggtgtttggttaggtggattagatctggtttattgtgttaggttttattattagtaagtgatgttaatgtattaaggtggatgtatgatattttaatcaatgaacatgaagctcttattggacaaaaaaaaaaaaaagttggactagaa

SEQ ID NO: 1900 - DNA, 488 bp, Artemisia annua
atgtcaggacgcgggaagggaggaaagggactaggcaaaggaggagcaaagcgtcacaggaaggttctccgtgacaacatccaaggtatcaccaagcccgccatccgtcgtttggctcgtagaggtggagtgaagcgtatcagtgggcttatctacgaagagacacgtggcgttctcaagatctttttggagaatgtgatccgtgatgctgtgacctacactgagcacgcgaggaggaagactgttactgctatggatgtcgtctatgctctcaagaggcagggaaggactttgtatgggtttggtggttaggtgtttttgggattgggttttaagtcttgctgtcaagaaagaaatgtgtttagggtttaagtctgtttggaatttggatggtttagttagcgttttgttggtattgtatgtagttagtgtttgtggttagttgttttaatgatgaatcaagtaatgaagttgattttcgtatcaaa

SEQ ID NO: 1901 - DNA, 619 bp, Artemisia annua
aaatcactcatattcatttccctcatcacatctttcagattttggatatgtcaggacgtggaaagggaggaaaaggattaggcaaaggaggagcaaaacgacaccgtaaagtactccgtgacaacattcaaggaatcactaaaccggctattcgtcgtttagcacgtagaggtggagtgaagcgtatcagtggtttgatttacgaagagacacgtggcgtgttgaagatatttttggagaatgtgattagagatgctgttacgtatactgagcatgctagaaggaagactgttactgctatggatgttgtttatgcgctcaagaggcagggaaggactttgtatgggtttggtggttagggaggtgtttggttggggttttaaagaaggaagttagggtgtttggatttgtgttttgatgttggtttagtgtttggttatgtgaatgtaaagatgttggttgtttagatgtctgatttgtgatatttgatggaatgaatggagttttggttactatggatctgtaattctaatagattgacttgtgtttgtttgattgtagtgtttgaaatggtctatttaaactgcatattagcttaaatatgagttgtttgggcaaa

SEQ ID NO: 1902 - DNA, 472 bp, Artemisia annua
aaaaaaatgtcaggaagaggaaagggaggaaaaggactaggcaaaggaggagcaaagcgtcacaggaaggttctccgtgacaacatccaaggtatcactaaacccgccatccgtcgtcttgctcgtcgaggtggagtgaagcgtatcagtgggcttatctacgaagagacacgtggcgttctgaagatctttttggagaatgtgatccgtgatgctgttacctacactgagcacgctaggaggaagactgttactgccatggatgttgtctatgctctcaagagacaaggacgtaccctttatggtttcggcgggtagatctagggtttctagggttagggtttcgaagttggggcttattgtgttgtttagtgattaatgattaatatctgattaatcattttaatttgtatttcgtattttatgttttaatgaaatgaaatttgaattctgtttaaaaaaaaaaaaaaaa

SEQ ID NO: 1903 - DNA, 917 bp, Artemisia annua
agacgcactctaagtctagttggtatcaacgcagtactccgacggggaaatcacaaattcaaatcaaaaccaattttcaaaattaaaaaaagagagagatgtcaggaagagggaaaggaggaaagggattgggcaaaggaggagcgaaacgacatcgtaaggtgctccgagacaacatccagggtatcaccaagcctgccattcgccgtttagcacgcagaggaggagtgaagaggataagcgggttgatttacgaggagacacgtggcgttctcaagatatttctagagaatgttatccgtgatgctgtcacttacactgagcacgcgagaaggaagacagtgactgcgatggatgtcgtttatgctttgaagagacaaggccgtaccctctacggttttggtggttagattaattatctgctgtttggttaggtggattagatctggtgtttattaggtttggttaaattaggtggtgtttggttagatatggtgtttattttgttttcttattatgaatgtgttgttgattagaagtgatgtattattgtaatgatgttcagtcaacgaaattgaaggtcttatttggccaatataaacggcagaaaggcacattttaaacacgacaaacttccaattcacacatatatcgcattacggaaatatgaaatcatcaacaactacagtagtaggcaacactcaatacacatattacggaaaacacatattaaaaacacgaacaagaatcgacaaaacatacacttgcttcatttcatttcttcatggcgtcaacttcatccgcagtaggcggcacttccttctccgcattcgcaacggcaacatactccccattcttaacatgacccccccctccacgtcatcaaaaaactcctcctcatcagaaatcaaaatcct

SEQ ID NO: 1904 - DNA, 513 bp, Artemisia annua
tacttgtttgctatcggtctcacgccagtatttagccttggacggaatttaccgccctattggggctgcattcccaaacaaccctaaattcaaaatcaaaaaatgtcaggaagaggaaagggaggaaaggggttaggcaaaggaggagcaaagcgtcatcgtaaggtgctccgtgacaacatccaaggtatcaccaagcctgccatccgtcgtttggctcgtcgtgggggtgtgaagcgtatcagcggtctgatttacgaagagacacgtggcgtgttgaagatctttttggagaatgtgatccgtgatgctgtcacctacaccgagcacgctcgccgtaagacagtgactgctatggatgttgtttatgctctcaagagacaaggcaggactttgtatggtttcggcggttagaaagggaattagtattatgtcgtcacgatgttctttgtatggttttatggttgtattgtgtgattgaaagttcatcaatccaatgaatctgaatttagc

SEQ ID NO: 1905 - DNA, 657 bp, Artemisia annua
tactccgacgggcatacccaaagaggagatggagaacaacatggtgagaccaaagaaatgtataatattttttgtataatgttgtttattatatctcatttttcatacacaaatccctcatcacaactttaagattttgaaaatgtcaggacgtggaaagggaggaaaaggattaggcaaaggaggagcaaaacgacaccgtaaagtcctccgtgacaacatccaaggaatcactaaacccgctattcgtcgtctggcacgtagaggtggagtgaagcgtatcagtggtttgatttacgaggagacacgtggcgtgttgaagatctttctagagaatgtgattagagatgctgttacttatactgagcacgccagaaggaagactgtgactgctatggatgtcgtttatgcgctcaagaggcaaggaaggactttgtatgggtttggtggttagggaggtgtttggttgggggattaaagaaggaagttagggtgtttggatttgtgttttgatgttggattagtgtttggttatttgaatgtaaagatgttggttgtttagatgtttgatttgtgatatttgatggaatgaatggacttatggttactatgcgaaaaaaaaaaaaaaaaaatgttggatctagaatgagtgcgtct

SEQ ID NO: 1906 - DNA, 485 bp, Artemisia annua
ataaaaaaaaatgtcaggaagaggaaagggaggaaagggattgggcaaaggaggagcaaagcgtcatcgcaaggttcttcgtgacaacatccagggtatcaccaagcctgccatccgtcgtctggctcgtcgtggaggtgtgaagcgtatcagcggtctgatttacgaagagacacgtggcgtcctcaagatctttttggagaatgtgatccgtgatgctgtcacctacactgagcacgctcgccgtaagacagtgactgcaatggatgtggtttatgctttgaagagacaaggaaggaccctctacgggtttgggggttagagttgaaattagggtttgttgttatggtatggttagggtgctagtattggtaagatcttgttgatatatctttgtgtaattgcaatttggaatggaatatcagtttaattttcatgtcaatttctgttgttgcttttttcaatttgtagatctgttcatttgg

SEQ ID NO: 1907 - DNA, 490 bp, Artemisia annua
acaaattcaaatcaaaaccaatttttatatatataaaagagaaatagatgtcaggaagagggaaaggaggaaaaggattaggcaaaggaggagcaaaacgacatcgtaaggtgctccgagacaacatccaggggatcaccaagcctgctattcgtcgtttagcacgtagaggaggtgtgaagaggataagcgggttgatttacgaggagacacgtggcgtcctcaagatatttttggagaatgttatccgtgatgctgtcacctacactgagcacgctcgaaggaagacagtcactgcgatggatgttgtttatgctttgaagagacaaggccgtactctctacggttttggtggttagattaattagctgctgtttggttagatggattagatctgttgtttattatagtaggttttattattatgtgttgttgatgttttaaagtggatgtatgatattttaatcaatgaacatgaagctcttatttg

SEQ ID NO: 1908 - DNA, 317 bp, Artemisia annua
aaaaaatgtcaggacgtgggaagggaggaaagggattaggcaaaggcggtgcaaagcgtcacaggaaagtgttaagagacaacattcaaggaatcacaaagccagctattcgtcgtttagctcgtagaggaggagtcaagaggatcagcggcttgatttacgaagagaccagaggtgttttgaagatctttttggagaatgtcatccgtgatgctgtcacctacaccgagcacgctcgccgtaaaacagtgactgcgatggatgttgtttatgctttgaagagacaaggcaggactctctatggtttcggtggttag

SEQ ID NO: 1909 - DNA, 497 bp, Artemisia annua
agcactgtaggatatgatgtttgttttatcaatcaatcaatgggaattaagtggacaaaaaatgtcaggacgtgggaagggaggaaagggactaggcaaaggcggagcaaagcgtcacaggaaagtgctaagagacaacattcaaggaatcacaaaacccgcgataagacggttggcgagacgaggaggagtgaagaggataagcgggttgatttacgaagagacgagaggtgttttgaagatctttttggagaatgttatccgtgatgctgttacgtatactgagcacgctagaaggaagactgttactgctatggatgttgtttatgctcttaagagacaaggcaggactttgtacggcttcgggggttaaaaagttgttttagaattagtactttgttgttgtgatgttcttggtacggttttatggatctattgtgtaatcgaaagtttataaatgaaatgaatgttattggttattgtcaaactacagtgct

SEQ ID NO: 1910 - DNA, 670 bp, Artemisia annua
cagtggtatcaacgcagtactccaacggggatcacaaatccaaacaacagtcaaattagctttttcaaaaaaaatcaatctctaaaaaatgtcaggaagagggaaaggagggaagggattaggcaaaggaggagcaaaacgacatcgtaaggtcctccgagacaacatccaggggatcaccaagcctgctattcgtcgtttagcacgtagaggtggagtgaagaggataagcggcttgatttacgaggagacacgtggcgttctcaagatctttctagagaatgttatccgtgacgcggtcacctacactgagcacgctcgacgtaagacagtgactgcgatggatgttgtttatgctttaaagagacaaggccgtactctctacggtttcggtggttagattaattacctgctgtttggttacatggattagatctggtgtttattatgtgttgttgaatagaagtgatgtattgtaatggtattaattaatcaatgaaattgaaggtcttatttggtttgtggatttgttagtgttgtttatttcataattagaatagtacatgtatgtgatggtcaagtttatcgtcctaattaacaatgaacatatatcattgtaacggatttgaatagtttgtatgtaaatatgaaagtcttaacttgatcgaaa

SEQ ID NO: 1911 - DNA, 492 bp, Artemisia annua
attaaaaaacttaaaaaatgtcaggacgtgggaagggaggaaaggggctaggcaaagggggagcgaagcgtcacaggaaagtgttgagagacaacattcaaggaatcacaaagccggctattcgtcgtttagctcgcagaggaggagtcaagaggatcagcgggttgatttacgaagagaccagaggtgtgttgaagatctttttggagaatgttatccgtgatgctgtcacctacactgagcacgctcgtcgtaaaactgtcactgctatggatgttgtttatgctctcaagagacaaggcaggactttgtatggtttcgggggttaggttgattagtattatgttgtcgttacgatgttctctgtatggttttatggttgtattgtgtaattgaaatttcatcaatgaaatgaatctgaatttagctcttttgtttattcattgttactgtattaaattgtgttaatgattattataaggaattattgct

SEQ ID NO: 1912 - DNA, 549 bp, Artemisia annua
atttctaattaaaacagaaagagaaaagaaaaatgtcaggacgtggaaagggaggaaaggggttagggaaaggaggagcaaaacgacaccgtaaagtcctccgcgacaacatccaaggaatcactaaacccgctatccgtcgtttggcgcgcagaggtggagtgaagcgtatcagtggtttgatttacgaagagacacgtggcgtcttgaagatatttttggagaatgtgattagagatgctgttacgtacactgagcacgccagaaggaagactgtgactgctatggatgttgtgtacgcgctcaagaggcaaggaaggaccctttatggttttggtggttagagggggtgtttggttgaggggttgtgggattaaaacttgattagggatactgtttggattagtgttttggtatttgattatgtggatgtaaagacgttggctgtttagatgtttgatttgtgatggaatgaattcaagttttagttatatgtttttaactgtttgacttgttttatttcaagttttagttgattgttatatggaa

SEQ ID NO: 1913 - DNA, 523 bp, Artemisia annua
tcaacgcagtactccgacggggacaaatccaaacaccaatcaaatctacttttataaaaaaaatatataaaaatgtcaggaagagggaaaggagggaagggattgggcaaaggaggagcgaaacgacatcgtaaggtgctccgagacaacatccagggaatcaccaaacctgctattcgtcgtttagcacgtagaggaggtgtgaagaggataagcggcttgatttacgaagagacacgtggcgttctcaagatatttctagagaatgtcatccgtgatgctgtcacctacactgagcacgctcgccgtaaaactgtcactgcaatggatgttgtctatgctttgaagagacaaggcaggactctctacggttttggtggttaaattaggtggtgtttggttacatgatttagatctggtgtttattaggttttattattattattataaatgtattgttgattagaagtgatgtaatattgtaatgatgttcagtcaacgaaattgaaggtcttattcggtt

SEQ ID NO: 1914 - DNA, 485 bp, Artemisia annua
aagagtggtatcaacgcagtactccgacggggaatcacaaaaacaaaaactcacaaatcaattcccaaaaaaaagaaaaaaatgtcaggaagagggaaaggaggaaaggggctaggcaaaggaggagcaaaacgacatcgtaaagtcctccgcgacaacatccagggaatcacgaaacccgcgataagacggttagcgagaagaggaggagtgaagaggataagcgggttgatttacgaagagacacgtggcgtgttgaagatctttctagagaatgtgatcagagatgccgtgacttacaccgagcatgctagaaggaagactgttactgctatggatgttgtttatgctttaaaaagacaaggcaggactctctacggcttcgggggttaggtcaattagtattatgttgtttgtacggttttatggatgtattgtgtaattggacaattatcaatgaaatcaaatgaaatgaatgttattgg

SEQ ID NO: 1915 - DNA, 523 bp, Artemisia annua
tactctgacggggatcaaaaacccaattagtaactttcattcaattaaccaaaacccaaaaaagtagcaaaaaatgtcaggacgtgggaagggaggaaagggactaggcaaaggcggagcaaagcgtcacaggaaagtgctaagagacaacattcaaggaatcacaaaacccgcgataagacggttggcgagacgaggaggagtgaagaggattagcgggttgatttacgaagagaccagaggtgttttgaagatctttttggagaatgttatccgtgatgctgttacgtatactgagcatgctagaaggaagactgttactgctatggatgttgtttatgctttgaaaagacaaggcaggactttgtacggcttcgggggttaaaaagttgttttaggattagtactttgttgtcatgatgttcttggtacggttttatggatctattgtgtaattgaaagtttataaatgaaatgaatgttattggttattagtaacaaaaaaaaaaaaaaaagtcggact

SEQ ID NO: 1916 - DNA, 456 bp, Artemisia annua
aatcaaaaactcaaaaacccaaaaagaaaatcatgtcaggacgtgggaagggaggaaagggactaggcaaaggcggagcgaagcgtcacaggaaagtgttaagagacaacattcaaggaatcacaaaacccgcgataagacggttggcgagacgaggaggagtgaagaggataagcgggttgatttacgaagagacgagaggtgttttgaagatctttttggagaatgtcatccgtgatgctgtcacctacactgagcacgctcgtcgtaaaactgtcactgctatggatgttgtttatgctctcaagagacaaggcaggactttgtatggtttcgggggttaggttgattagtattatgttgtcgttacgatgttctttgtacggttttatggatctattgtgtaattgaaagttcatcaatcaaatgaatctgaatttagcaaatgtcgagcgt

SEQ ID NO: 1917 - DNA, 517 bp, Artemisia annua
agcactgtagaagcgtggtatcaacgcagtactccgacggggacaccaaaatccaattctaaaaaatgtcaggaagagggaaaggaggaaaggggttaggcaaaggaggagcaaaacgacaccgtaaggtgcttcgtgataatattcaaggaatcactaagccagcgataaggcggttagcgagaagaggcggagtgaagaggataagcgggttgatttacgaggagacacgtggcgttctgaagatatttttggagaatgtgattagagatgcggtgacttacactgagcatgcgagaaggaagacagtgactgctatggatgttgtttatgctttgaagagacaaggaaggactctttatggttttggtggttagatgaattaggtggtgtttggttacatggattagatctggtttattattgtgttaggttttgttatggttgtgtagttgtattgaagatgtgttaaatgagtgaattgaaatctatgtttcggaataaaaaaaaaaaaaaa

SEQ ID NO: 1918 - DNA, 470 bp, Artemisia annua
aaaaatgtcaggaagaggaaagggaggaaaggggttaggcaaaggaggagcaaagcgtcatcgtaaggtgctccgtgacaacatccaaggtatcaccaagcctgccatccgtcgtttggctcgtcgtggaggtgtgaagcgtatcagcggtctgatttacgaagagacacgtggcgtcctcaagatctttttggagaatgtcatccgtgatgctgtcacctacactgagcacgctcgccgtaagacagtgactgcaatggatgtggtttatgctttgaagaggcaaggaaggactctctacgggtttgggggttagagttgaaattagggtttgttagggtttggttatggtgtttgttaatctttcagatgtggttaggtggttgttatgctttagatctggttagttggttatgtgtagatgagttctgttatatcttgtaactggagcttgatttggaattaatatg

SEQ ID NO: 1919 - DNA, 458 bp, Artemisia annua
tacccgacgggatctcaaacttttataattccaaaagaagatcaataatgtcaggacgtgggaagggaggaaagggactaggcaaaggcggagcgaagcgtcacaggaaagtgttacgagacaacattcaaggaatcacaaaacccgcgattagacggttggcgagacgaggaggagtgaagaggatcagcgggttgatttacgaggagacgagaggtgttttgaagatctttttggagaatgtgattcgtgatgctgttacgtacactgagcatgcgagaaggaagactgttactgctatggatgttgtttatgctttgaaaagacaaggcaggactttgtatggcttcgggggttagaaagtcaattagtattgtgttgtcgcaatgttctttgtatggtttttatggatgtattgtgtaattgaaactttgtcaagcaaatgaatctcactttag

SEQ ID NO: 1920 - DNA, 573 bp, Artemisia annua
gtggtatcaacgcagtactccgacggggatcacaatcaattctcacacacatagtttcagatcccgttaccaaacagaacagtaaaaatgtcaggaagaggaaagggaggaaaaggactaggcaaaggaggagcaaagcgtcacaggaaggttctccgtgacaacattcaaggtatcactaaacccgccatccgtcgtctggctcgcagaggtggagtcaagcgtatcagcggtcttatctatgaagagacacgtggcgtgttgaagatctttttggagaatgtgatccgtgatgctgtgacctacactgagcacgcgaggaggaagactgttactgctatggatgtcgtctatgctctcaagaggcagggaaggactttgtatgggtttggtggttaggtgtgtttgggattgggttttaagtcttgctgtcaagaaagaaatgtgtttagggttgattctgtttggaatatggatggtttagttagtgtttcgttggtattgaatgtagttagtgtttgtggttagttgttttaatgatgaatcaagtaatgaagttgattttcgtatcaa

SEQ ID NO: 1921 - DNA, 542 bp, Artemisia annua
atatcgcgagacaggtatcaacgcagtactccaacgagggacaacacacacaaataacaatccattaatccaaacaccaccaaattcaattacaaaaaaatgtcaggaagaggaaagggaggaaagggattaggcaaaggaggagcaaagcgtcacaggaaagttctccgtgacaacatccaaggtatcaccaagcctgccatccgtcgtcttgctcgtcgtggaggtgtgaagcgtatcagcggtctgatttacgaagagacacgtggcgtcctcaagatctttttggagaatgtcatccgtgatgccgtcacctacactgagcacgctcgccgtaagacggtcactgcaatggatgtggtttatgctttgaagagacaaggccgtactctctacgggtttgggggttaggttgaagttagggtttgttgttatggttagggtgctagtaatgataagatcttgttgatataactgtgtaattgcaatttggaatggaatgtcagtttattttgttgtagttaatgtgaaacttgattaga

SEQ ID NO: 1922 - DNA, 415 bp, Artemisia annua
aaaaaaatgtcaggaagagggaaaggaggaaaaggattaggcaaaggaggagcaaaacgacatcgtaaggtgctccgcgacaacatccaggggatcaccaagccagcgataaggaggttagcgagaagaggcggagtgaagaggataagcgggttgatttacgaggagacacgtggcgttctgaagatatttttggagaatgtgattagagatgcggtgacgtacactgagcatgcgagaaggaagacagtgactgctatggatgttgtttatgctttgaagagacaaggaaggactctttatggttttggtggttagatgaattaggtggtgtttggttacatggattagatctggtttattgtgttaggttttgttatggttgtgtagttgtattgaagatgtgtttaatgaa

SEQ ID NO: 1923 - DNA, 478 bp, Artemisia annua
tcaattaaaccaaacacccccaaattcattcaaaatcaaaaaatgtcaggaagaggaaagggaggaaagggattgggcaaaggaggagcaaagcgtcatcgtaaggttcttcgcgacaacatccagggtatcaccaagcctgccatccgtcgtctggctcgtcgtggtggtgtgaagcgtatcagcggtctgatttacgaagagacacgtggcgtcctcaagatctttttggagaatgtgatccgtgatgccgtcacctacactgagcacgctcgccgtaagacagtgactgccatggatgtggtttatgctttgaagaggcaaggaaggactctttacgggtttgggggttaggttgaagttagggtttgctgttatggttagggtgctggtaatgataagatcttgttgatataactttgtgtaattgcaatttggaattgaatgtcagtttattttgttgtcaaagagtgcgtct

SEQ ID NO: 1924 - DNA, 595 bp, Artemisia annua
aaaaagaaagaaaagaatgtcaggaagaggaaagggagggaagggattaggcaaaggaggagcgaaacgacatcgtaaggtgcttcgagacaacattcaaggtatcacgaagcctgccatccgtcgtttggctcgtcgtggtggtgtaaaacgtatcagtggtcttatctacgaagagacacgtggcgtcttgaagatctttttggagaatgtgattcgtgatgctgtcacttacactgagcatgcgagaaggaagacggttactgctatggatgttgtttatgctttgaaaagacaaggaaggaccctttatggttttgggggttaagtttgttatgttttagatattgtaattgaatctttattgcggattaatatgaattttagtattttctgtttaatggtttctgtgtattttattataaagattggttagtttagtttcataagtctagggtttgtgttgactgttaattgaatagtaaattgtttaagtaagctcattggatttatacaaatttagtcatgaaaactgctgatgtaagattgtgtttattgtaaggatttgcaaaattgcactggaaacgtgtctgat

SEQ ID NO: 1925 - DNA, 565 bp, Artemisia annua
tactccgacggggacaaattcaaatcaaaaccaatttttatatcataaaaagtgagagagagatgtcaggaagagggaaaggagggaagggattagggaaaggaggagcgaaacgacatcgtaaggtcctccgagacaacatccagggaatcaccaagcctgccattcgtcgtttagcacgtagaggaggtgtgaagaggataagcgggttgatttacgaggagacacgtggcgttctcaagatctttctagagaatgtcatccgtgatgctgtcacctacactgagcacgcgagaaggaagacagtgactgcaatggatgttgtttatgctttgaagagacaaggccggaccctctacggtttcggtggttaatttaattagctgctgtttggttacttggatttagatatggtgtttggttagatggattagatgattagatctggtttattgtgttaggttttattattattattattaagtgttattagatgtttttaagtggatgtatgatattttaatcagtgaacatgaaggtcttattcggtttaaaacgcactcgt

SEQ ID NO: 1926 - DNA, 490 bp, Artemisia annua
aaaaaatgtcaggaagaggaaagggaggaaaaggactaggcaaaggaggagcaaagcgtcacaggaaggttctccgtgacaacatccaaggtatcaccaagcccgccatccgtcgtcttgctcgtagaggtggagtcaagcgtatcagcggtcttatctatgaagagacacgtggcgttctcaagatctttttggagaatgtgatccgtgatgctgttacctacactgagcatgctaggaggaagacggttactgctatggacgttgtctatgctctcaagaggcaaggaaggactttgtatgggtttggtggttaggtgtgtttgggattgggttttaagtcttgctgtcaagaaagaaatgtgtttagggttatttctgttgagatttggatggttttgttagcgtttcgttggtattgaatgtagttagtgtttgtggttagatgttttaatgatgaatcaagtaatgaagttgattttcgtatcaa

SEQ ID NO: 1927 - DNA, 571 bp, Artemisia annua
agacgcactcaagcagtggttcaacgcagtactcgacggggacacacaaacaacaatcaattaatacataaacccccaaattcaaaatcaataaaaatgtcaggaagaggaaagggaggaaagggattaggcaaaggaggagcaaagcgtcatcgtaaggttcttcgcgacaacatccagggtatcaccaagcctgccatccgtcgtctggctcgtcgtgggggtgtgaagcgtatcagcggtctgatttacgaagagacacgtggcgtcctcaagatctttttggagaatgtgatccgtgatgccgtcacctacaccgagcacgctcgccgtaagacagtgactgctatggatgtggtttatgctctgaagaggcaaggaaggactctttacgggtttgggggttagggttcacattagggtttggttatggtgtttgttaatctttcagatgtggttaggtggttgttatgctttagatctggttagttggttatgtgtagatgagttctgttatatcttgtaactggagcttgatttggaattaatatgaatgttttcgtttagtttt

SEQ ID NO: 1928 - DNA, 482 bp, Artemisia annua
caaattcaatttcaaaaaaatgtcaggaagaggaaagggaggaaaggggttaggcaaaggaggagcgaaacgacatcgtaaagtgctccgagacaacatccagggaatcaccaaacctgctattcgtcgtttagcacgtagaggcggtgtcaaacgtatcagcgggttgatttacgaagagacacgtggcgtgttaaagatatttttggagaatgtgatccgtgatgctgtgacgtacactgagcatgcgagaaggaaaacagtgactgctatggatgtggtatatgctcttaagagacaaggaaggactctttacggctttgggggttaatcacaacatcttattgttgttgatatatctttttgtaattgcaatttctattgttatatatattttttaaaatttgcagctctgttcatttagaaaattaatggtgtaatgtaattggttctacaattattggtattttaaccttgtttaa

SEQ ID NO: 1929 - DNA, 523 bp, Artemisia annua
acaaatccaaacaacaaccaaatcaacttttttataaaaaaaaaatgtcaggaagagggaaaggagggaagggattaggcaaaggaggagcgaaacgtcatcgtaaggtgctccgagacaacatccagggtatcaccaagcctgccattcgtcgtttagcacgtagaggaggtgtgaagaggataagcggcttgatttatgaagagacacgtggcgtcctgaagatatttctagagaatgttatccgtgatgcggtcacctacactgaacacgctcgtcgtaagacagtgactgcgatggatgttgtttatgctttaaagagacaaggcaggactctctacggtttcggtggttaaatcgattaggtggtgtttggttagatggattagatctggtgtttattatgtgttgttgaatagaagtgatgtattgtaatggtattaattaatcaatgaaatcgaaggtcttatttggacaaaaaaaaaaaaaaaaaaacaatgttggatctagaattgtcgagcgt

SEQ ID NO: 1930 - DNA, 493 bp, Artemisia annua
attcaaaatcaaaaaatgtcaggaagaggaaagggaggaaaggggttaggcaaaggaggagcaaagcgtcatcgtaaggtgctccgtgacaacatccaaggtatcaccaagcctgccatccgtcgtttggctcgtcgtggaggtgtgaagcgtatcagcggtctgatttacgaagagacacgtggcgtgttgaagatatttttggagaatgtcatccgtgatgctgtcacctacaccgagcacgctcgccgtaagacagtgactgccatggatgtggtttatgctttgaagaggcaaggccgtactctttacggttttgggggttagaattggaattagggtttgttgttatggttaggatgtggaagttgtttatgtggttaagattgttatgttttagatctggttaggtgcttgtgtagatggggtttgttacatcttgtaattgaatctctgttgcgaattaatatgaatttaagtattttctgtttaa

SEQ ID NO: 1931 - DNA, 456 bp, Artemisia annua
aaaaatgtcaggaagaggaaagggaggaaagggactaggcaaaggaggagcaaagcgtcacaggaaggttctccgtgacaacatccaaggtatcaccaagcccgccatccgtcgtttggctcgtcgaggtggagtcaagcgtatcagcggtctgatctacgaagagacacgtggcgttctcaagatctttttggagaatgtgattcgtgatgctgttacctacactgagcacgctaggaggaagactgtgactgctatggatgttgtctatgctctcaagaggcaaggccgtaccctttacggtttcggcggctagatctagggtttctagggttagggtttcgaatttggtgcttgttgtgttgtttagtgattaatgattaatatctgattaatcattcagttgtatttcgtattttatgttttaatgaaatgaaatttgaattccgtttaaaa

SEQ ID NO: 1932 - DNA, 532 bp, Artemisia annua
agcactgtagaagcaggggtatcaacgcagtactccgacggggacatctcaccacaaaacccaaatccaaacacaccccaattcaaaaaaaatgtcaggaagagggaaaggaggaaaaggactaggcaaaggaggagcaaagcgtcacaggaaggttctccgtgacaacattcaaggtatcactaaacccgccatccgtcgtctggctcgtagaggtggagtgaagcgtatcagtgggcttatctatgaagagacacgtggcgttctcaagatctttttggagaatgtgattcgtgatgctgttacctacactgagcacgctaggaggaagactgtgactgctatggatgttgtctatgctctcaagaggcaaggaaggaccctttacggtttcggcggctagatctagggtttctagggttaaggtttcgaatttggtgctgtttagtgattaatgattaatatctgattaatcattttaatttgtatttcgtattttatgtttaatggaatgaaatgaaagttgtttgaa

SEQ ID NO: 1933 - DNA, 533 bp, Artemisia annua
acgctcgacaatcaattaatccaaacaccccccaaattcaaaatcataaaatgtcaggaagaggaaagggaggaaagggattgggcaaaggaggagcaaaacgacaccgtaaagtccttcgtgacaacattcaaggaatcactaaacccgctattcgtcgtttggcacgtagaggtggagtgaagcgtatcagtggtttgatttacgaggagacacgtggcgtcttgaagatattcttggagaatgtgattagagatgctgttacgtacactgagcacgccagaaggaagactgtgactgctatggatgttgtgtacgcgctcaagaggcaaggaaggaccttgtatgggtttggtggttagatagaggggggtgtttggttgaggggttgtcggattaaaacttgattagggatactgtttggatttgtgttttggtatttgattatgtggatgtaaagatgttggttgtttagatgtttgatttgtgatggaatgaattcaagttttagatatgtttgcaagagtgcgtct

SEQ ID NO: 1934 - DNA, 528 bp, Artemisia annua
tactccgacggggatcacaatcaattctcacacacatagtttcagttacagatctcgttactacacagaaccaagcaaaaatgtcaggaagaggaaagggaggaaaaggactaggcaaaggaggagcaaagcgtcacaggaaggtgcttcgtgataatattcaaggaatcactaagccagcgataaggaggttagcgagaagaggcggagtgaagaggataagcgggttgatttacgaggagacacgtggcgttctgaagatatttttggagaatgtgattagagatgctgtgacgtacactgagcatgcgaggaggaagacggtcactgctatggatgttgtttatgctttgaagagacaaggaaggactctttatggttttggtggttagatgaattaggtggtgtttggttacatggattagacctggtttattattgtgttaggttttgttttggttgtgtagttgaattgaagatgtgttaagtgaatgaaattgaaactatgtttcagttaaaaaaaacaaa

SEQ ID NO: 1935 - DNA, 457 bp, Artemisia annua
tactccgacggggattcagacccaaaagaaaaaaaaactcaatttgttcaacgatgtcgggccgtggaaagggaggaaaaggactaggcaaaggcggagcgaaaagacacaggaaggtgcttagggacaacatccaggggatcacgaagcctgcgattaggcggttggccagacgaggaggcgtgaagaggataagcgggttgatttacgaagagacgcgaggcgttctgaagatatttttggagaatgtgattagagatgcggtgacttatactgagcatgctagaaggaagactgttactgctatggatgttgtttacgcgcttaagaggcaaggaaggactttgtatggtttcggtggttaaggaataagggttgttgtttgttatggttgttatgagttagttgtgtttttaggtgtttggttatgttggtttagtgtttagatttggtgttt

SEQ ID NO: 1936 - DNA, 431 bp, Artemisia annua
ggggacacacaaaaaacaatcaattaatccaaacacccccaaattcattcaaaatcaagaaatgtcaggaagaggaaagggaggaaagggattgggcaaaggaggagcaaagcgtcatcgcaaggtccttcgcgataacatccagggtatcaccaagcctgccatccgtcgtttggctcgtcgtggtggtgtgaagcgtatcagcggtctgatttacgaagagacacgtggcgtcctcaagatatttttggagaatgtcatccgtgatgccgtcacctacaccgagcacgctcgccgtaagacagtgactgctatggatgtggtttatgctttgaagaggcaaggaaggactctctacgggtttgggggttagagtggaaattagggtttgttgttatggttaggttgttatgttgtttgagatctggtta

SEQ ID NO: 1937 - DNA, 548 bp, Artemisia annua
aacacacacaaataacaatcaattaaaccaaacacccccaaattcattcaaaatcaaaaaatgtcaggaagaggaaagggaggaaagggattaggcaaaggaggagcaaagcgtcatcgtaaggttcttcgcgacaacatccaaggtatcaccaagcctgccatccgtcgtctggctcgtcgtggaggtgtgaagcgtatcagcggtctgatttacgaggagacacgtggcgtgttgaagatatttttggagaatgtgatccgtgatgctgttacttacactgagcacgctcgccgtaagactgtgaccgccatggatgtagtttatgctttgaagaggcaaggaaggactctttacgggtttgggggttagaattggaattagggtttgttgttatggttaggatgtggaagttgttatgtggttaagcttgttatgttttagatctggttaggtgcttgtgtagatggggtttgttacatcttgtaattgaatctctgttgcgaattaatatgaatttaagtattttctgtttaaaacgcactcgt

SEQ ID NO: 1938 - DNA, 416 bp, Artemisia annua
tactcggggatcaccacaaactcacattcaaacaaccccaactgattcttgttagcgaaaaatgtcgggccgcggaaagggaggaaagggtttaggaaagggtggagcgaaacgtcacaggaaagttctccgagacaacattcaaggaatcacgaagcccgcgataaggaggcttgcgagaagaggtggagtgaagaggataagcgggttgatatacgaagagactcgtggcgttttgaagatatttttggagaatgtgattagagacgcggttacttatactgagcatgcgagaaggaagactgttacggctatggatgttgtttatgcgcttaagagacaaggccgaaccctttacggatttggaggctgataatttagtatttgtatgtaggtttagtttggcttattaaaat

SEQ ID NO: 1939 - DNA, 505 bp, Artemisia annua
ttaatccaaacaccaccaaattcaattacaaaaaaatgtcaggaagaggaaagggaggaaagggattaggcaaaggaggagcaaagcgtcacaggaaagttctccgtgacaacatccaaggtatcaccaagcctgccatccgtcgtttggctcgtcgtggaggtgtgaagcgtatcagcggtctgatttacgaggagacacgtggcgtgttgaagatctttttggagaatgtcatccgtgatgctgtcacctacactgagcacgctcgccgtaagacagtgaccgccatggatgtggtttatgctttgaagaggcaaggaaggactctctacgggtttgggggttaggttgaagttagggtttgttgttatggttagggtggtagtaatgagaagatcttgttgttgatatatctttgtgtaattgcaatttggaatggagtatcagtttattttgatgccaaaaaaaaaaaaaaaaacatgttggatctagaattgtcgagcgt

SEQ ID NO: 1940 - DNA, 379 bp, Artemisia annua
aaaatgtcaggaagaggaaagggaggaaagggattgggcaaaggaggagcaaagcgtcatcgcaaggttcttcgcgacaacatccagggtatcaccaagcctgccatccgtcgtctggctcgtcgtggaggtgtgaagcgtatcagcggtctgatttacgaagagacacgtggcgtcctcaagatctttttggagaatgtgatccgtgatgctgttacttacactgagcacgctcgccgtaagacagtgactgcaatggatgtggtgtatgctttgaagaggcaaggaaggactctctacgggtttgggggttaggttgaagttagggtttgttgttatggttagggtgctagtaatgataagatcttgttgttgatat

SEQ ID NO: 1941 - DNA, 462 bp, Artemisia annua
aaaaaatgtcaggaagaggaaagggaggaaagggattaggcaaaggaggagcaaagcgtcatcgcaaggttcttcgcgacaacatccagggtatcaccaagcctgccatccgtcgtctggctcgtcgtggaggtgtgaagcgtatcagcggtctgatttacgaagagacacgtggcgtcctcaagatctttttggagaatgtgatccgtgatgccgtcacctacaccgagcacgctcgccgtaagacagtgactgctatggatgtggtttatgctttgaagaggcaaggaaggaccctctacgggtttgggggttaggttgaagttagggtttgttgttatggttaggctgtggttgttgttatatgttttaagatttggttaggtgtttgtgtagatgtggtttggtacatcttgtaattgaatcactattgcgaattaatatgaattttagtattttctc

SEQ ID NO: 1942 - DNA, 550 bp, Artemisia annua
agacgcactcaagcagtggttcaacgcagtactccaacggggaaaacacaatcaattaatccaaacacccccaaattcaatttcaaaaaaaatgtcaggaagaggaaagggaggaaagggattaggcaaaggaggagcaaagcgtcatcgtaaggtgctccgtgacaacatccaaggtatcaccaagcctgccatccgtcgtcttgctcgtcgtggtggtgtgaagcgtatcagcggtctgatttacgaagagacacgtggcgtgttgaagatctttttggagaatgtgatccgtgatgccgttacctacactgagcacgctcgccgtaagactgtgaccgccatggatgtagtttatgctttgaagaggcaaggaaggactctttacgggtttgggggttagagttggaattagggtttgttgttatggttaggctgttatggttgttatgttttaagatgtggttaggttgttatgtgtagaggtgttctgttatatcttgtaactggagcttgatttggaattaatatgaatgttatcgtttagttt

SEQ ID NO: 1943 - DNA, 421 bp, Artemisia annua
aaaatgtcaggaagagggaaaggaggaaaaggattaggcaaaggaggagcaaaacgacatcgtaaggtgctccgcgacaacatccagggaatcaccaagccagctataaggcggttagcgagaagaggcggagtgaagaggataagcgggttgatttacgaggagacacgtggcgtgttgaagatatttttggagaatgtgattagagatgcggtgacttacactgagcatgcgagaaggaagacagtgactgctatggatgttgtttatgctttgaagagacaaggaaggactctttatggttttgggggttagatgaattaggtggtgtttggttaggtggattagatctggtttattattgtgttaggttttgttttggttgtgtagtttaattgaagatgtgttaaatgaatgaatt

SEQ ID NO: 1944 - DNA, 556 bp, Artemisia annua
agacgcactccagtggtatcaacgcagtactccaacgggacaaaacacagtcaattaatccaaacaccaccaaattcaattacaaaaaaatgtcaggaagaggaaagggaggaaagggattaggcaaaggaggagcaaagcgtcatcgcaaggttcttcgcgacaacatccaaggtatcaccaagcctgccatccgtcgtttggctcgtcgtggaggtgtgaagcgtatcagcgggttgatttacgaggagacacgtggcgtgttgaagatatttttggagaatgtcatccgtgatgctgtcacctacaccgagcacgctcgccgtaagactgtgaccgccatggatgtggtttatgctttgaagaggcaaggaaggactctctatggatttgggggttagagttgaaattagggtttggttatggtgtttgttaatctttcagatgtggttgttatgctttagatctggttagttggttatgtgtagatgagttctgttatatcttgtaactggagcttgatttggaattaatatgaatgttatcgtttagtaaa

SEQ ID NO: 1945 - DNA, 476 bp, Artemisia annua
aaatgtcaggaagaggaaagggaggaaagggattaggcaaaggaggagcaaagcgtcacaggaaggttcttcgtgacaacatccaaggtatcaccaagcctgccatccgtcgtctggctcgtcgtggtggtgtgaagcgtatcagcggtttgatttacgaggagacacgtggcgtgttgaagatctttttggagaatgtcatccgtgatgccgtcacctacactgagcacgctcgccgtaagactgtgaccgccatggatgtggtgtatgctttgaagaggcaaggaaggactctttatgggtttgggggttagagttgaaattagggtttgttagggtttggttatggtgtttgttaatctttcggatgtggttaggtggttgttatgctttagatctggttagttgttcgtgtagaggtgttctgttatatcttgtaactggagcttgatctggaattaatatgaatgttttcg

SEQ ID NO: 1946 - DNA, 446 bp, Artemisia annua
acttttataaaaacatcatgtcagggagagggaaaggagggaagggattagggaaaggaggagcaaaacgacatcgtaaggtcctccgagacaacatccagggtatcaccaagcctgccattcgtcgtttagcgagaagaggaggtgtgaagaggataagcggcttgatttacgaggagacacgtggcgtcctcaagatatttttggagaatgttatccgtgatgcggtcacctacactgagcacgcgagaaggaagacagtgactgcgatggatgttgtttacgctcttaagcgtcaaggcaggactctctacggtttcggtggttaaatcgattaggtgctgtttggttagctggtttagatctggtgtttattatgtgttgttgaatagaagtgatgtattgtaatggtttaattaatcaatgaaattgaaggtcgtatttgg

SEQ ID NO: 1947 - DNA, 487 bp, Artemisia annua
gaaaaaaaagaaaaatgtcaggacgtggaaagggagggaaagggctaggcaaaggaggagcaaaacgacaccgtaaagtactccgagacaacatccaaggtatcactaaacccgctattcgtcgtttggcacgtagaggtggagtgaagcgtatcagtggtttgatttacgaggagacacgtggcgtgttgaagatctttttggagaatgtgattagagatgctgtgacgtacactgagcatgccagaaggaagactgtgactgctatggatgttgtgtacgcgctcaagaggcaaggaaggaccttgtatggttttggtggttagatagagggggggtgtttggttgagggggttgtgggattaagaaagaagttagggatagtgtttggatctgtgttttggtgtttggttatgtggattagatgtaaagatgttggttgtttagatgtttgatttgtgatggaatgagttgaattaagttttag

SEQ ID NO: 1948 - DNA, 473 bp, Hordeum vulgare
gacaactcaacctcaccggagagaagcgagaagatgtcgggccgcggcaagggaggcaagggtctcgggaagggcggcgccaagcgccaccggaaggtcctccgcgacaacatccagggcatcaccaagccggcaatccgtcgcctggcccggcggggaggcgtgaagcgcatttcggggctcatctacgaggagacccgcggcgtcctcaagatcttcctcgagaacgtcatccgcgacgccgtcacctacaccgagcacgcccgccgcaagaccgtcaccgccatggacgtcgtctacgccctcaagcgccagggacgcaccctctacgggttcggaggctaggccaccaaccagattagagtgtctagggttcgtggtcgttggtttaatcgcagcatctcgctgttgtttgctatcttctgtaggatcgaatggaatggaatggaaattgctagttcattgttgaaaaa

SEQ ID NO: 1949 - DNA, 530 bp, Hordeum vulgare
gatcccccgggctgcaggaattcggcacgaggatcccctccaatctcaccctcggagcagcagagccatccagcgagcgtcgccagccatgtcgggccgcggcaagggaggcaagggcctgggaaagggcggcgcgaagcggcacaggaaggtgctgcgagacaacatccaggggatcacgaagccggcgatccggcggctggctcggcggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggaggctaagccctcgcgtggtgcaggtgcttcgggtgtagttgtggtcaggcgggtcgtcgttctctggtgtgctggtcatgtgtgtgcagctgcgtgctggtgcttgtaacgagttccagattctataatatggatg

SEQ ID NO: 1950 - DNA, 573 bp, Hordeum vulgare
ccaacaccagcgaaccccaccggagagaccgacagaagccgcggcggcgtcggcgaagatgtcggggagaggcaagggcggcaaggggctgggcaagggcggcgccaagcgccaccggaaggtgctccgcgacaacatccaggggatcacgaagccggcgatccggcggctggcgcggcggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcggcagggccgcaccctctacggcttcggcggctaggccggcccccctccagccggctaccagattactactacaaggctagtagtatttgtctagggttcgtggtctcttcggtgttgtctgctctgctctgctctgttcctgcgtgatgttgggattgatgtactagtgccaaagactgaatgaaaaatcgaattttggaaatgaacagagacgtgtttacgccattctcacttgag

SEQ ID NO: 1951 - DNA, 361 bp, Hordeum vulgare
aaatccccaaatccttcttcttccccgggaaaaaacacggagctgcggagatgtctggccgcggcaagggcggcaaggggctcggcaagggcggagcgaagcgccaccggaaggtgctgcgcgacaacatccagggcatcacgaagccggcgatccggcggctggcgcggcggggcggcgtgaagcgcatctcggggctcatctacgaggagacccgcggcgtgctcaagatcttcctcgagaacgtcatccgcgacgccgtcacctacacggagcacgcgcgccgcaagaccgtcacggccatggacgtcgtctacgccctcaagcgccagggccgcaccctctacggcttcggcggcta

SEQ ID NO: 1952 - DNA, 646 bp, Brachypodium distachyon
aatccacccaccagctccaattcccctccttccaaattcaaatctcgtgtagcagaggggaacgactcgaggttctcggccatgtctgggcgaggcaagggcggcaaggggctgggcaagggcggcgccaagcgccaccggaaggtcctgcgcgacaacatccagggcatcaccaagccggcgatccgtaggctggccaggaggggcggcgtgaagcgcatctccgggctgatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagatttggtggatggttgttgtggagctttagttcttcaggagcgtgttctgactttgtgtgatatgtgcttgtggtagatgggagttactccggcggcgtgcggcgttgtgtttcttcttgtgtgtggcaggctgtaatacttcgtgttcaatggaagcgttccgatcatgagccctcaccaattgtgttccgagcttgtcagtttcacggtttcacctgtttagtttcagatttaaggtcgcatttctgtgca

SEQ ID NO: 1953 - DNA, 773 bp, Brassica napus
atcaacgcagagtacgcggggacatcgaaaacacacaagcgaatctcaattaaaaactttccgagaaaagaaaaatgtctgggcgaggaaaaggaggaaaggggttgggaaagggaggagccaagaggcacaggaaggttctccgtgacaacatccagggcatcacgaagcccgcgattcgtcgtctagctagaagaggtggcgtgaagcgtatcagcggtttgatctacgaggagactcgcggtgttctcaagatctttctcgagaatgtgattcgcgatgccgttacttacactgagcacgctaggaggaagacggtgacggcgatggatgttgtctatgcgttgaagaggcaaggacgaactttgtatggattcggcggttgagggatgagattggagtttgtaaatcgcgtttgtctttagggtttgtttaatctattaaagctgttttagagtttcgtttagaatgtttcagcgatttgaatttaatgaaaacactttttatctaaaaaaaaaaaaaacacaaactcgatatccaaattcaacatttttctcgaaatgttctcttttctcatcccattgggggacgctaataaggctactattgcttctgcggcctccgtagccttcttagactttgccggtttaacaatggccgtttcgggcgtggccttagttggatccgcaccgtttttcattcatattcaccccgattctcctccccgcgactattgccactcctctcctagccactgggttctgggcggggcc

SEQ ID NO: 1954 - DNA, 527 bp, Brassica napus
tctgattttaaaaactattttcacaagaaaaataaaaatgtctgggcgtggtaagggaggaaagggattgggaaagggaggagccaagaggcacaggaaggttctccgcgacaacatccagggaatcaccaagccggcgattcgccgtttagcgagaagaggcggcgtgaagcgtatcagcgggttgatctacgaggagactcgcggcgttctcaagatctttctcgagaatgtgattcgcgacgctgtgacttacactgagcacgcgaggaggaagactgtgacggcgatggatgttgtgtacgcgttgaagaggcaggggaggactctgtacgggttcggcggctgaggggattggattagggtttttgtaaatctcgtctgggttgtttttagggtttgttaagagctttaagctgttgttatggtttcttttcgaatgtttcggtgatctgaagttaatgaaaacgcttttaactaaatttacggtgtctttagagtttgataagctgaacggtgctgattaa

SEQ ID NO: 1955 - DNA, 556 bp, Brassica napus
cctgcggaccggtccggaattctcgggtcgacccacgcgtccggttagaagatgtcaggaagagggaaaggaggaaaaggattgggaaagggaggagccaagaggcacaggaaggtgcttagagataacatccaaggtatcaccaagcctgctattcgtcgtcttgctcgtcgaggtggtgtcaagcgtatcagcggtttgatctacgaagagaccagaggagtcctcaagatcttcctcgagaatgtcatccgcgacgctgttacctacaccgagcacgccaggaggaagactgtcactgctatggatgtggtttatgctttgaagaggcaaggtcgcactctctacggtttcggaggttaaatcgacggagatgagtaaatccacgactgttgtatcattttctgctgtgttgttagccaacattatgttaaattaatcttaatcaaaagttgtgctgtgataatcctccatcttcaaagaaatttattttatattataaaagattatacaaagtaaaaaaacaaaacgttgaataaattcactgccattccgc

SEQ ID NO: 1956 - DNA, 513 bp, Brassica napus
cagatctagataagcttgtgaagagagatgtcaggaagaggaaagggaggaaagggattgggaaaaggaggagcgaagaggcacaggaaggtgctgagggataacatccaaggcatcaccaagcctgcgattcgtcgtcttgctcgcagaggtggagtcaagcgtataagcggtctgatctacgaggagacaagaggagtcctcaagatcttcctcgagaatgtcatccgcgacgccgttacttacaccgagcacgctaggaggaagacggttactgctatggatgtggtgtatgctttgaagaggcaaggacgtactctctacgggttcggcggttaatctacgatggattagcgttctctgtcttgtcttgtagctaaagcttatgctaatgagttgtcaaatgaaagctgagaatcattaatattatgtatttggttctcttagtttgatatatgaatctaagttcaaagaacaaaaaaaaaaaaaaaaaacgaccgacctcggcctcta

SEQ ID NO: 1957 - DNA, 395 bp, Manihot esculenta
ggaaaatgtcaggaagaggaaagggaggcaaagggctaggaaagggaggagccaagaggcacaggaaggttctgcgggataacatccaggggattacgaaaccggcaattcgtcggctggctcgtagaggaggcgtgaagcgtatcagtggtctcatttatgaagagaccagaggggttctcaagatcttccttgaaaatgtgattcgtgatgctgttacttacactgaacacgcaagaagaaagactgtaaccgccatggatgttgtctatgctctcaagaggcagggtcggacgctctatggctttggcggttgacttatattttccctttttttctgttttttttctccaatttgtattagatttcctgttatgtttgatatagataatctc

SEQ ID NO: 1958 - DNA, 334 bp, Manihot esculenta
gaaaaatgtcgggtagaggaaagggaggaaagggtctgggaaagggaggagcaaagaggcacaggaaggtattgagggataacattcagggaatcacgaagccggcaattcgtcggctagcccgtagaggaggcgtgaagcgtatcagtggtctcatttatgaggaaaccagaggcgtcctcaagatcttccttgaaaatgtgatacgtgatgctgtcacttacactgagcatgctcgaagaaagaccgtaactgccatggatgttgtttatgccctgaagaggcagggtcgaaccctctacggctttggtggttgatatatatttttttcttc

SEQ ID NO: 1959 - DNA, 334 bp, Manihot esculenta
gaaagggtaagatcaaacatgtcaggcagaggaaagggaggaaagggattgggaaagggaggtgccaagaggcacaggaaggttctacgggataacatccagggcatcaccaagcctgcgatccgccggctggccaggcgtggcggagtcaagcgtatcagcggtctcatctatgaggagactagaggcgtcctcaagatcttcctggagaacgtcattcgtgatgcggttacctacaccgagcatgctcgccgtaagaccgttactgctatggatgttgtgtatgccttgaaaaggcagggtaggactctgtatggttttggtggttagacat

SEQ ID NO: 1960 - DNA, 511 bp, Cicer arietinum
gagaaaatcatttgtgtccattaagtttcatttgaaacgattaatcgcagaaaaaagagagaaacatcaaaatcacagccatgtctggaagaggaaaaggaggaaagggtcttggaaagggaggagctaaacgtcaccgtaaagttctgagagataacatccaaggaataacaaagcctgcgattcgtcgtctcgcacgacgtggtggcgtgaaacgtatcagtgggttaatttatgaggagactcgtggtgttctcaagatctttcttgagaacgtgattcgtgatgctgttacatacaccgagcatgctcgccgcaagactgtcactgccatggatgttgtttacgcactcaagagacagggcaggactctttacggtttcggcggttagaatttggggatttctgtgtttctttgaaaatttagggtttcttttagtgctaatgttattgttgatatatggtgtaatagcacttgatattgcttattaacaatggtttttctttgtta

SEQ ID NO: 1961 - DNA, 543 bp, Cicer arietinum
gactcatattcaaatcaaaaccctagatccccaaatttacattgttcttcaaattttctcgataaaatgtctggtcgtggaaagggtggtaagggacttggaaagggaggtgcaaagaggcacagaaaggttcttcgcgataacatccagggaatcacaaagcccgctattcgtagattggcgagaagaggtggtgtgaagaggatcagtggtttgatctatgaagaaaccagaggtgtgttgaagatctttttggaaaacgttattcgtgatgctgttacttacactgagcacgcgaggaggaagactgtcactgctatggatgttgtctacgctctcaagagacaaggaagaaccctctatggattcggaggttaaaacagaaacactcttttgtttcttggttcagctttgtaattttatcatgcaattcaaacttcaaattatggaaatacagtgatgtttaggttgatttgtgacatgtaattctcaatgagatgtatgtgtattcaaatttaatgaaaagtattactgttttatttc

SEQ ID NO: 1962 - DNA, 440 bp, Cleome gynandra
tcacagcctgagaaaaaacaatccaaaaaatctcgagaaaaattcaaaatttctgcgtgaaaaatgtcaggaagaggaaagggaggaaagggtttgggaaagggaggagcaaagaggcataggaaggttcttagagataacattcaaggaatcacaaagccggcgattcgacgattggctcgtagaggtggagtgaagagaatcagtggattgatctatgaagaaaccagaggtgtgcttaagatttttcttgagaatgtaattagagatgctgttacgtatactgaacatgctaggagaaagactgtgactgccatggatgttgtttatgctttgaagagacaaggaaggactttgtatggttttggtggttagatctttgatttcttttgtgttgtaatgtaaatctgtttgtctttttttttttcttttgttgtttc

SEQ ID NO: 1963 - DNA, 550 bp, Cleome gynandra
ttcaaatcatttcaatcgtttgcttttcgagacaatcttgagctttggaaaatgtcaggaagaggaaaaggtggaaagggattgggaaagggaggagcaaagaggcacaggaaggtcctgagagataacatccaaggaatcaccaagcccgcgattcggcgtctggctcgtagaggaggtgtgaagcgtatcagcggtttgatctacgaagaaaccagaggtgtcctcaagatcttcttggagaatgtcattagagatgcagtcacatacactgagcacgctaggaggaagacggtgaccgcaatggatgtcgtctatgccttgaagaggcaaggaaggactctctacggtttcgggggttagatttgcttcgttaaccgtgtcgatctctctatttggttccttcttgtagatttttaggttttgtctgccaagatctctgtattttgaatgtttttagtctttatctgagactgaatccgttaaggatccactgttggaggcgaattagagccattattatcgtcattctgatgtatcgtttaattga

SEQ ID NO: 1964 - DNA, 493 bp, Cleome gynandra
aatcctcaaaattttcgttgtttcgatttcacacgaagaaacattttccttcgcattttctctcgttttccggtaaaatgtcaggcagaggcaaaggaggaaagggattgggaaaaggaggggcgaagaggcacagaaaagttctacgagataacatccaggggatcacgaagccggcgatccgtcgtctggcaaggaggggcggtgtgaagcgtatcagcggcttgatatacgaggagactcgtggcgttctcaagatcttcctcgagaacgtgattcgtgatgctgtcacctacaccgagcacgctcgccgtaaaactgtcacggcgatggacgtcgtctatgcgctgaaacgacagggaaggactttgtatggatttggcggttgaggattcttctatttcgataatagtgcaaatatttcttatagcgtgatgtttaggaagattgtcgaattcaatttcgtgaatctagggttttttgtttgttcttc

SEQ ID NO: 1965 - DNA, 545 bp, Cleome gynandra
atctcactccaattgcaatactcaactaatttactcaagaaaatccttattttcccgggaaaatgtctggtcgtggaaaaggaggcaagggactcggcaaaggaggagctaagcgtcacaggaaggtgctgagggataacattcaaggaatcacgaagccggcgattcggagattggctcgaagaggaggtgtaaagcgtatcagtggtttgatctatgaagagactcgtggtgtcctcaagatcttcttggagaatgtcatccgtgacgccgttacttatactgagcacgctcggaggaagacggtgaccgccatggatgtcgtttatgcgctcaagaggcaaggaaggactctatacggattcggcggttagaatcgaactttataagaggttttttagatagtaaaaatggattgctggttcctgttgatgtttgctttagtttctggaatcagatgaatgtagttttcatatcttgtaactcatgagatttgtcgatttctgactgtacgaatggctttaagaactcaatattggatgttc

SEQ ID NO: 1966 - DNA, 321 bp, Cleome gynandra
aaaaatgtcgggaaggggaaaaggaggaaagggattgggaaaaggaggagccaagaggcataggaaggttctgagagataacatccaaggaatcaccaagcctgcgattcgacgtctggctcgtagaggaggtgtgaagcgtataagtggtttgatatacgaagaaaccagaggagtcctcaagatcttcttggagaatgtcattagagatgcagtcacatacactgagcacgctaggaggaagacggtgaccgccatggatgtcgtctatgccttgaagaggcaaggaaggactctttacggttttgggggttagatttg

SEQ ID NO: 1967 - DNA, 641 bp, Cleome spinosa
ggcagagaactctatattccaaaaaaaaaaaaaacgataagacctttgtttggtgcctgagaaaattcaaatctctccgtgaaaatgtcgggaagaggaaagggagggaaggggctgggaaagggaggagcgaagaggcacaggaaggtgctgagggacaacatccaagggatcacgaagccggcgataaggcggctggctcggagaggaggagtgaagcgcataagtggtctgatctacgaggagaccagaggggtcctgaagatcttcctcgagaacgttatcagagacgctgttacgtacaccgagcacgccaggaggaagacggtcaccgccatggatgtcgtctacgccctgaagaggcagggcaggaccctctacggcttcggcggttaggttcgtcgggcctccctggtgttggctgtgatgaagagattacgggtgtggaggtgacggcggctgatgttttgtaggattagtggtgtcccgtcgtatgtcgatgtcgggtttgtaattagggtttctagattttggaactccttgtttctggattagctgtgtttcagatatgtgttataagcttttgataatatatgattctgaagtcaaatcatataaatcaatttagattcagaacttcg

SEQ ID NO: 1968 - DNA, 516 bp, Cleome spinosa
ggcggaaatcatttctaaattcaaaaggtttcacaaatccttgtttggtttctaagaaaattcgaagctctccgggaaaatgtcgggaagagggaagggaggaaaggggctcggaaagggaggagccaagaggcacaggaaggttctgagggataacatccaaggaatcacgaagccggcgattaggcggctggcgcgtagaggaggagtgaagcgaatcagtggtctgatatacgaagagaccaggggagtgctcaagatcttcctcgagaacgtcatcagagacgccgtgacttacacggagcacgccaggagaaagactgtgaccgccatggacgtcgtctacgctctgaagaggcaaggaagaactctctacggtttcggcggttagatttggtctattgttagtgctctgttgtagatcaggtaggcttggttgcgatgcttttgtattttgtcgatttcaaaaccttaaatcgttaaaatcaccttttggtgaagaaaaccattgttcgc

SEQ ID NO: 1969 - DNA, 660 bp, Cleome spinosa
tcacaaatcctagcagcctttcatttcattgaagtagaagaaacgaaagctagttttctcgagaaaatcgaattatcctgggaaaatgtcgggtcgtggaaagggaggcaagggattgggcaaaggaggagccaagcgtcacaggaaggttctgagggacaacatccagggaatcactaagccagcgattcggcggttggctcgtaggggtggagtcaagcgtatcagtggtctgatatacgaggagactcgtggtgtcctcaagatcttcttggagaatgtcattcgagacgccgtcacttacaccgagcacgctcggaggaagacggtgaccgccatggacgtcgtctacgcactcaagaggcagggaaggacactttacggattcggtggttagggttttcagcttttcgattgcaaaactagtgaaataccaacgggttgtttttgtttttggctttgtccagaatctgtctgtatttttttagcgatttcgatggcgttagtggtttgtgtaattaatcgttgctcaatgctcgtaattccgaatttcgttccgacaagtttaatggaaatttctgaaactgtgctatccaaagcaatgtatctgtaaatccccgatagaatcggacaaaggacaaatcttttgtggcggagcca

SEQ ID NO: 1970 - DNA, 698 bp, Cucumis sativus
ttgccaccaacatcaaattttgagatccaccctttaacgattcgtttcccaaatttcagttgaagcaatgtctggacgaggtaagggaggcaagggattgggaaaaggaggagcaaagcgtcacaggaaggttttgcgagataacattcagggcattacaaagcctgcaattcgtcgtttggctcgtagaggtggtgtgaagcgtatcagtggattgatctatgaagaaaccagaggggttttgaagattttccttgagaatgtgattcgtgatgctgttacctacacagagcatgctaggagaaaaacggtgactgccatggatgtggtttatgctttgaaaaggcagggaaggaccttgtatggttttggaggttaagttgtaggttgattttacgaatgattgtatatctggggtttggatttaacgtcattgatgttcatgttcatgttctgttagagaaatttggaacttatttactgttcttgcaatgaaattctagttgatcatgtacttactgtctccagtttctttttactttatatatgaatatttactgagcattgatcatcggatagaaagtttcccttacctaagatgtgttgcattcattatgtttgcgagatggtaaatgcaaagcttaagtgtaaaatctgtaaaatttgtatttaaatatattgaaactaaaaatttaagg

SEQ ID NO: 1971 - DNA, 395 bp, Cucumis sativus
catcgtcatctccacaacaaaattttcaaattttccaattgccttaattcttcttcatccccgaaatcacccatcttctctgaaatatgtctggccgtggaaagggaggcaagggattgggaaaggggggagcaaagcgtcaccgtaaggttttgagagacaacattcagggcattacgaagcctgcaatccgccgtttggctcgtagaggtggtgtgaagcgtatcagtggattgatctatgaagaaaccagaggtgttttgaagattttccttgagaatgtgatccgtgatgctgtgacttacactgagcacgctaggaggaagacggtgaccgccatggatgtggtttatgctttgaaaaggcaggggagaactctatatggctttggaggt

SEQ ID NO: 1972 - DNA, 572 bp, Cucumis sativus
accaatttcaaaatttctgattaatcctattccatactcttccaaatcaagctccgataatgtccggccgcggcaagggaggcaagggtttgggaaagggaggagccaagcgtcaccgcaaagtcttgagagataacattcaaggtattacaaagcctgcaattcgccgtttggctcgtcgtggcggtgtcaagcgaatcagcggtttgatttatgaagaaaccagaggtgttttgaagattttccttgagaatgtgatccgtgatgctgtgacttacactgagcacgctaggaggaagacggtgaccgccatggatgtggtttatgctttgaaaaggcagggaaggactttgtacggtttcggaggttaggttgtagattaatccaatggaggattgtagatcttggctttagatctggtttttctttcttagcgtttataaattttttcttctctttttaggatttcatgtaccctagtccctgttattcagtaattgaagtattactcgaatcatgattccaccttttcatctctctcttccttcaatttgtttcgttcttagggttca

SEQ ID NO: 1973 - DNA, 689 bp, Cucumis sativus
atcgaaatcaaaatcaaaactcacaaccgatttagttccacatcgctgttctaatataaccaccaaatcaccggcgacaatgtctggacgtggtaagggcggtaagggattaggaaagggaggagctaagcgtcacaggaaggttttaagagataacattcagggcattaccaagcctgccattcgtcgtttggctcgtagaggtggtgtgaaacgtatcagtggattgatctatgaagaaaccagaggtgttttgaagatctttcttgagaatgtgattcgtgatgctgttacctacactgagcatgcaaggaggaagacggtgactgctatggatgtggtttatgctttgaaaaggcaaggaaggactttgtatggttttggaggttaggtttagggtttgattccaagaatgattgtagaccattacgtttgatcttgtattttgtagtcgaactcgttcttattgattaatgtaagttaattcctcattagttggaagtgatggaagctttacttcattgatgccatgtgctataagattttcgtttttttctctccagttttcttaatcttcttgtctcgataattaacaaatttcttcgagctaactgtttaattgtttccaatttgaaactttactatacgttgatatcgaaagaaaatggcagccacagtttctgtttctt

SEQ ID NO: 1974 - DNA, 610 bp, Cucumis sativus
tttcttcatcgaaatctccatcaaccaaagcaaccaacaatgtccggcagaggcaaaggaggaaaaggtctcggaaagggaggagccaagaggcatcggaaagttctgagggacaacatccaaggaatcaccaagccggccatccgccgtcttgctcgccgtgggggcgtaaagcgtatcagcggcctgatctatgaagaaactcgcggcgttctcaagatcttcctcgaaaatgtcattcgtgacgctgtcacttacactgagcatgctcgccggaagactgtcaccgccatggatgttgtgtacgcgctcaagaggcaaggacgtactttatacggcttcggaggttagggttgtcgaaacctaaggtttggatttgggggttttgtggttcggtgatttggatgtgattttggagaggaattgtatattattggtgattttgttagattcaaactatgatatcagtctgtaggttgttaattgtttctctcgtaattggaaatcttgatgcgcgtaattagaaactgttctagttttgttcatcttcaagttcactatgtttctcttctgattattggatctgattcttaaagcataattttagctc

SEQ ID NO: 1975 - DNA, 608 bp, Cucumis sativus
aactcagaaaaattcccaatcaatcgattcattcttcatcccttcaagtcaatcaaggaaatgtctggccgtggaaagggaggaaaggggttggggaagggaggagcaaagcgtcaccggaaggttttgagagataacattcagggcattaccaagcctgccattcgtcgtttggctcgtagaggtggtgtgaagcgtatcagtggattgatctatgaagaaaccagaggtgttttgaagattttccttgagaatgtgattcgtgatgctgttacctacactgagcatgcaaggaggaagacggtgactgccatggatgttgtttatgccttgaaaaggcagggaaggactttgtatggttttggaggttaggttatggttttggtctagataatatttgtataggttgtttcttttctgctgggtttctttgtttctgcaagttcttttcttattgttctggcaaaatgataatggttcattatccaattgtgcttttgcgttactacctgtctctcgtaccatttctctccctcttcttccgaatttgaatcaacaagaactcaacagttgacgaacttaaggttatatacagttgaatgaagttt

SEQ ID NO: 1976 - DNA, 516 bp, Cucumis sativus
tcgtttcccaaatttcagttgaagcaatgtctggacgaggtaagggaggcaagggattgggaaaaggaggagcaaagcgtcacaggaaggttttgcgagataacattcagggcattacaaagcctgcaattcgtcgtttggctcgtagaggtggtgtgaagcgtatcagtggattgatctatgaagaaaccagaggggttttgaagattttccttgagaatgtgattcgtgatgctgttacctacacagagcatgctaggagaaaaacggtgactgccatggatgtggtttatgctttgaaaaggcagggaaggaccttgtatggttttggaggttaagttgtaggttgattttacgaatgattgtatatctggggtttggatttaacgtcattgatgttcatgttcatgttctgttagagaaatttggaacttatttactgttcttgcaatgaaattctagttgatcatgtacttactgtctccagtttctttttactttatatatgaatattta

SEQ ID NO: 1977 - DNA, 517 bp, Solanum melongena
agggaatcatcacaaatctaaatcaaagagcattggttttcaattttaaattatcttaagaaaaatgtcaggaagaggtaaaggaggcaaaggattgggcaaaggaggagccaagagacataggaaggtactgagggataacatccagggaattactaagccagctattcgtagactcgctcgtagaggtggtgtgaagcgtatttctggattgatttacgaggagactcgtggggttctcaagatcttcttggagaatgtgattcgtgatgctgtgacttacacagagcatgctaggagaaagactgttactgccatggatgttgtttatgcgcttaagaggcaaggaaggaccctatatggatttgggggttagggtttgtgaagttagggtaatgtttgtagatttatctcatctttcgtttgcttgttgtgatttaggattgttagttttgttttgaggttgaaggtgtaatactctgttacaaattcaaggaatagaaattcgctttatcag

SEQ ID NO: 1978 - DNA, 499 bp, Solanum melongena
atcacaaaccaaatcgatttcttctcagctcagtttgctcaaacgataatgtctggacgtggaaagggtggcaagggtttgggaaagggaggagcaaaacgtcaccggaaagttctccgtgacaacattcagggaatcaccaagccggcgataaggaggcttgcgagaagaggtggagtgaagagaatcagcgggttgatctatgaagagacaagaggtgttttgaagatctttttggagaatgtgattcgtgatgctgtgacttacactgagcatgctaggagaaagactgttactgctatggatgttgtttatgctttgaagagacaaggaaggactctttacgggtttggtggttgatttttatatatatttgcctttgttttgttgttgggttatggaacctagctggtgttttgctttttatgtagttgaagattgtgagatcattgtaattggtgaaatttgtgtttaatgaaatggatctctaattttagat

SEQ ID NO: 1979 - DNA, 674 bp, Solanum melongena
aattcacagcttatcttctctttcagtttctaataatcaatttcaaaaccctagaaattcttgaaaaatgtctggccgtggtaagggaggcaagggattgggcaaaggaggagccaagaggcacaggaaggttctaagggataacatccagggtattactaagccagccattcgtaggcttgctcgtagaggtggggtgaagcgtatttctggattgatttatgaggagactcgtggagtgcttaagatctttcttgaaaatgtgattcgtgatgctgttacatacactgagcatgctaggagaaagactgttactgctatggatgttgtttatgccctgaagagacagggaaggaccctttacggatttggaggttagggtgttagtggttgtagatttggtgttttagtttgtggtgcattaggcttattattatgtttctgtttgttatggtcatgatattgtaattcctcattactcaattaatggaagaatgtcatttctgtagtaattgtagttgttctcatcatgattttgtactgcatttattatgttaatctcgacttattttggttggtttggtttgctctaaaatatttgttgcaattcaaatcatgataattcaattgatgattgaatcaatagaatggcagttcgacaatgtgttatcatc

SEQ ID NO: 1980 - DNA, 596 bp, Solanum melongena
atcttcatcgaactcttcagaaaaagttacattcagagaattttgaagatgtctggacgtggaaaggggggaaaaggattggggaagggaggagcgaaacgacaccgtaaggtcctccgtgataacattcaaggtatcacaaaacctgctattcggcgtttggctcgtagaggaggagtgaagcgtatcagtggtctaatctatgaggagactcgtggggttcttaagatcttcttggagaatgtgattcgtgatgctgttacttataccgagcatgctaggaggaagacggtgactgctatggatgttgtatatgcactcaagagacaaggaaggactctatatggattcggtggttagaattactcttctcaagagcataaatgagtgggggaaattgggtttcagcttagtgtttgatgtaattatagagttgtttaattgcactatcttttataatgaatctgcccatttatttaattctctgttggttttttccttgattatgtttatatatgtaaagaagaagggatgctagcttttgtgtgtatcggaattgtgactttgaacaggctttcttgaatggggtttgctag

SEQ ID NO: 1981 - DNA, 461 bp, Solanum melongena
aatcaccatcacttcacttccattcaccttcagctatccaatcgcttgattcaaaaatgtctggccgtggaaagggaggcaagggattaggaaagggcggagcgaaacgtcatcggaaagtcctccgtgacaacattcagggaatcactaagccagcaattcggagattagcgagaagaggtggagtgaagagaatcagtgggttgatctacgaagaaacaagaggggttttgaagatctttttggagaatgtgattcgtgatgctgtgacctacactgagcatgcgaggaggaagactgttactgctatggatgttgtttatgctttgaagagacaaggaaggactctttatgggtttggtggttaaaaatggtgaatcttttgattgtttctgctatttaatgtaattgaagctggactttgttatcaattggaaaaaaaattgttctttctctgattc

SEQ ID NO: 1982 - DNA, 533 bp, Solanum melongena
atcaccaaaaatctctcaaattccctcaaatttcattcccaaaattccccaaaaatgtcaggccgtggaaagggaggcaagggattaggaaagggcggagcaaagcgacaccgtaaggtgcttcgtgacaacattcagggcataacaaagcctgctattcggagattggcgagaagaggaggagtgaagagaatcagtgggttgatttatgaagagacaagaggtgttctcaagatctttttggagaatgtgattcgtgatgcggtgacttatactgagcacgctaggagaaagactgttactgctatggatgttgtttatgctttgaagagacaaggaaggactctttatgggtttggtggttagatttagggttttgggtattagtatttctagtaatgttgatgtaattgatctatgcttatgaatctatgaaatatctcatttctgtttcaaatttgactcatttctgtttcaatttgtggaagatatatggtttatgcgtttctatgtgaagaattatcatctttgaa

SEQ ID NO: 1983 - DNA, 696 bp, Solanum melongena
atcgtctttcctggttctcttgaagcttttgatatctgagaaattaaagtttgattgaaaatgtcgggccggggaaagggaggaaaaggattgggaaagggaggagctaagcgtcaccgtaaggttctccgtgataacattcaaggtatcactaagccagctattaggcgtttggctcgtagaggaggagtgaagcgtatcagtggtcttatctacgaggagactcgtggggttctgaagatcttcttggagaatgtgattcgtgatgctgttacttacactgagcatgctaggaggaagactgtgactgctatggatgttgtctatgcactcaagagacaaggaaggactttgtatggatttggaggctaagtggagatttggatctgacttttgtttagtctgcaaaagtcttgctgtcaagaaatggatatggggttctgttttgctttttgtttgggttggtggtttctattctggtgtaattatactatcgttcaattagaggatatagctatgatatattatagtatcagttctcttgttagtgggatgtagtgaaagcttttgtttcagaacttctgaaatttggctgtaattcagtgaatattgctgattggtttagctttatatctatcatatgaatattacagctgaatctcagctggtatttgatttacagctcattcctctgct

SEQ ID NO: 1984 - DNA, 537 bp, Eschscholzia californica
tttctctctctagaatttcttctttcagtttctctctctagaaacaagatgtctggccgtggtaagggaggtaagggtttaggaaagggaggagcgaagcgtcatcgtaaggtcttgagagacaatatccagggaatcacaaaaccagccatcagaaggttagcaagaagaggaggtgtgaagaggatcagtggtttgatctatgaagaaactcgaggtgtgttgaagatcttcttggaaaatgtcatccgtgatgctgtcacttacactgaacatgctcgtcgtaagactgtgacagccatggatgttgtttatgccctaaaacgtcaaggaagaactctttatggtttcggtggttagaggattttcatttttctcgcttctatgttaccagatcttctatatggtttaatctagggtttggtttactttaaattagcttttgtaaatctttttgttataagcttcttctattagatctagattcatcttttttgttagttgagtaaatctttagatcttgatggtcaatgttga

SEQ ID NO: 1985 - DNA, 554 bp, Eschscholzia californica
ctctctcctcttcttcttctttctctttcttctcttctactttctctctctagaattttgtctctgagtttcttctctctctagaagcaagatgtctggtcgtggtaagggaggtaagggtttaggaaagggaggagcaaagcgtcatcgtaaggtcttgagagacaacatccagggaatcaacaaaaccagcaatccgaaggttagcaagaagaggaggtgtgaagaggatcagtggtctgatctatgaagaaactcgtggtgttttgaagatcttttttggagaatgtgatccgtgatgctgtcacttacactgaacatgctcgtcgcaagactgtgacagccatggatgttgtttatgccctaaaacgtcaaggaagaactctttatggtttcggtggttaatttcctcacttcctctagtctgtctcatcaagatagttcatctgtgccggtggttcatctagggtttatttcaatctcctttcaatattttaggttttgtatatcttttagttaaaacttgtctcagatcccctgatcttcttcttctt

SEQ ID NO: 1986 - DNA, 557 bp, Linum usitatissimum
ccacgcgtccgctcaatcttccccaaacccagaactcatccaaatttcgaaacttctcccatttctctgttctgaagatgtctggccgcggcaagggaggcaaaggactgggaaagggaggagccaagaggcacaggaaggttctcagagacaacatccagggaatcacaaagccagccattcgtcgtttggctcgcagaggaggcgtgaagcgtatcagtggtctcatctacgaggagactcgcggtgttctcaagatcttcttggagaatgtcatcagggacgccgtcacctacaccgagcacgccaggaggaagacggtgactgctatggatgtcgtctatgctttgaagaggcaaggaaggactctctacggtttcggcggttagattgcctctagagattgagggatctagggttagcttagctgccatggttgatttagggttaaggcagatcttggctgaagatctggatttagtggtttctgtttatttgattggaattgtaattgtaattgatggttttaatgctatgaatataagcttgctttcggt

SEQ ID NO: 1987 - DNA, 576 bp, Gerbera hybrid cultivar
aatccaacttcaccttcaagagttctcaaaccctagaatccatcagttcgacccaaacctcattccggcaatgtctggccgtggtaaaggcggaaaagggctcggaaagggaggagcaaagcgtcaccggaaagttctccgggacaacatccagggaatcaccaagccggcgatccggaggctcgcgaggagaggcggcgtgaagagaatcagcggcttgatctacgaagaaaccagaggcgttcttaagatcttcttggagaatgttattcgtgatgcggttacgtacactgagcacgctcgtaggaagactgtgaccgccatggatgttgtttatgctctgaagagacaaggtagaactctgtacggattcggcgggtgatagatctatgaggtttgtatgattgtaatgaatcacttgattttagatattttggatcttaaatttgaaggtttaggattgtggaatttgtaattgaatgaaactcgaatccattttctaatggaaatgaaatcaaaagctctatcttgatgttcttcatttctgttgaaaaaatttgtgttgcattcataaaa

SEQ ID NO: 1988 - DNA, 642 bp, Gerbera hybrid cultivar
tagaaacatgtcaggaagaggaaaaggaggcaagggattaggaaagggaggagcaaagcgtcaccggaaagttctccgggataacattcagggcataaccaagccggcgatccgtcgactcgcgaggcgtggcggcgttaagcgtatcagcggtctaatctacgaggagactcgaggtgttcttaagatcttcctagagaacgttattcgtgacgccgttacctacaccgagcatgctcgccggaagactgtgaccgccatggatgtggtgtatgctctgaagcgacaggggcgtactctctacggtttcggcgggtaagagaaatttagggtttgcaggattaggtcactttgttttgggtctttgtgtcacagatctgtttggctgttcgtttaaattgttgatatatctgtgtaattgggactcgtaatgcaatactcgtttgatcctgttatctaatcgatcgtttgattttgtaattaccttctctttcactcattttatattccttctgtttcatgaaaaaaaaaaaccgttgctgcggattcttggacttaaactaggagttgatattagtattgataatgcctaggcaatgatttgaaaacgaactaagtttgaccatgacttaggatgggatc

SEQ ID NO: 1989 - DNA, 491 bp, Gerbera hybrid cultivar
aatttatctatcaatttaaaccctaattttagttcatttcaagaatgtcaggccgtggaaagggaggcaaaggactgggaaagggcggggcaaagcgtcaccggaaagttctccgtgataacattcagggaatcaccaagcccgccattagaaggctcgctcgtagaggaggtgttaagcgtatcagtggtttgatttacgaggagactcgtggagttcttaagatcttccttgagaatgtcatcagagatgccgtgacttacactgagcacgctcgccggaaaactgtcacggcgatggacgtggtttatgctttgaagcgacagggccgcactctgtacgggtttggtggttagatctagggtttgggttaaaaattgatgtaatcgctgtagatcgtatcctgtttctccttattgtatcctatttcgctatcattccccatcttggggatttgattttatgttatgaaacctctttaattcaccgga

SEQ ID NO: 1990 - DNA, 577 bp, Gerbera hybrid cultivar
gcaaaatccgaaactctaatctccgatcacatctccgccaattcaaagatgtctggccgtggaaagggtggcaaagggttaggcaagggcggggcaaagcgtcaccggaaagttctccgagacaacattcaaggaatcacgaagccggcgattcgaaggctcgctcgtagaggcggtgtgaagcgcatcagtgggttgatctacgaggaaactcgtggtgtcctcaagatctttctagagaatgtcatcagagacgccgtgacgtacactgagcacgctcgccggaaaactgtcaccgccatggatgtcgtttatgctttgaagcgacagggccgtactctttatgggttcggtggttagaggttagagacagaattattgtagatcgtgttagatttgtcgtttctattgaatttgaattctagttgctagaccccatctcggggttttgatgacagatttatgtaatcgttaagtctgaatttcggtttaatttgaaaatggttgtcttctgttcaaaaaaaaaaaccgttgctgtccaaaggctttcagctgtcacacaactggaaaaatggca

SEQ ID NO: 1991 - DNA, 512 bp, Gerbera hybrid cultivar
ctatatacaagtccaatccaaacctccatagacaatgtctggccgtggtaagggcggtaaggggctcggaaagggcggagcaaagcgtcaccggaaagttctccgggataacattcagggaatcacgaagccggcgatccggagacttgcgaggagaggcggagtgaagaggattagcggtctgatatatgaagaaaccagaggtgttcttaagatattcttggagaatgtgattcgcgatgctgttacgtacaccgagcacgcgcggaggaagacggtgactgccatggatgttgtttatgctttgaagaggcagggaaggactctgtatggattcggcggttgatttatctgtattgcctggtaatgtttattttgctgttatgattgtaatgaatcaagtggttcttttagggttttagtgatggtgatgtataattgatgaaactctactggatctacttcaaattgaaatctgaagcgcctttttgctaaaaaaaaaaaaaaaaaaa

SEQ ID NO: 1992 - DNA, 424 bp, Gerbera hybrid cultivar
caaaaccctagaaggattccgatccaatcgaagccgttttgcaacaatgtcgggccgtggaaagggcggaaaggggctgggcaagggcggagcaaagcgtcaccggaaagttctccgtgacaacatccagggaatcacgaagccggcaatcaggagattggcgaggagaggaggagtgaagaggatcagtggtttgatctatgaagaaaccagaggtgttcttaagatcttcttggagaatgtgatccgtgatgcagttacgtacactgagcacgctcggaggaagactgtgaccgccatggacgttgtgtatgccctgaagaggcagggaaggactctctatggattcggaggttaataaatctgtatttcatttgctgtttgtactgttttaatggtggaatgaaaggatttctatggtttt

SEQ ID NO: 1993 - DNA, 566 bp, Gerbera hybrid cultivar
ggagagagagagagagagagagagagagacagacagagatagagagagagagagatatatagagagagacagatagatccaaaccttcgtcgacaatgtccggccgtggtaagggcggtaaggggctcggaaagggcggagctaagcgtcaccggaaagttctccgggacaacatccagggaatcacgaagccggcgatccggaggctggctaggagaggcggagttaaaaggatcagcggtctgatctatgaagaaactagaggtgttcttaagatcttcttggagaatgttattcgtgatgcggttacttacacagagcacgcaaggaggaagacggtgactgcaatggatgtcgtgtacgctttgaagaggcagggaaggactctgtacggattcggaggttaataggtctgtaacttttgatgtctattttgctgttacgattgtaatggatctggtgttttttagggtttttgaattggagatttgtttttgattgaaacttcatctgattttaatggaaattaaaacgaaatttcgattgttgtgtaaaaaaaaaaaaaa

SEQ ID NO: 1994 - DNA, 521 bp, Panax ginseng
attcatcaattccttttctctctctctctctccctccaaccaaaccctagaaattaattgactttctctctcttctagctctgcaaaaatgtctggccgtggaaagggtggcaagggattgggcaagggaggagccaagaggcacaggaaagttttgagggataacattcagggaattaccaagcctgccattcgcaggcttgccagaagaggcggtgtgaagaggatttccggcctgatttatgaggagacacgtggagttctcaaaatctttttggaaaatgttattcgtgatgctgtgacctacaccgagcatgccaggaggaagacggtcactgccatggatgtggtgtatgcactcaagaggcagggccgaaccctttatggatttggtggttagattggttaggcttttgattgttctgttagtagttattgtagatctggtcattctctttaagggttctaaatctatctgtttgtttctagatcctaaaaccctgtggttgttcttttcatct

SEQ ID NO: 1995 - DNA, 552 bp, Heritiera littoralis
gattcaaaacttttttcttgttctcaatcttcatttcgaaaaggcgttctccgagaagatcaaaagcttttgaagaaaatgtcaggcagaggaaagggaggtaagggccttggtaaaggaggagccaagaggcacaggaaggttttaagggataacatccaaggtatcacgaagcccgccattcgccgtctggctcgtagaggtggagtcaagaggatcagcggcctgatctatgaagaaaccagaggagtcttgaagattttcttggagaatgtgattcgtgatgccgtgacttacactgagcacgcaagaagaaagactgttaccgccatggatgttgtctatgccttgaaaaggcagggcaggactctctatggtttcggaggttaggtctagtgcttatatcatagatttagcgtttggtgtattaagttcgtgactgtagaatcgtagatcttggctcctttgtgtgattgttcagtaactcgttgatgttatcgtaatctgtaatcatgaatatggtcatcggattaaagttcagcaaatctttct

SEQ ID NO: 1996 - DNA, 519 bp, Ipomoea batatas
gccggggacgcgatcaaaagtcaggtcagtttttcttagcgaagaagagaagtattgtctgaaaatgtctgggcgtggaaagggcggcaagggtttgggaaagggaggagctaaacgtcaccgtaaggttctccgggacaacatccaaggcatcacgaagccggccattcgccgtcttgctcgccgtggtggagtgaagcgtatctccggcctcatctacgaggagactcgcggcgtcctcaagatcttcctcgagaacgttatccgcgacgctgttacctacactgagcacgctcgccggaagacggtcactgcaatggacgtcgtgtatgctctcaagagacagggccgcactctgtacggattcggcggttaggtttggaaatcgtcggtgtatatcttggtggtgttttggtctagggttgatggttagggttagattgggcgttctgttctgaattaatctcagattgattgtttcaatgttactctgatttcaatctactgaatttcagttcc

SEQ ID NO: 1997 - DNA, 602 bp, Unknown
  Sequence found in Organisms: Ipomoea nil, Ipomoea batatas
acactcttcattgtcgttgcattctaagctctacaacttctcagatttaggaatttgtagttgagcgtctgttcagaatgtcgggtcggggaaaaggaggtaagggattgggaaagggaggagctaagcgtcacaggaaggtcctccgcgataacatccagggtattaccaagccggcgatccgtaggctggcccgtagaggcggcgtgaagcgtatcagcgggctcatatacgaggagactcgcggtgttttgaagatctttctggagaatgtgattagggatgccgtgacctacaccgagcacgcccgccgcaagacggttactgccatggacgtcgtgtatgcgctgaaaaggcagggtaggactctctatgggttcggcggttgagcgtttagggctgaatcgtttgtactggtctttgttatgagtcttgctgtcaagaaaattacaactgtcaacaatggctgggctctgctattacttactgttttttgtaaatactcattgttgggtattgtcttcttaggtatgtagttgaatgcttcatgttttgttatggggatgttgtcgttgaattcatgaattgatccttagatgagc

SEQ ID NO: 1998 - DNA, 600 bp, Ipomoea batatas
aaatctacttgtccattttacctcagtccgcgaattcaaaaccctagatttcttccttcactctgcaaaaatgtccggccgtggaaagggaggcaagggattgggcaagggaggagccaagcgtcacaggaaggtgcttcgcgacaacatccaggggatcaccaagccggccattcgccgtctggctcgtagaggaggcgtgaagcgtatctccggcctcatctacgaggagaccaggggagtcctcaaaatcttcctcgagaatgtgatcagagacgccgtgacctacactgagcacgctcggaggaagaccgtgacggcgatggacgtcgtctacgccctcaagaggcagggcaggactctgtacggtttcggaggctaggctgttgtgcgctattggatgttcgtctgtgtagttgcagatctgttcgactatttccgtttaggctctaggtagctattgcctgttttgtgattgataatttagaagtaaatgtaatatcctgttgcagttatgcagttacctgatctgattttgtgaatcaatacatcgttatctgctctatgaaaaccgaatttcgttcataaaaaaaaaaaaaa

SEQ ID NO: 1999 - DNA, 550 bp, Ipomoea batatas
taagactggagactcgcgccgctctgcaggtcgacactagtgggatccaaagagaattttccgaagatgtctgggcgtggaaagggcggtaagggtttgggaaagggaggagctaaacgacatcgtaaggtcctccgggacaacatccaaggcatcacgaagccggccattcgccgtctggctcgccgtggaggagtgaagcgtatctccggcctcatctacgaggagactcgcggcgtcctcaagatcttcctcgagaacgtcatccgcgacgctgttacctacactgagcacgctcgccggaagacggtcaccgcaatggacgtcgtctatgctctcaagagacagggccgcactctgtatggattcggcggttagaatttcgtatcgccggtgtatattttggtggtgtttaggtctagggttgatgattagggttaaactgggcgttctattttgaatcaatctccgattgatgattgttggaatgttaatctgatcttagatccaatgaattttagttcttatgaatccttaattctctaatttt

SEQ ID NO: 2000 - DNA, 595 bp, Ipomoea nil
cttccaaatcaaaatctacttgtccaatttacctctcactccaccaattcaaaaccctagatttcttctttctctctgcaaaaatgtccggccgtggaaagggaggcaagggattgggcaagggaggagccaagcgtcacaggaaggtgcttcgcgacaacatccaggggatcacgaagccggccattcgccgtctggctcgtagaggaggcgtgaagcgtatctccggcctcatctacgaggagaccaggggagtcctcaagatcttcctcgagaatgtgatcagagacgccgtgacatacactgagcacgctcggaggaagaccgtgacggcgatggacgtcgtctacgccctcaagaggcagggcaggactctgtacggtttcggaggctaggatgttgggatgcgctattggatgttcgtctgtgtaattgcagatctgttggactatttccgtttagtttttagttatgtttttaggttgtaggtagcgattgtctgcttgtttcgtgaatgtaatatcctgttgcagttaaagcatcactaataccttctgttctgattttgtgaatcaatacaacgttatctgctcta

SEQ ID NO: 2001 - DNA, 502 bp, Ipomoea nil
gacagcgtgatcaaaagacaggtcagatttccttagcgaagaagagaagaatttgctgaaaatgtctgggcgtggaaagggcggtaagggtttgggaaagggaggagcgaaacgacaccgtaaggtcctccgggacaacatccaaggcatcacgaagccggccattcgccgtcttgctcgccgtggtggagtgaagcgtatctccggcctcatctacgaggagactcgcggcgtcctcaagatcttcctcgagaacgtcatccgcgacgctgttacctacactgagcacgctcgccggaagacggtcaccgcaatggacgtcgtctatgctctcaagagacagggccgcactctgtacggattcggcggttaggttttgatatcggcggtgtatatttcggtggtgtttagatctagggttgatgattagggttaaattgggcgttctgttctgaatcaatctcagattgattgttacaatgtgactctgatattaatcata

SEQ ID NO: 2002 - DNA, 488 bp, Ipomoea nil
agcgaagaacagaagagttttctgaagatgtctggtcgtggaaagggaggtaagggtttgggaaagggaggagcgaaacgacaccgtaaggttctccgggacaatatccaaggcatcacgaagccggccattcgccgtctcgctcgccgtggtggagtgaagcgtatctccggtctaatctacgaggagactcgcggcgtccttaagattttcctcgagaacgtgatccgcgatgctgttacctacacagagcacgctcgccggaagacggtcaccgcaatggacgttgtgtatgctctcaagagacagggccgcactctgtacggcttcggcggttagggtttggcattggcggtgtatattttggtggcgtttaggtctaggattggggaggattagggttagattcggtgtgctattttgaatcaatccacaattgattgcttgttgcaatgttactcttatttcaatccaatcaatttcagttc

SEQ ID NO: 2003 - DNA, 490 bp, Ipomoea nil
gaagaagagaagagttgtctgaagatgtctgggcgtggaaagggcggtaagggtttgggaaagggaggagcgaaacgacaccgtaaggttctccgggacaacatccaaggcatcacgaagccggccattcgccgtctggctcgccgtggtggagtgaagcgtatctccggtctgatctacgaggagactcgcggcgtcctcaagatctttctcgagaacgtgatccgcgatgctgttacctacactgagcacgctcgccggaagacggttaccgcaatggatgttgtgtatgctctcaagaggcagggccgcactctgtacggcttcggcggttagggtttggcgtcgctggtgtatattttggtggtgtttaggtctagaattgaggaggattagggttagattgggtgtgctattttgaatcaatccacagattgattgattgattgttgcaatgttactctgatttcaatccaatcaatttcagttc

SEQ ID NO: 2004 - DNA, 620 bp, Ipomoea nil
gatacactctccattgtcgttgcattgtgagctcgaggtcattcttcgtcttctatacatttctcagatttaggaatttgtagagtgtcggttcagaatgtcgggtcggggaaaaggaggcaagggattgggaaagggaggagcgaagcgtcacaggaaggtcctccgcgataacatccagggtataactaagccggccattcgtaggctggcccgtagaggcggcgtgaagcgtatcagcggcctcatatacgaggagactcgcggcgttttgaagatctttctggagaatgtgattagggatgccgttacctacaccgagcacgcccgccgcaagacggttactgccatggatgtggtgtatgcgctgaaaaggcagggtcggactctttacgggttcggcggttgagcgttttgggctgaaccgtttgtactggtttttgttatgagtcttgctgtcaagaaaattagaactgtcaacaatggctctctgctttctgacttttttgtaaatactcttcagtgttgggtattgtcttcttaggtaggtagtagtttgttcactttactggtgatgttgaatgcttcatgttttgtttctggaatgggaattttgttgt

SEQ ID NO: 2005 - DNA, 621 bp, Ipomoea nil
gacccgaatacactcttcattgtcgttccaatttgagcttcaggccattctgcaacaacttttatacacttctcagttttaggaatttgtagttgggtgtctgttcagaatgtcgggtcggggaaaaggaggcaagggattgggaaagggaggagccaagcgtcacaggaaggtcctccgcgataacatccagggtataaccaagccggccatccgtaggctggcccgtagaggcggcgtgaagcgtatcagcggtctcatatacgaggagactcgcggcgtgttgaagatctttctggagaatgtgattagggatgccgttacctacacggagcacgcccgccgcaagacggttactgccatggatgtggtgtatgccttgaaaaggcaggggaggactctgtacggattcggtgggtgaatcgtttgtactggttttttgttatgagtcttgctgtcaagaaaattagaactgtcaacaatggctgggctcttttcttactcacttttttgtaaatactcattgttgggtattgtgttcttaggttggttgtagtttagtcactttagtgttggtgttgaacgctttatgttttgtttcagtaatgggaaatttgttgt

SEQ ID NO: 2006 - DNA, 508 bp, Ipomoea nil
gaccaattcttcaatcttccaatcgaaaccctagaaagcttttctcatcaaatttctcagtgcgaaaatgtcaggccgtggaaagggaggcaagggcttgggtaagggaggagccaagcgtcacaggaaggtcctccgcgacaacatccagggcatcaccaagcccgccatccgccgtctggctcgcagaggcggcgtgaagcgtatctccggcctcatctacgaggagaccagaggcgtcctcaagatcttcctcgaaaacgtgattagagatgcggtgacctacacggagcacgcccggagaaagaccgttacggcgatggacgtggtttacgcgctcaagaggcagggaaggactttgtacggatttggtggttaggagcttcataaactagggtttatgcttcttttctgaaatcagtggattatttgtgcttctgcattagttctatttactactgtgtaattctcaattgcgctgaaatatatcgattaattgaagataaaa

SEQ ID NO: 2007 - DNA, 525 bp, Ipomoea nil
gaccgagcaatcaaaattgtttgaaaggtcagatttccttagcgaagaagagaagaaattttcgaagatgtctgggcgcggaaagggcggtaagggtttgggaaagggtggagcgaaacgacaccgtaaggtcctccgggacaacatccagggcatcacgaagccggccattcgccgtcttgctcgccgtggtggagtgaagcgtatctccggcctcatctacgaggagactcgcggcgtcctcaagatcttcctcgagaacgtcatccgcgacgctgttacctacactgagcacgctcgccggaagacggtcactgcgatggacgtcgtctatgctctcaagagacagggccgcactctgtacggattcggtggttaggtttttatatcggcggtgtatatttttggtggtgtttaggtctagggttgattattaaggttaaattgggcgttctgttctgaatcaatctccgattgatgattgttacaatgttaatctgatttaagtccaatgattttcagttc

SEQ ID NO: 2008 - DNA, 536 bp, Jatropha curcas
attcagaaaggaaaggagaaaaagcttcgagcaagcggaaacgatgtcgggcagaggaaagggaggcaagggattgggaaagggaggagccaagaggcacaggaaggtcttaagagataacatacaaggcatcaccaaacctgcaattcgccgattggctagacgtggtggcgttaagcgtatctccggtctaatttacgaggaaaccagaggtgttttgaagattttcctcgagaatgttattcgagatgctgttacctatacagagcacgcccgccgcaagactgttactgcaatggatgttgtctatgccttgaagaggcagggccgtactctctatggttttggtggttagggattttaggatgtatggatggatctagaatgattaggggttgggtctagggtttctttttgtaatttggggcctcattttggtttatagttttttggagtttgtatctgtgcaaagtagtaatgaaatgaatggattgcattttgttagttctgttgctggatatgaaatttagccaaat

SEQ ID NO: 2009 - DNA, 586 bp, Jatropha curcas
tcgatcggttaaaagatgtcaggccgtggaaagggcggaaaggggctgggcaaaggaggagcaaagcgtcatcggaaagttctccgtgataacattcagggaatcacaaagccggcgattcgccggttggctcgaagaggtggagtgaaaagaatcagtggattgatctacgaagaaactcgtggagtactcaagatcttcttggagaatgtgattcgtgatgctgtgacatacactgagcatgctaggagaaagacggtgaccgccatggatgtggtctatgctttgaagaggcaaggaaggactctttatggatttggagggtaagaagggagtcttggtttgtggtgttggagatcggagaagtcttgctgtcaagaattagaagtgacaatggtggtggcagtggcggtggagacgacggtggttgttaaggtgtttagggttagggttaggtttttgtaattgttaatttgaatgttgtttctatgtaattagattggtgtgtttgggaatctgagtttatgtcagtactatggagtatctgtctttgtaattcattctatgaattgcaattttactgaaa

SEQ ID NO: 2010 - DNA, 469 bp, Lactuca sativa
attcatttctaacgagagaaaagtagagagaaaacatgtcaggaagaggaaaaggaggcaagggattgggaaagggtggagccaaacgtcatcgtaaggttctccgggacaacatccaaggtatcaccaagccggcgatccgccgtctagccagacgaggaggtgtcaagcgtatcagtgggttaatatacgaggagacccgtggtgttttgaagatctttcttgagaacgtcatccgtgacgccgtcacatacaccgaacacgctcgccggaaaactgtcaccgccatggatgttgtttacgctttgaagcgccaaggccgtactctctacggatttggtggttaagagaattttacggtttctactttctagggttcttgttgctttgttggcttatctgtaatccgaagtggtattacttgtaattgaagctattaatacaatatcacttatctaattaatctttt

SEQ ID NO: 2011 - DNA, 406 bp, Lactuca sativa
caatcaaaaccctaatttgaaaatgtcaggccgtggaaagggcggaaaagggctaggaaagggaggagcaaagcgtcatcggaaagttctcagggataacatccagggaatcacaaagccggcgatcaggagactggcgaggagaggaggagtgaagaggatcagtggtttgatctacgaagagacgcgaggtgttctcaagatctttttggagaatgtcattcgtgatgctgttacctacactgaacacgctcgtaggaagactgtgacagccatggatgttgtgtatgctttgaagaggcaaggaagaactttgtatggattcggaggttaatagatgtatgaggtggatagtgaatattatgcttcagttattgtaatgaatcatgtagaacttggaacgaat

SEQ ID NO: 2012 - DNA, 496 bp, Lactuca sativa
ataagaactcaaattcagcatctcatcttgagcttgtttcaacaatgtcgggacgtgggaagggaggcaagggactcggaaagggaggagcaaagcgacacaggaaggttcttcgggataacatccagggtatcaccaaacccgccatccggagattggctcgtcgaggaggtgtcaaacgtatcagtggcttgatctatgaagaaactcgtggtgttctcaagatctttctcgagaatgtcatcagagatgccgtaacctacactgaacatgctcgccgcaaaactgtaactgcaatggatgtcgtctatgctttgaaacgacaaggccgtaccctttatgggtttggtggttaggtttagggtttgggttatgaattagtgtgtattcactgtagatcgtattcgatttctccttcgttgtatcctgtttgaatatcgttgtcataccccatctcggggtatgggtttatgctatgaaaattccccttttttct

SEQ ID NO: 2013 - DNA, 537 bp, Lactuca sativa
cgggactcattcctcactcaatcacaactcaaattcagcatctctccttgagcttgttccaacaatgtcaggacgtggaaagggaggcaagggactcggaaagggaggagcaaagagacacaggaaggttcttcgtgataacatccagggaatcaccaagcccgccatccgaagattggctcgtcgaggaggtgtcaagcgtatcagtggcttgatctatgaagagactcgtggtgttctcaagatctttcttgagaatgtcatcagagatgccgtaacctacactgaacacgctcgccgcaagactgttactgcaatggatgtcgtctatgctttgaaacgacagggccgtaccctatatgggtttggtggttaggtctagggttttggttgtgtgttagtgtgtattcactgtagatcgtatctaatttcccctttcgttgtatcctgtttcaatatcgttgtcaaaccccatctcggggtttgaatttatgttatgaaaatcctcctattttatacaatcgtctgagtttcatc

SEQ ID NO: 2014 - DNA, 487 bp, Lactuca sativa
tcagatttcggagcaatttgaagatgtcaggccgtggaaagggcggaaaaggattgggaaagggaggtgcgaagcgtcatcgtaaggttctccgagacaacatccagggaatcacaaaaccggcgatcagacgtcttgcgagaagaggaggtgtgaaacgtatcagcgggttgatctacgaggaaactcgcggagttttgaagatctttctagagaatgtcatcagagatgctgttacctacaccgagcacgcacgccggaaaactgtcaccgccatggatgtggtgtacgcgctcaagagacaaggccgaactctctacggattcggtggttagggttttactagtgttggtgtttctttagtgatttctactacttgttgaaatcaactgttgtaagttttatgctatttcttaaaccaaaccagaagtaatagacggatttcctatttcggtttcgccaaaaacaaaatcaaattggttgcttt

SEQ ID NO: 2015 - DNA, 507 bp, Lactuca sativa
gcgggacgtcttcattccaaaccctaatttcacctttgaattcgatcttagcatctttctgaaatgtcgggccgtggcaagggaggcaaaggattgggaaagggaggagccaagagacaccggaaagttcttcgtgataacattcaaggcatcacaaagcccgccattagaaggttagctcgaagaggaggtgtcaagcgtatcagcggtttgatatatgaggagacccgtggagttctcaagatatttctcgagaatgtcatcagagacgccgtcacatacaccgaacatgctcgccggaaaactgttacagcgatggacgttgtttatgcgttgaaacgacaggggcgtactctctatggattcggtggttaaaattttaggtagttcttagaagttaatgaagtgattgtagatcttgttcgttgtttatttcccgttgtagggttgttcaagctattgaaaatttctgattttcataatcataacgagtctaattgacaaaga

SEQ ID NO: 2016 - DNA, 474 bp, Lolium multiflorum
gcaatgtcaggccgcggcaagggaggcaaggggctgggcaagggcggcgccaagcgccaccggaaggtgctgcgcgacaacatccagggcatcaccaagccggccatccggcgcctggcccgccgtggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggaggctgagctcggcgaccgctctagctgggtcggcgtgtccctaagggctgtccgttgttagggtctggattgcgtgcgtgagtagtttggaagcgatggcgatgcagcctgtgatggaattcgttgcacatggatggatgaatgaatggatttggtgtggttgga

SEQ ID NO: 2017 - DNA, 529 bp, Lolium multiflorum
cagccatgtcgggccgcggcaagggaggaaaggggctgggcaagggcggcgccaagcgccaccgcaaggtgctccgcgacaacatccagggcatcaccaagccggccatccgccgcctggcccgccgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtagtctacgcgctcaagcgccagggtcgcactctctacggcttcggcggctagaggcctctcctcctcttcgtccgcctagagtgctcatgtagttcctcatctggaggtgtagagatgttgttaccttcttccagtgagtgcgtgccggaatctagtaggtgtggtaggtgttcttgttcgtgctctcatgcattgtgttagtttctgttcgtgtctgatgttacccgcttgttattatcagtaatgaaaatgttggctaccag

SEQ ID NO: 2018 - DNA, 449 bp, Lotus japonicus
gtaatcacccaaactacacataatctctttttttctcggtaattaatctacttcatcaattgcttaattaagtttcatccaactcaatttcttgttctaattttttgttaactgttgcagattgtgattagcgataacaatgtcagggcgtggaaaaggaggcaagggattaggaaagggaggagcaaaacgacaccgtaaggtgctgcgcgacaacatccagggcataaccaagccggcgattcggcgtttggcgcgtaggggcggcgtgaagcgtatcagcggccttatctatgaggagacacgcggcgtgctcaagatctttctcgagaatgtgatccgggatgctgttacgtacactgagcacgcgaggaggaagacggttacggcgatggatgtggtgtacgcgctcaagaggcaggggaggactctgtatggatttgggggtt

SEQ ID NO: 2019 - DNA, 533 bp, Lotus japonicus
acaattcaaaaccctaaatccccaaatttcgaaatccccaaaattttctcgggaaaatgtctggtcgtggaaagggtggcaagggactcggcaagggaggagccaagaggcacaggaaggtgctgcgcgacaacatccagggcatcacgaagccggcgattcggaggttggcgaggagaggtggcgtgaagaggatcagtgggttgatctatgaggagactaggggtgtgttgaagatcttcttggagaatgtgattcgtgatgcggttacatacaccgagcatgcgaggaggaagactgttactgctatggatgttgtttatgctcttaagaggcagggaaggaccctctatggattcgggggttgaaaatttgggttgctgtggggttgtgctgttctgggttttgggatttgggttgtgggtatgtgtaaatttggtgaatttgaggtgttggttgtgttttttggtttgagctgaattgtcatgtatgttgattatctcaatctaatgaaagatgattgaagttacttc

SEQ ID NO: 2020 - DNA, 339 bp, Lotus japonicus
ttgcaaattttctcgggaaaatgtcaggtcgtggaaagggtggaaaggggcttggcaagggcggagcaaagaggcacaggaaggttctgcgcgacaacatccaaggcatcacgaagcccgcgattcggaggctggcgaggagaggcggcgtgaagaggatcagcggtctcatctacgaggaaaccaggggagtgctcaagatcttcttggagaacgtgatccgtgatgcggtgacgtacacggagcacgccaggaggaagacggtcaccgccatggatgtcgtttatgctctcaagaggcagggcaggactctctatggcttcggaggttaaagaatat

SEQ ID NO: 2021 - DNA, 327 bp, Lotus japonicus
aaatcgcaaccatgtcaggaagaggaaagggaggcaagggtttgggcaagggaggagctaagcgtcacaggaaggttctgagggataacatccagggaatcaccaagcctgccattcgccgtctcgcaaggcgtggtggtgtgaagcgtatcagcggtctcatctatgaagaaactcgcggtgttctcaagatcttcctcgagaacgttattcgtgatgctgttacctacactgagcacgctcgccgcaagactgtgacggcgatggacgttgtttacgctctcaagaggcagggcaggaccctctatggtttcggtggttagggat

SEQ ID NO: 2022 - DNA, 506 bp, Medicago truncatula
atcattttcatctcaatctcaatctcaatcgcagagagagaaactcaaagccatgtcaggaagaggcaaaggaggaaagggtttaggaaagggtggagcgaaacgacaccgtaaggttctgcgcgataacatccagggaatcacaaagcctgcgattcgtcgtctcgcaagacgtggtggtgtgaagcgtatcagtggcttaatctatgaagaaactcgtggcgttctcaagatctttcttgagaatgtgattcgtgatgctgtcacatacacagagcatgctcgccgtaagactgttactgcaatggatgttgtttacgctctcaagaggcagggaaggactctttacggtttcgggggttagggtttcttgtattgaaattttcaaatttgatatatatattttgtaaccgcacttgagctctagcattaacgatgattaattgctttgataagagttgttaaacgttgatttgaattttcaatccagtaattaatttcatgaa

SEQ ID NO: 2023 - DNA, 504 bp, Medicago truncatula
ggggactccaattcaaaaccaaaccctaatttcttcaaatttctcaaactttcttcgtttatcggattttcatctcttgaaaatgtctggtcgtggtaagggaggtaagggactaggaaagggaggtgcaaagaggcataggaaggtgcttcgcgataacatccagggtatcactaagcctgcgattcgtcgtttggcgagaagagggggtgtgaagaggatcagtggtttgatctatgaagaaaccagaggtgtgttgaagatcttcttggagaatgtcattcgtgacgcagttacatacactgagcatgcaaggaggaagactgtgactgccatggatgttgtctatgctttgaagaggcagggaagaaccctctatgggtttggaggttgatgaattgaagaagaagaacagaagaagaagaagaagcactcttttgtgtattattgtttagctagtaattggaactcgtggttgttccttataatatgcttattttttac

SEQ ID NO: 2024 - DNA, 583 bp, Mimulus guttatus
atccactacttgcagaataacttcaaatagtttctctctctagaatacaattttcagttagcggaaaatgtcaggtcgtggcaaaggaggcaagggtttgggaaagggcggagcaaaacgacaccgtaaggtcctgagggataatatccagggaatcaccaagccagccatccgtcgtttggctcgtaggggtggagtcaagcgtatcagcgggcttatctacgaggagacacgtggcgtcctgaagatatttttggagaatgttatccgtgacgccgtcacatacaccgagcacgctcgccggaaaaccgtgaccgccatggatgtggtttatgcgctgaagaggcagggacgtactctctacggattcggcggttgattttctagggttttggtgtaaaatacacgctgtagttggattaggttctttttaattccgattgatgaagattttgttgtttaattttagtgtagttatcgtcgtttgttctgatctttctcggatcggatttctctttgttgaattgaatgaaatgaaattgttgaattgctgtttgccattatttcaatttcgtacacgcac

SEQ ID NO: 2025 - DNA, 593 bp, Mimulus guttatus
actcacagcagtaaactctaaatcaggatttacccccaaaattattatctagtttcatagaaagagagagaagagaaaaaaaatgtcaggaagaggaaagggcggcaagggtttgggaaagggcggagcaaagcggcacaggaaggttctccgggataacatccaaggcatcaccaagcctgcgattcgccgccttgcccgccgtggcggcgttaagcgcataagcggcctcatctacgaggagactcgcggcgttctgaagatctttttggagaacgtcatccgcgacgccgtcacctacaccgagcacgcccgccggaagacggtcaccgccatggacgttgtctacgcgctcaagaggcagggccgcaccctctacgggttcggaggctgagaatttctcgatttacggctgaggatggtgatattttgtgtagatttgggaattattcttagggtttatcttttagggtttatgtagggaatttggggatctggtactgttcaattgtctgtttttttttttttttatttgaatcaaatcgagtttattacttttgttctaacgcagttatcaattaatttcaatttta

SEQ ID NO: 2026 - DNA, 547 bp, Mimulus guttatus
ttcaatctctcaattgaaaaatgtcagggcgcggaaagggcggcaagggtttggggaagggcggagccaaacgacaccgtaaggtgctcagggataacatccagggcatcaccaagccggctatccgccgtttggctcgcagaggcggcgtcaagcgtatcagcggcctcatctacgaggagacacgtggcgtcctgaagatcttccttgagaacgtcatccgcgacgccgttacttacaccgagcacgctcgccggaaaaccgtcacggccatggatgtcgtttacgctctcaagaggcagggccgtactctctatggattcggtggttagggtttcaattgatggatgtttaggactaagctttctattcctagtagttttattagatgattagggtttatcgactgtgggctctgtaatcagattcccccccccccttttttttttcctcccgaaatgaatattaaattctcaatatatctttcaatttatgctatttctcgattccaattgaccaattcttcatgatttcctgattataattt

SEQ ID NO: 2027 - DNA, 540 bp, Mimulus guttatus
tgaaaattttatttttgtttaaattctaatcggaaaagatgtcagggagaggaaagggcggcaagggtttggggaagggcggagcaaagcgacacaggaaggtgctgagggacaacatccagggcatcacgaagccggcgatccgccgcctcgcgcggcgcggcggcgtgaagcgcatcagcggcctcatctacgaggagacgcgcggcgttctgaagatatttttggagaacgtgatccgcgacgccgtcacctacaccgagcacgcccgccggaagactgtcaccgccatggatgttgtttacgcgctcaagaggcagggccgcactctgtacggtttcggaggttaagtttttttttttttctagggttagggtttgtggattttggaatgtgtatatgttggatgaacaattagtgtttgggagatttgatttctgttgttttagattttcgttgtggatcttttgttttggattaggatttgttcatcagtatcttttgttggaatgaaatctggattagttgaaatttttggct

SEQ ID NO: 2028 - DNA, 1530 bp, Mimulus guttatus
agataatcagatgctccatcgctgacgaacctctgtaactcgaaccgagtcgatggctgcactcaacctctcatcttcattacactctccatcttctcttcgaagattccccaattttcatccttccagaagtacccccactatttccttttattcccttcccaaaccatctattccatttccgtccacatcgcttgtgcagaaaaccgctctaataagtcgccgtctcaacgtcgtcgtttcggcggtgaagaatttatctgagactgagttggtgcccgtttcgtcggaaaacgaattcccatccgattccggtgtttatgccatttacaatgacagcgacgaccttcaattcatcggcataaccaggaatctcgccgccagtgttctcacccacaagaaatccgtgcctgagctctgtttctccgtgaaggttggggtggtagaggagcctgataaaactgctttaaccgaagcatggaagtcatggatgcaagaacatatagcagcttcagggaaggttccaccaggtaacgaaccaggaaatacaacatgggtgaagaaggcagctccgagaaagaagcctgatctgaggttgacacctggcagtcacgtccaactgacagtacctttggaagatctcatcgacaggttagtgaaagagaacaaagtggtagcattcatcaaagggtcaagaagcgccccattatgcggattctcacaaagggtcgttggaattcttgaaagtcaaggggtggaatatgaaagtgttgacgtactggatgaagagtacaattatggtttaagggagactttgaagaagtacagtaactggcctactttccctcaggtttttgttaatggtgatctccttggtggctgtgatatattgacctccatgcatgagaatggtgaacttgctggtctctttaaacactcacatattaaaaaggagaaaggggtaattaaaatgtcggggaggggaaagggcggcaagggacttggtaagggcggcgcaaagcggcaccgtaaggttctgagggacaacatccagggcatcactaagccggctattcggcgtctggctcgcaggggtggcgtgaagcgaatcagtgggctcatctacgaggagacacgtggcgttctcaagatcttcctcgagaatgtcatccgcgacgccgtcacctacaccgagcacgcccgccgcaagactgtgacggcgatggatgttgtttatgccctcaagaggcagggccgaactctttatggattcggcggttaagttccaatttgtcagatctgtaattaggaatttttcttttcgctatgttaagaaatttggtaatgtaacctgtcttatatatttgctaattccaagtgatatggaaatcggagtataattttttgtttttaatatcttagatgctggttaaattcttgttgatcagtgttattagagtgagagctcacaatgttttcgaatctagtgttgcttattcttatacaatttggatttgtcatttgaatata

SEQ ID NO: 2029 - DNA, 554 bp, Mimulus guttatus
ctaattcaaatttcaatctcattcaaagtaaggtaaaattagggtttgaataaaaatgtcagggagaggaaagggaggaaagggtttgggaaagggcggagcaaagcgccaccgcaaagtgctgagagacaacatccagggaatcacaaagccggctatccgccgtctggctcgccgtggcggagtgaagcgcatcagcggtctcatctacgaggagacacgtggcgtcctcaagatcttccttgagaacgttatccgtgacgccgttacctacaccgagcacgctcgccgcaaaaccgtgacggcgatggacgtcgtctatgccttgaagaggcagggccgaactctctacggtttcggtggttaagttccgtgcagtttggctggtttcattagattgtagatttagggtttcattactatgtttctatcatctcagatccaaaaattagaagtttgaacgataggtttctatctcagatccttgtatcttaaatcgaattaaaatttctgttgattattgccttcttttttttttaattatttttattttt

SEQ ID NO: 2030 - DNA, 504 bp, Mimulus guttatus
aaaaaccaaatcaaaaataaaataaatttttcgaaaaatgtcaggaagaggaaagggcggaaaggggctgggaaagggcggggcaaagcgccaccgcaaagtgctccgcgacaacatccagggcatcacaaagccggccatccgccgtctggctcgtaggggcggcgtgaagagaataagcggattgatctatgaagagacacgtggcgtgctgaagatattcctggagaacgtgatccgtgacgccgtcacctacaccgagcacgctcgccgcaaaacagtaactgccatggacgtggtttatgctctcaagaggcagggccgtactctttacgggttcggtggttgattttagtattagggtttctttgtacatttctctttagatcgaatctaccagatgtaatgtttttttcagtaaaatggtattttgtttgaacaattcctctctttactgtatctaccagactttataatattcaatctaactgttaccaatgctgc

SEQ ID NO: 2031 - DNA, 628 bp, Tropaeolum majus
cggccggccggggtatcaaatcaattttctcaaatcaaattcttagatctggtaaagatttcatttcgagattttcggaagtagtcaactcgaatcgaagatgtccggacgtggaaagggaggtaaaggattaggaaagggaggagccaagaggcacaggaaggttcttcgtgataacatccaaggtatcaccaagcctgcgattcgtcgtttggcacgtagaggcggtgtgaaacgtatcagcgggttgatttacgaagagacgagaggtgtgttgaagatctttttggagaacgtcattcgtgatgctgttacgtacaccgagcacgctagaaggaagacggttacggctatggatgttgtttatgctttgaagagacaaggaaggactctgtacggattcggtggttagattgggatttttttatttctggtggtagtggttaagggaccatctggatgaagtcttgctagctgtcaagaatggttgttgatttggttgtgtaggggttagggttttagctttctctgtagtttgtgaattttggatagaattagcatttggaaaatggatcttgaaatcggaattcatgtaattgattgtttcttaattggagttcggtttgat

SEQ ID NO: 2032 - DNA, 607 bp, Tropaeolum majus
cggccggggggtactgaatcaaaaaacaatcaaatctagggtttcagatctcatctaatcaaacaatgtcaggccgtggaaagggaggaaagggattaggaaagggaggagccaagaggcacaggaaggtgcttagggataacatccaaggtatcactaaacctgctatccgtcgtttggctcgtaggggtggtgtgaagcgtatcagcggtttaatctacgaggaaaccagaggtgtgttgaagatcttcttggagaatgttattcgtgatgctgtgacttacaccgagcatgccaggaggaagacggttacagccatggatgtcgtatatgcactaaagaggcaaggtcgtactctctacgggtttgggggttaggttatttagttctctttctgttcatatttggcgattgtgcatcgttagatgaagtcttcgatggtgtctataagacttttataacgtctagcatcgctctaatttcagtttcggattcgtcatgtgatttgttatcttgattgtaagacaatccaaatatttatatcaacgtgatgttttccgataaccactgtttgctgcaattcaattggtacgatgtttgtttcatt

SEQ ID NO: 2033 - DNA, 615 bp, Tropaeolum majus
acggccggggtattccaacaaatctactatttcattcgattctctagatctatcgaaatcttgagattcttgcaatcaaaatcttcttgaataatgtctggacgtggaaagggaggtaaaggattaggaaagggaggagcgaagaggcacaggaaggtccttcgtgataacatccagggtatcactaagccggcgattcgtcgtttggctcgtagaggtggcgtgaagcgtattagtggtttgatctacgaggagactagaggtgtattgaagatctttttggaaaacgtgatccgtgatgcagtgacttacacagagcacgcaaggaggaagacggttactgctatggatgttgtgtatgcactcaagagacaaggtagaaccttatacggcttcggcggttagggtttcaattcgatttaggggttttggtattgaaaatgcagttcagaaagtcttgctgtcaagaaaaaaaatagatgtaatcgacggctttggatttatagttagggtttgtgtaattaggggctgaatttcgattgggaatttacttcttgaatttgtacgttttgctatgaattgcaagctggggaattataattggttggtcgttaa

SEQ ID NO: 2034 - DNA, 503 bp, Tropaeolum majus
aattactgaacttacaaaaacttaactgctttcaaatcagaatatcgtgaaaatgtcagggagaggaaagggaggcaaaggattaggaaagggaggagccaagaggcacaggaaagtgttgagagataacatccagggcattacaaaacctgcgattcgaaggcttgctcgtagaggaggtgttaaacgaatcagcggtctcatctacgaggagactcgtggagttctcaagatcttcttggagaacgtgatccgtgatgccgttacatacacagagcacgccagaaggaagactgtgactgcaatggacgtcgtctatgcactcaagaggcaaggtagaactctttatggtttcggtggttaagatctcgtatgttgtacatggaaaaatagaaaattaggaaatttaccgagtcattcttagggctttatgcctggtgtatccagatttgtaatgaactcgcttcacctgttgagtattttttttttatagtaatatggaa

SEQ ID NO: 2035 - DNA, 564 bp, Tropaeolum majus
aaaccattcatcttcgaattggtattgaaaatatacgaacttcactaaaatttctggaagcgaaatgtcaggaagaggaaagggaggaaaaggtctaggtaaaggaggggccaagaggcacaggaaggtgttgcgtgataacatccagggcatcaccaagcccgccatcagaagacttgctcgtagaggtggagttaagagaatcagtggtctaatctatgaggaaactcgtggagttcttaagatcttcttggagaatgttatccgcgatgctgttacttacaccgaacatgctagaagaaagactgtgactgcaatggacgttgtttatgctctcaagaggcagggtcgaactctctatggtttcggcggttaagaggcaatgtgttgtaaatggaaaacgaaactcagcgattgcttaaatctttcctagagatttacattttgatgtaaaacaaatttgtaatgacgttcttaattatttgcgtatggatatccaatggtatttgttaagatcacttttagttcctgttcatatcgcagacgttttttcccattatgttc

SEQ ID NO: 2036 - DNA, 482 bp, Tropaeolum majus
cggccggggttaggttattgaaaatatacaacttcccttacattctttgaagcgtaatgtcaggaagaggtaagggaggaaagggtctcggcaaaggaggggccaagaggcacaggaaggttttgcgggataacatccagggcattaccaaacccgccatccgaagacttgctcgtagaggtggagttaagagaatcagtggtttaatctatgaggagactcgtggagttcttaagatcttcttggagaatgttatccgtgatgctgttacttacactgagcatgctagaagaaagactgtgactgcaatggacgttgtttatgctctcaagaggcagggtcgaactctctacggtttcggtggttaagaggtcatgtgtcgtaaatggaaaatgaaactcagcgaatgtttgaatcttatctagggatttacatattgatgttaaacaaatttgtaacgaagttctgaattatttgcgtat

SEQ ID NO: 2037 - DNA, 440 bp, Tropaeolum majus
atcaggacttgctcaatttcttccattccccaaataagatctgttttcttctgatttcatttcatctattccggcatcatgtctggccgtggaaagggaggaaagggtttgggcaaaggaggagctaagcgtcacaggaaggtgttgagggataacattcaaggaataacaaagccagcaatccgtcggttggctaggagaggaggagttaagaggatcagcggtttgatttatgaggaaacccgtggtgttcttaagatcttcctcgagaatgttatccgtgatgctgttacctacaccgagcatgctcgtcgcaaaaccgtaactgccatggatgttgtttatgctttaaaacgtcaaggaaggacactgtatggctttggaggctaaagatcggtttgtaatttattcgttgttgctctgttctttgagatgtggat

SEQ ID NO: 2038 - DNA, 589 bp, Tropaeolum majus
aacaaacccagaaaaacatcatacattgcttaatctctgtatcggcgaaatgtcaggaagaggaaagggaggtaaagggctcggaaagggaggagccaagaggcacaggaaagtgttgcgtgataacatccagggcatcaccaaacctgctattcgaaggcttgctcgtagaggaggtgttaagcgaatcagcggtctcatctatgaggagactcgcggagttctcaagatctttttggagaacgtgatccgtgatgccgttacgtacactgagcacgccaggagaaagactgtgacggcaatggatgtggtctacgctctcaagaggcaaggccgaactctttatggttttggtggttaagatctcatatcttgtacatgaaaacacgaaattacgacgaattcgaatcattcttaaggatttatagttgatgtattcctgatttgtaatgaactagcttcacttattgagcttattttcatagttaaattgaatggtaattggtctctttctattgttaattccgttgcctggtataataatgtagctctacggttctgaatacttgaaagaatgctattgcggtaa

SEQ ID NO: 2039 - DNA, 543 bp, Orobanche aegyptiaca
gctcaagcctaaatttaattaaaaataaatgtcaggaagaggaaagggaggcaagggtttgggaaagggcggagccaagcggcacaggaaggtgctcagagacaacatccaggggatcaccaagccggcgatccgccgactggcccgacgtgggggcgttaagcgcatcagtggcctcatctacgaggagactcgcggcgtcttgaagatattcttggagaacgtcatccgtgacgctgtcacctacactgagcacgctcgccggaagacggttactgcaatggacgtcgtttacgccctcaagaggcagggccgcacgctttatggattcggaggttagcggatttgtagtgatagtgattgggacaggggttggagtagaatttgtatagattggggacggcggtttggatgtggaatgaattgttgtttggagtttgtgatatttgggattatgtaagattgggatggctctgtatccgaaaactatgttttttgtttgttttgtttgattttctgaaatctccaaccaaaaaaaaaaaa

SEQ ID NO: 2040 - DNA, 500 bp, Orobanche aegyptiaca
agcttcatctaattcctactaaatcgataaattagtgttcaattaaaatgtccggaagaggaaagggcggcaagggattgggcaagggcggcgcaaagcgccatcgcaaggtgttgagggataacattcagggcatcacgaagccggctatccgtcgtctggcccgccgtggtggcgtgaagcgtatcagcggtctcatctacgaggagacacgtggcgtcctcaagatattcctcgagaatgtcatccgtgatgctgtcacctacactgagcacgctcgccggaagactgtgacggcgatggatgttgtttacgcgcttaagaggcagggaaggacactttatggcttcggtggctaaattcgtaaagttagggtttgattagatctagatttaggtgtttgttatattatgcttgaacaatggtactgtgaacaatcttagatccttgtatgtgtgttttgttttcttatatggaaatggaatggaatctctgtgatt

SEQ ID NO: 2041 - DNA, 577 bp, Orobanche aegyptiaca
aaaaatcaagcttaagtctgaatctaatttaaaacaaaaatgtcaggaagaggaaagggaggtaagggtttgggaaaaggcggagccaagcggcacaggaaggtgctgagagacaacatccagggtatcaccaagccggcgatccgtcgactggctcgccgcggcggcgttaagcgcatcagtggcctcatctacgaggagactcgcggcgtcttgaagatcttcttggagaacgtcatccgtgatgctgtcacctacactgagcacgctcgccggaagacggtaactgcaatggacgttgtttacgccctcaagaggcagggccgcacgctttatggattcggaggttaggggatttgtaaggttagtgattgggggcgggttggagtggaatttgtatagatttggggtggcggtagatgtggaatgaattgttgtttgaattttgtgatatttgggattatgtaagattgggatggttctgtttccgagaaatggttgtgtttccgaaaactccatttttcgtttgttttgttaattttgatgatatgcgtttgattttaggaaaatcttttac

SEQ ID NO: 2042 - DNA, 662 bp, Orobanche aegyptiaca
caaacttccaaaatctctctcgcttttctatatacacttcattatcaaatagcaacaagaacaaaatgtctggacgcggcaaaggaggcaagggtttgggaaagggcggagccaaacgacaccgtaaggtgttgagggacaacattcagggaatcacgaagcctgccattcgtcgattggctcgtaggggtggggtcaagcgtatcagtggactcatctacgaggagactcgcggcgtcttgaagatcttcttggagaacgtcattcgcgacgcagtcacctacactgagcacgctcgccggaaaactgtcaccgccatggacgttgtttatgctttgaagaggcagggtcgtactctgtacggtttcggaggttagaatcattgggtttgtatgatttgtgtaaatcggcatggttattgatggagatggtttggtattttgtttagtgctgtagtctggatattagtgtttggtttgatctatctcagatctttgttttttctcttgaattggaatgaaaaacgatattcaaattgtgttcttttgttttggttatgttttgagaattctcattcagtgtcttcatagtatttggctggaaaaaaatgagaagaatttgcgcagctattttctttttttgtcgatttagtcatcacatta

SEQ ID NO: 2043 - DNA, 599 bp, Orobanche aegyptiaca
acaaattagttattgaatcaagatgtcgggaagaggcaagggaggcaagggactgggcaagggcggcgcaaagcgccatcggaaggtgttgagagataacattcagggcatcacgaagcccgctatccgtcgtctggcccgccgtggtggagtgaagcgtatcagcggtctcatctacgaagagacacgtggcgtccttaagatattcctcgaaaatgttatccgtgacgccgtcacctacactgagcacgctcgccggaagactgtgacggcgatggatgttgtttacgcccttaagaggcagggaaggacactttatggcttcggtggttaaatttctaaagatagggtttcattagatgtagatttaggggtttcctatattatgcttgaacaatggtactgtgatcaatcttatgtccgtgtattttgtttcgttttcttatatggaatggaatttctgtgattttactcctaaactttggttcttctagactatgctattgcttcaattacagctaaattctgtagcttgctttgcagtttcctcttcttattggtatgattatttgagtaaagtaactaaaaaaaaaaaaaaa

SEQ ID NO: 2044 - DNA, 441 bp, Orobanche aegyptiaca
aaatcgaaaaattactctaaattaaaatgtcgggaagaggcaagggcggcaagggattgggcaagggcggtgcaaagcgccatcgcaaggtgttgagagataacattcagggcatcacaaagccggctatccggcgtctggcccgccgtggcggcgtgaagcgtatcagcgggctcatctatgaggagacacgtggtgtcctcaagatattcctcgagaatgtcatccgtgatgccgtcacctacactgagcacgctcgccggaagactgtgacggcgatggatgttgtgtacgctcttaagaggcagggaaggacgctttatggatttgggggttaatttcgttaatttagggtttgtttagacgtagatttagggttctcttatattatgcttgaacaactgtgtaccgtgatcaatctatcttagatccttgtatgtt

SEQ ID NO: 2045 - DNA, 641 bp, Orobanche aegyptiaca
aattcttttgctctaatctcaccgaaagagaagaaaaatgtcaggaagaggaaagggaggcaagggtttgggaaagggcggagctaagcgtcaccggaaggttctcagggataacattcagggtatcaccaagccggcgattcgaaggctggctcgtcgcggcggcgtcaagcgcataagcggtcttatatacgaggagacacgtggcgtcttgaagatcttcttggagaacgtcattcgtgacgccgtcacctacactgagcacgctcgccgcaagacggtgacggccatggatgtggtttatgctctaaagaggcaggggcgtacactttatgggttcgggggctagggtttctgtttgggtttttgcttagtatgatgatattttatatggattgggaatattgtttgttgttgttagggactctatgttagggtttatgtaatgttgttatttagggattttatattcccatatcctgtgtttctaattaaatctgagaaattgttacagaaattctcatatttgttcaccttagctaagcctggaagtttatacttttagttatggagtctatgattatgattgttccaaaggaaattgttattataaatgatatattttcccacaaattcgacaa

SEQ ID NO: 2046 - DNA, 526 bp, Orobanche aegyptiaca
atatacacttcattatcagatagcaataagaacaaaatgtctggacgtggcaaaggaggcaagggtttgggaaagggcggagccaaacgacaccgtaaggtgttgagggacaacattcagggcatcacgaagcctgccattcgtcgattggctcgtaggggtggggtcaagcgtatcagtggactcatctacgaggagactcgcggcgtcttgaagatcttcttggagaacgtcatccgtgacgctgtcacctacactgagcacgctcgccggaaaactgtcactgccatggatgttgtttatgctttgaagaggcaggggcgtactctgtacggattcggagggtaaagacctagggtttggttttcattgtgtagctcgtcattgttattgatcgagctggtttatggtttcgttaagtgatgtagtttggatattattgtttagtttgatctaactcagatatttgtttttctcttgaaatggaatgaaaatatctcgttttaatacaaaaaaaaaaaaaaaa

SEQ ID NO: 2047 - DNA, 577 bp, Orobanche aegyptiaca
tttcctctccaatttctcaattatatcaaaagctgaaaaatgtctggccgtggaaagggtggcaagggtcttggtaaaggcggagccaaacgacaccgtaaggtgctgagggataacattcagggaatcaccaagccggctatccgtcgtttggctcgcagaggtggcgtcaagcgtatcagtgggcttatctatgaggagacacgtggtgtcttgaagatcttcctcgaaaacgtcatccgagacgccgtaacttacactgagcatgctcgccggaaaaccgtaacggcgatggatgtcgtttacgctctcaaaaggcagggccgtactttgtacggttttggtggctgaggttgcgcgttgtgtggttgctgtttagggttagaagtttttccgttaatattttcttggtagaaaattaagtgtagtgattttatggattgggttttcaatggttgttagcttactgaacacatgtagtcacatctgtgttttcaatgaaacaaaaatttctgaaattcacgtctaatttttgagttgcctttgattcatgacaaaattgaataaattaatgttc

SEQ ID NO: 2048 - DNA, 466 bp, Orobanche aegyptiaca
caaagtaaatcgataaattattgctcaatcaaaatgtcgggaagaggcaagggcggcaagggattgggaaagggcggcgcaaagcgccatcgcaaggtgctgagagataacattcagggcatcacgaagccggctatccgccgtctggcccgccgtggtggagtgaagcgtatcagcggtctcatctacgaggagacacgtggcgtcctcaagatattcctcgagaatgtcatccgtgatgctgtcacctacactgagcacgctcgccggaagactgtgacggcgatggatgttgtttacgcgcttaagaggcagggaaggacactttatggctttggtggctaaattcgtaaagttagggtttgattagatgtagatttaggggtttgtatgttatatcatgtttgaacgatggtactgtgaacaatcgtagattcttgtatgtctgttttattttcttatatgg

SEQ ID NO: 2049 - DNA, 434 bp, Orobanche aegyptiaca
aagatgtcgggaagaggtaagggcggcaagggactgggcaagggcggcgcaaagcgccatcggaaggtgttgagagataacattcagggcatcacgaagccggctatccgtcgtttggcccgccgtggcggtgtcaagcgtatcagcggtctcatctacgaggagacacgtggcgtcctcaagatattcctcgagaatgtcatccgtgatgccgtcacctacactgagcacgctcgccggaagactgtgacggcgatggatgttgtttacgcccttaagaggcagggaaggacgctttatggcttcggtggctaagtcgtaaagttagggttttattagatgtagatttaggggttttgttatattatgctttaacaattgtactgtgatctatcttagattccttgtacgttttgttttgttttcttatatgg

SEQ ID NO: 2050 - DNA, 507 bp, Orobanche aegyptiaca
tttcagcttcatctcattccaagtaaatcgaaaaatttgctcttaattaaaatgtcgggaagaggcaagggcggcaagggattgggcaagggcggcgcaaagcgccatcgcaaggtgttgagagataacattcagggcatcacgaagccggctatccggcgtctggcccgccgtggtggcgtgaagcgtatcagcgggctcatctatgaggagacacgtggcgtcctcaagatattcctcgagaatgtcatccgtgatgccgtcacctacactgagcacgctcgccggaagactgtgacggcgatggatgttgtgtacgctcttaagaggcagggaaggacactttatggatttgggggctaattacgtaaagttagggtttgattagatgtagatttagggttctcttatattatgtttgaacaactgtaccgtgatcagtctatcttagatccttgtatgtttgttttgttttattatatggaatggaacttttgtgatcttaat

SEQ ID NO: 2051 - DNA, 718 bp, Orobanche aegyptiaca
cacagaaaatgtccggaagaggaaagggaggcaagggtttgggtaagggcggagccaagcggcacaggaaggttctgagagacaacatccagggtatcaccaagccggcgattcgtcgtctggctcgccgtggcggcgtcaagcgcatcagcggcctcatctacgaggagactcgcggcgttctcaagatcttccttgagaacgtcatccgtgatgccgtcacctacaccgaacatgctcgccggaagacggtgactgcaatggacgtcgtttatgcccttaagaggcaaggccgcacgctttacgggtttggaggttaggggatttgtacccctaggttttgggggttgtgtttttttgtatagagtggggacggtgatttggatgggaaaaaattgtttttgggagttaatggtatgtcggattatgtgagattggatgtttggtttacggattttttctgctttgttgattttgatgatatgcatttgattttaagaaaatcacagttggaatatttgaagattctgctacagcaatgtttacattcgtttgattgaagaactattttctgacaaaatgaagaaataagttgtcattgatgaatttagttcaatcattattcttagtctttaaattaactcaaccgcttcaatgtcattgatggctgccacctaagtcgaattcgtttagcgcatgtagaggggcgtcctcccca

SEQ ID NO: 2052 - DNA, 468 bp, Orobanche aegyptiaca
ctaaatcgataaattagcgtataattaaaatgtcgggaagaggcaagggcggcaagggattgggcaagggcggcgcaaagcgtcatcgcaaggtgttgagagataacattcagggcatcacgaagccggctatccgtcgtctggcccgccgtggtggagtgaagcgtatcagcggtctcatctacgaggagacacgtggcgtcctcaagatattcctcgagaatgtcatccgtgatgccgtcacctacactgagcacgctcgccggaagactgtgacggcgatggatgttgtttacgctcttaagaggcagggaaggacactttatggctttggtggctaaagttagggtttcattagatgtagatttaggggtgtcttatattatgattaaacaatggtgtactgtaccttagatccgtgtatgtttatttcgttatcttatggaatggaatttctgtgattttact

SEQ ID NO: 2053 - DNA, 629 bp, Orobanche aegyptiaca
tttcagcttcatctcattccaattaatcgattaattagggctcaatcaaaatgtcgggaagaggcaagggcggcaagggattgggcaagggaggcgcaaagcgtcatcgtaaggtgttgagagacaacattcagggcatcacgaagccggctatccgtcgtttggcccgccgtggtggagtgaaacgtatcagcggtctcatctacgaggagacacgtggcgtcctcaagatattcctagagaatgtcatccgtgatgctgtcacctacactgagcacgctcgccggaagactgtgacggcgatggatgttgtttatgcccttaagaggcagggaaggacactttatggctttggtggctaaagttagggtttttattagatgttgatttaggggtttcttatattatgattaaacaacggtgtactgtatcttagatccgtgtatgtttgtttcgttatcttatatggaacggaatttctgtgattttactcctaaagtggtgttttattttttttttcttttacataattggttattgtcgattatgcttttggttcaattatagctgaattctgtaatttgctttgcagtttcttattcttattgttgtgattatttgagtgcaag

SEQ ID NO: 2054 - DNA, 483 bp, Orobanche aegyptiaca
atctctttctaaaagcagaagaaaagaaaacagaaaaatgtctggaagaggaaagggcggtaagggtttgggaaagggcggagccaagcggcacaggaaggttctgagagacaacatccagggcatcaccaagccggcgatccgccgtctggcccgccgtggcggcgtcaagcgcatcagcggtctcatctacgaggagactcgcggcgtcttgaagatcttcttggagaacgtcatacgtgacgctgttacctacaccgagcatgctcgccggaagacggttactgcgatggacgtcgtttatgctttgaagaggcaggggcgtactctgtacggttttggaggttaatggatttgtgggttttgtatagattttgggggctgcgatttggaagtgaagtattttttgtttggagtgttttgatatttggggttatgtaagattttgatgtttgtgtttctgattaatatcttttgcttgcc

SEQ ID NO: 2055 - DNA, 681 bp, Orobanche aegyptiaca
ctcatttctttcatgatcgaagccctttcttcagcttcatctccttcgaattaaatcggaaaattagggtttatcaaaaatgtcgggaaggggcaagggcggcaagggattgggtaagggcggcgcaaagcgccatcgcaaggtgttgagagataacattcagggcatcacgaagccggctatccggcgtctggcccgccgtggtggcgtgaagcgtatcagcggtctcatctacgaggagacacgtggcgtcctgaagatattcctagagaatgtcatccgtgatgccgtcacctacactgagcacgctcgccggaagactgtgacggccatggatgttgtttacgcgcttaagaggcagggaaggacactttatggctttggtggctagtttcgtaacgttagggtttggttagatgtagatttaagggcttcttatatcatatatgctggaacaatggtactgtgatcaatctatgtttgttcttgttttctttgatgatgttatgggttcaactggagcttaattcttaagtttgcttgtattctacttaaacgtgatatatttttacataaatacctcgatgcttatgcaaatattttttgagttgtaagtttagggcacttttatgtttaggataaatcctgaacattccttattaattattaaatttaatctcc

SEQ ID NO: 2056 - DNA, 463 bp, Orobanche aegyptiaca
aaatcgataaatcagggcttaattaaaatgtcgggaagaggcaagggcggcaagggattgggcaagggcggtgcaaagcgccatcgcaaggtgttgagagacaacattcagggcatcacgaagccggctatccggcgtctggcccgccgcggcggcgtgaagcgtatcagcgggctcatctatgaagagacacgtggcgtcctcaagatattcctcgagaatgtcatccgtgatgccgtcacctacactgagcacgctcgccggaagactgtgacggcgatggatgttgtgtacgctcttaagaggcagggaaggacactttatggatttggtggctaatttcgtaaagttagggttttattagatatagatttagggttctcttatattatgtttgaacaactgtactgtgatcagtctattttagatccttgtatgttatggaatggaatttcaatgtatg

SEQ ID NO: 2057 - DNA, 525 bp, Orobanche aegyptiaca
tcctgttttcacttttgtgtttctaatcgctatccgcagtaaaaatgtcgggccgtggaaagggaggaaagggattgggcaagggcggagcaaaacggcaccgtaaggtcctccgggacaatattcagggtataacgaagccggctatcaggcgtctggcgaggagaggcggagtgaagagaatcagtgggttgatctatgaggagacgaggggagttctgaagatattccttgagaacgtcatcagggacgccgtcacatacactgagcacgccaggaggaagacggtcactgccatggatgttgtctatgctttgaagaggcagggccgtacactttatggtttcggcggttgacttttatttttcttctcttcttttcttttttcctaatgttctctttttcctaagaacaaaagatgaattgggaaattgtggtcaagtttgtggatctaggctttattattcggcaattgaatgatttttagaagtaaaattatttagttatatgatttatcttttcatc

SEQ ID NO: 2058 - DNA, 512 bp, Pisum sativum
agctatgtcaggaagaggcaagggaggaaaaggtctcggaaagggaaaagcactagaatcagtttcattagagagaaaaaacctcaagaaatcacacagctatgtcaggaagaggcaagggaggaaaaggtctcggaaagggaggagctaaacggcaccgtaaggttctcagagacaacattcagggaataacaaagcctgcaattcgtcgtctcgcaagacgtggtggcgtgaaacgtatcagcggtctaatttatgaagaaacccgcggtgttctcaagatctttctcgagaatgtgattcgcgatgctgttacctacaccgagcatgctcgccgtaagactgttactgcgatggatgttgtttacgctctcaagaggcagggtaggactctttacggattcggcggttagaaaactcggaattgctgtttaatttagggtttcttgtaatttgaatctcaatgtttaggtataatgtgtaatagcaccccgagctttggcattaacatt

SEQ ID NO: 2059 - DNA, 530 bp, Pisum sativum
tccaacgcaaagagtgagaaaaagctcaagaaatcacagccatgtcaggaagaggcaaaggaggaaagggtcttggaaagggaggagccaaacgacaccgtaaggttctcagagataacattcagggaataacaaagcctgctattcgtcgtctcgcaagacgcggtggcgtgaaacgaatcagcggtctaatttatgaagaaactcgcggtgttctcaagatctttcttgagaacgtgattcgcgatgctgtgacctacaccgagcatgctcgccgtaagacagttactgcgatggatgttgtttacgctctcaagagacagggaaggactctctacggattcggcggttagaaaattggggatgactttatcaattagggtttcttgtagttcgaacatcaatgtcgataaatattgtgtaattgtactcgatgtttagcatcaatgtttgttttcgcataatgtattaattgacgatttgaaatttcaatctttgattgatccattgctatgttgtgagtagttgtt

SEQ ID NO: 2060 - DNA, 549 bp, Pisum sativum
aacccaaatccaaatctaaatcccaatctctcaatttccttccgttcttcaagttttctcgcgaaaatgtcgggccgtggaaagggtggtaagggactaggaaaggggggtgcaaagaggcataggaaggttcttcgcgataacatccaaggtatcacaaaaccagctattcgccgattggcaagaagaggtggtgttaagagaatcagcggtttgatctatgaagaaaccagaggagttctcaagatcttcttggaaaacgtgattcgcgatgctgttacgtatactgagcatgcgaggaggaagactgttaccgccatggatgttgtttatgctctcaagagacagggaagaaccttgtacggattcggtggttgaagaagaagctttcatttgttaattttatcagttttagcgatgtaattggtctgtgattgtaattctggttgcttgatgatgtttaggttaattgagaaatgaaatgttcatgaaatcttagcacacttaattttcatggattggagttgaaatctaatgaaaactagtact

SEQ ID NO: 2061 - DNA, 494 bp, Pisum sativum
gacagaacgcaatcacatcgctttttgctgcttaagtttcaaagtacgaacgaagcatcaagatcttgcaagaaatcaagcatgtcaggaagaggtaaaggaggaaagggtcttggaaagggtggagccaagcgtcatcgcaaagttcttagagataacattcaaggaattacgaaacccgctattcgtcgtcttgctagacgtggtggtgtgaagcgtataagtggattgatctatgaagaaactcgtggtgttctcaagatctttctcgagaacgttattcgtgatgctgtgacttacactgaacacgctcgccgcaaaacagttactgctatggatgttgtttatgcgctcaagagacagggcaggaccctttacggttttgggggttaggtttaaatgttagctattagtaatagtttgttgaatcaacatcagcttgttgatttaatctcagcttgttcaatttaaattttaatgaatattttcttact

SEQ ID NO: 2062 - DNA, 653 bp, Pisum sativum
caatttcaccttcagcttaatcgcaaagaaagagagaaactcaagaaatttcagacatgtctggaagaggcaagggaggaaagggtcttggaaagggaggagccaaacgtcaccgtaaggttctcagagacaacattcagggaataacaaagcccgccattcgccgtctcgcaagacgtggtggcgtgaagcgtattagcggtttaatttatgaagaaactcgtggtgttctcaagatctttcttgagaacgtgattcgtgatgctgttacatataccgagcacgctcgccgtaagactgttacagcgatggacgttgtttacgcactcaagagacagggaaggactctttacggcttcggcggttagaatattacggattgctgtatcaattagggtttcttttagttcgaatctcaatgttgatatgtattgtgtaagatttctcgagcttaagcatcgacaagggtttttgcttttctctagttgataatcaatgttttgtattttcgatctttttcgattcttattctctgttgtgactttttgttaattgcgtggtaattaatttcaaatcgtaggtataattgaacaaatacattttgagattgagatttcgataaatcaagatcaatttatcaaaaaaaaaaaaaa

SEQ ID NO: 2063 - DNA, 469 bp, Pisum sativum
aaatcaaaccctaaatactcatttccgaattctccatcgaaaatgtcaggtcgtggtaagggaggtaagggacttggaaagggaggtgcaaagaggcacaggaaggtgttgcgagacaacatccaaggtatcaccaagccagctattcgtagattggcgagaagaggaggtgtgaagagaatcagcggtttgatctatgaagaaaccagaggtgtcttgaagatctttttggagaatgtgattcgtgatgctgttacatataccgaacacgctaggaggaagacggttacagctatggatgttgtttacgctctcaagaggcagggaagaaccttgtacggtttcggaggttgaagaagaagctatcttatgctttttcttattgattatgtgaattttcttaggtttacgatggtgattaggtttaatttgtaatctgtaaggctgaattaaactggtgtttatccag

SEQ ID NO: 2064 - DNA, 513 bp, Pisum sativum
aattcaaatccaaatctaaactctatctctcagtttccttcagtttctcaaattttctcgcgaaaatgtcaggccgtggaaagggtggtaagggactaggaaagggaggtgcaaagaggcataggaaggttctccgcgataacatccaaggcatcacaaaaccagctattcgcagattagcaagaagaggtggtgttaagagaatcagtggtttgatctatgaggaaaccagaggagtcctcaagatcttcttggaaaacgtgattcgcgatgctgttacttacactgagcatgcgaggaggaagactgttaccgccatggatgttgtctatgctctcaagaggcagggaagaactttatacggattcggtggttgatgaagaagctttcatttgataattttactatatttagacatgttattggagtctgcgattgtaatatgaaatcaaagcctactcaatttccgtgggttggaattgaaatctaatgaaaaccagtattttttttatt

SEQ ID NO: 2065 - DNA, 457 bp, Pisum sativum
ttcaatcttccttttcaaaatttcacagttgataattataagaagagaaaaatgtcaggtcgcggtaaaggtggaaagggtttgggaaagggaggagcaaagaggcacagaaaagtgcttcgtgataacatccagggaattaccaagcctgcaattcgccgtttggcgagaagaggtggtgtcaagagaatcagtggactcatctatgaagaaactcgtggtgttctcaagatctttctcgagaacgttattcgtgatgccgttacttacactgagcacgctaggaggaaaactgtcactgccatggatgttgtttatgctctgaagaggcagggaaggactctgtacggtttcggtggttgattttatgatccaatttagggtttcgttagtgttagttgggtgtagatgtattttatctatttaagctgaactgaggcaatttgttatgttcttc

SEQ ID NO: 2066 - DNA, 472 bp, Pisum sativum
acgcatacacgcattgaaaaaggaaaaaaatgtcaggccgtggtaaaggtggaaaaggtttgggaaagggaggagcaaaacggcaccgtaaagttctccgggataacattcaaggtattacaaagccggcgattcgccgtcttgctcgcagaggtggagtgaagcgtatcagtggtctgatctacgaagaaacacgtggtgttctcaagatctttttggagaatgtgattcgtgatgctgttacttacactgaacatgctaggagaaagactgttactgccatggatgttgtttatgctcttaagagacagggaagaactctctacggatttggaggttagggttagggtttcaatttgggtttttgttggttgtaattgatgaatcttctgggattgaaatgttacattggaaatgattttgatttcaacaactctgtaatggtcaatttaacaatggttaatattgaaaa

SEQ ID NO: 2067 - DNA, 650 bp, Pisum sativum
tctctgaaagtaggaatcagctaccaacaacatcaccatgtctggaagaggtaaaggtggaaagggtttgggaaagggtggtgcaaagcgtcaccgtaaggttctaagggataacattcagggaataacaaagcctgcgattcgccgtctcgcaaggcgtggtggtgtgaagcgtatcagtggattaatctatgaagaaactcgcggtgttttgaagatctttctagagaatgttatccgtgacgccgttacttacacggagcatgctcgccggaagactgttactgcaatggacgttgtttatgctctcaagagacagggaagaactctttacggatttggcggttagaaatttgggaaatacaatttcaattagggtttcttgtaattcaaatctcaacgttgatatgcactactgtgtaaaagtacccgagttttagcattaacattagtttttgcttttctcttatagttataaattgatgatttgaatttttaattttgttcaattcatttatcagctgttaattgcatgtgagtaaattgaacgaatcctgatatagttgaggacgaatgctggtgcggggaaagttgaattatataaatggagttgagatggttttatttgtctcacactcatctactctgtc

SEQ ID NO: 2068 - DNA, 692 bp, Physcomitrella patens
attgtgtcgttgcgatttagctttgtaactttgtgcggtagagagcttcagtcgacatataggagtttgcctttggttagtagaggtttcttgccaccatgtctggtcgcggcaagggtgggaagggactgggcaagggcggcgccaagcgccatcgtaaggtattgcgcgataacattcaggggatcactaagcctgccatcaggcgcttagcaagaagaggaggcgtgaagcgcatcagtggtctgatctatgaagagactcggggcgtgcttaagatctttcttgagaacgtgattagagatgctgtaacatataccgagcatgctcggcgcaagaccgtgacggctatggatgtggtttatgccctgaagcgtcagggcagaactctctatggttttggaggctaggtcgacgtgccagaccttcgcatcgcacgtaaaaatggtgttattgaacaccaccttctgacgaaccttatcaagtcttatcagttttagctttctactttcattggatgtttgtttacttatttgtttgtttgtttgttttttctttctaattttagcgagtgttgtgtttcgtgatgcttgggatgtttgtaacagcgttaaccgatttgacagtggcgtcttttatttccaagcgttaagtcccaagcctataatttcatttttgcggttttgaaccgt

SEQ ID NO: 2069 - DNA, 1569 bp, Physcomitrella patens
gtctctgttctgtagggatttgttttccgaccgtcctcaccatgtctgggcgcgggaaaggaggcaagggacttggcaaaggtggcgccaagcgtcacaggaaggttctgcgtgacaatatccaagggatcaccaagcctgctatccgacgcctcgctcgccgtggtggagtgaagcgtatcagtggattaatttatgaggagactcgtggagtgttgaaaattttcttggagaatgttattagggatgctgttacctacacggagcacgctcgacggaagaccgtgacggcgatggacgtggtgtatgccttgaagagacaggggcgtaccttgtatggtttcggaggctgaccaacagtctgcacagtttcgtcggcctcttatctatggtgttcttttaacaccaccactattaaggattttacttctcttccattaatctgcaaaccaattttcatgtgatggtgtttggatttgtgttaggccagcctccagtgctgtctcgtaagggcccgatgtgttactaactatgtccggttggtggtttagatgcgctcttaacttgaccgacggtggatgtaattgacatactgactctgctttctatgcctgaccgaaggtgtcaccttatcagcccactgacttcgctgtcattccatttcgtgggatgaacataatgtcatgtgaaaggtctgatctcttcaggggtgtatgactaactcgcatctaatcgctatccggactaccgtcaccactctctgtgctcagaaactaggatgggattgtcgtgtaatattctacttcttcttcaatgatgacgaggtttcttacctgcctgcgcacgctttagggtacggaccaatagaagtcggtcaatcgcggcttcatgagtctccgcgacatggattaacccaagatgcaatgctggctaagctacgctcctgttcaggcttttggatttgttgtcgaaagcctgttcgttatgacatgccagtgggtatgttgtacgtggaaatatatgccaactttttgctgagcagaagagaagctatgtacgtgctccagcattccgtctgtaatctgcaggtggagaaagcatattaccgtcggtacaagatccccatccttaaattgttagattgtggcagactcgtcgtgtcccaatacctgcagtgcagcgttgcgtcgatcgaggtagggcccaattatctgtattggaagaagcccttatctgtttggaggttcacctcctctgcaaaccacgggttgtcgacagttttagtcagaaagtagattattccttcactttccaacgtatacgtctaagactgttgtatcagcaagcaaatatagtctaggtgctactttagtgagtttcagttggctaggcacattactacgtctctcaagtcttcgcaagtttttggtaattaacatgttatattcttacaagtagaaagaaagttaatttctaactactcaaagaatgacgatgtgtatttgtgcctgtcagatctcactctgtttcttgctttgatataatattaatcacacctgtctgtgtaag

SEQ ID NO: 2070 - DNA, 547 bp, Physcomitrella patens
gtcgggtctctagaacgtctttcggttaggggtttgtgcttttgtaatttctgcttgtgttcgccatgtcgggccgcgggaagggaggtaagggccttggcaaaggtggcgccaagcggcataggaaggtgctgcgtgataatatccagggaataacgaagcctgctattcggcgtctcgctcgtcgtggtggagtgaagcggatcagcggtttgatatacgaggagactcgaggcgtactgaagatcttcttggaaaacgttatcagggatgctgtgacgtacactgagcatgctcggcgcaagactgtgactgcgatggacgtcgtgtatgcgttgaagaggcagggacgcaccttgtacgggtttggaggttaattcaagtggaaaatatcggactaataatacttacggtgttcttgaacaccaccatttcgagcgaattttacatctccgaagtgtagacattttctgtgattatggtctttaagttgcacaaaacgaagtgcttctgttacaatcctctggttggcttaactgtaccctga

SEQ ID NO: 2071 - DNA, 585 bp, Physcomitrella patens
tgcgtgttacctttgtctgttctagtttcccaagaactccgtcttgtacgctcctgagggttttgctcttctgtgattgattcgccatgtctggccgcggcaagggtggtaaaggcctcggaaagggtggcgccaagcgtcaccggaaggtgctgcgtgataacattcagggtatcaccaagcccgctattcggcgtctggctcgtcgtggcggagtgaagcgtattagtgggctgatttatgaagagactcgtggcgtattgaagatctttctggagaatgtcatcagagatgcagtcacctacactgagcatgctaggcgcaagactgtgacggctatggatgttgtgtatgccttgaagaggcaggggcgaaccctttatggttttggcggctagagcgtaagctgagactgcgcttagcttttacggtgttcttaaacaccaccaatttgtgggattaagcttctgtatttgattgatatctttgcaggtcttagtcgctcctgttggtgattatgtttttggtgcacagccatgggattttctctgttggtgctctctctaattatccttcaatctcgtt

SEQ ID NO: 2072 - DNA, 314 bp, Physcomitrella patens
ccatgtcgggacgcggcaaaggaggaaaggggttgggcaaaggtggcgctaagcgtcacaggaaggttttgcgtgacaacatccagggtatcacgaagccggcgatcaggcgattggcccgaaggggcggtgtcaagcgtatcagtggtctgatatacgaggaaacccgtggcgtgctcaagatctttttggagaatgtcattagggatgctgttacttacactgagcacgcgaggcgcaagactgttactgctatggacgtagtgtacgccctgaagaggcagggaaggaccttgtacggtttcggaggctag

SEQ ID NO: 2073 - DNA, 315 bp, Physcomitrella patens
ccatgtcgggacgcggcaagggagggaaggggctcggcaagggtggcgcgaagcgtcatcgaaaggttctgcgtgataacattcaggggatcaccaagcccgccatccggcgcttggctaggagaggcggcgtgaagcgcatcagcggtttgatctacgaggagactcgcggtgtgctgaaaatctttttggagaacgtcattcgtgatgctgtgacctacactgagcacgccaggcgcaagactgtgaccgcaatggatgtcgtgtatgcgctgaagcgacaaggccggactctttacggcttcggaggctaac

SEQ ID NO: 2074 - DNA, 316 bp, Physcomitrella patens
ccatgtctggacgcggtaaaggaggtaagggcttggggaagggtggcgccaagcgtcataggaaggtgttgcgagacaacattcagggtatcactaaacccgccatccggcgcctggcgcgaagaggaggtgtgaagcgtatcagtgggcttatttacgaagagactcgtggtgtgctcaaaatatttttggagaacgtgatcagggatgctgtgacgtacaccgagcacgcgaggcgcaagactgtgacggccatggatgtggtctatgcattgaagcgacagggcaggactctgtacgggtttggaggctagat

SEQ ID NO: 2075 - DNA, 336 bp, Physcomitrella patens
ttcgacgatgtctgggcgtggcaaaggagggaaggggcttgggaagggtggcgcgaagcgtcatcggaaagtgttgcgtgataacatccagggtatcacgaagcctgcgatccggcgtctggctcgtcgtggaggagtgaagcgtatcagtgggctgatttacgaggagactcgcggcgtgctgaagatatttttggagaatgtgatcagggacgcggtgacgtacacggagcacgctcggcggaagacggtgacggcgatggatgtggtgtatgcgttgaagaggcaggggcggacgctttacgggttcggagggtagagcggaagggcgggccg

SEQ ID NO: 2076 - DNA, 319 bp, Physcomitrella patens
ccatgtcggggcgtggtaagggcggaaagggcctaggcaaggggggtgccaagcgccatcgcaaggtcctacgagataacatccaggggatcaccaagcccgccattcgtcgtctcgctcgtcgaggtggagtgaagcgtatcagtggtttgatttatgaggagactcgtggtgtcctgaaaattttcctggagaacgtaattcgtgacgctgtgacttacactgagcacgccagacgtaagactgtcacggccatggatgtggtgtacgccctcaaacggcagggaaggaccctatacggttttggaggctgattttc

SEQ ID NO: 2077 - DNA, 326 bp, Physcomitrella patens
ccatgtctggacgaggtaagggaggcaaggggcttggtaagggtggcgccaagcgccatagaaaggtgttgcgcgacaacatccagggcatcaccaagcctgccatcaggcgattggcgaggagaggtggcgtgaagcgcatcagtgggctcatatatgaagaaactcgcggtgtgcttaagatctttctggagaatgtcattagggacgctgttacttacaccgagcacgccaggcggaagaccgttacggccatggatgtagtgtacgctctgaagcgccagggccgtactctttacggttttggaggctgagatgaatgctgc

SEQ ID NO: 2078 - DNA, 524 bp, Cajanus cajan
gcggggatcacatttaaaaccaaagccccaaatcctcaatttaggtttcaaagcaaattaacctcagaagatgtctggtcgtggaaagggtggaaagggtctgggcaagggaggtgccaagaggcacaggaaggtgcttcgcgacaacattcagggcatcaccaaacctgcgattcgtaggttggcgagaagaggtggtgttaagagaatcagtggtttgatctacgaagagaccagaggagttctcaagattttcttggagaacgtgattcgcgatgctgtcacctacaccgagcacgctaggaggaagactgttactgccatggacgttgtttatgcgctcaagagacagggaaggaccctctatggattcggaggctaaacaatttgttcttttcaatggctttgattctgtaatgtaggatgtttctctagttttacattggataatagttgtataactacgattggaattatatcctgtaatgtttcttcattaaagattatagttcaacgttaaaacc

SEQ ID NO: 2079 - DNA, 582 bp, Pinus taeda
gcgattggcaattgagatttgatctcgaggtcttttggttgtggagatttgaagggggaaagatgtctggacgtggaaagggaggcaagggtttgggaaaaggaggtgcaaagaggcacaggaaggtactgcgtgataacattcagggaattacaaagcccgccattaggcgtcttgccaggagaggcggtgtcaagcgtatcagcggccttatatatgaagaaacgaggggtgtgctgaagatctttcttgagaatgtcatcagggatgctgtcacttacacagaacacgcgaggagaaagaccgtaactgctatggatgttgtgtacgccttgaaaaggcagggccgaaccctatacggctttggaggttaaagaacggggctctgtattttgttcatttaatgaattgctgatggcgttttgaaacgccataacttgctttctctgggaatttgtaaacttgttagtgccgaagtaacgctgaatcgctgaattgctgctttgagcatgtaaattgtttctgtatgtgagggtttcaattcaaatccaaatttgtatgaaaaaactgttttcgtatcaa

SEQ ID NO: 2080 - DNA, 643 bp, Pinus taeda
gtgaataagtttgtggcagcgtgtagggttcgaattgcagcgaccgagtttcatttgaaagccccggtcgcgaagaaacaataacaatgtctggccgcggcaagggtggtaagggtttgggaaagggaggagcgaagaggcacaggaaggtactgagggataacatccagggcattaccaaacctgccatcagacgtcttgccaggagaggaggcgttaagcgcattagcggactcatctacgaagagaccaggggagtattgaaaatctttctggagaatgtcatcagagacgccgtcacttacactgagcacgccaggcgcaagactgtcactgccatggatgtcgtctatgcgctcaagaggcagggcagaaccctctatggcttcggcggttaatgttcaactcaactgtcttcacttgttgcatctttagggttcttggttgtgtttaatttctggttaaattttggggagagatgtctgtgttccatctcaaaacctgtgctataatgttgtattatatgttgtttgtactggattaattcaatggatggtgcgtgcttatctgtatctgtgtacttgctctgattcgcagagtacccaatttctcaacggaacaagaattggatttgataatatgt

SEQ ID NO: 2081 - DNA, 516 bp, Populus trichocarpa
aatcaaaaaacaaaactcaaaatctcgtaaaaaaatgtcagggagaggaaagggaggcaagggattgggaaagggaggggccaagaggcatcgtaaggttcttcgtgataacatccagggtatcaccaagcctgcgatccgtcgtctagcaaggcgtggtggtgtcaagcgtatcagtggtcttatctacgaggagaccagaggcgtgctcaagatcttcctggagaatgtgattcgtgacgctgtaacctacacagagcacgcacgccgcaagacagtgactgctatggatgtcgtgtatgctttgaagaggcaaggccgtactctttatggttttggtggttaaaggaatttggggattttctgggctagtggtcgttttagggtgttttgtttgttcttgttaggtacgtgggttgataggctttaggtagacgtctaattcttgtattttcaaagctgcaagtgtctctctcttgatgcttgatctaaatgaaatgctccttttccttttta

SEQ ID NO: 2082 - DNA, 564 bp, Populus trichocarpa
tgaagagctctgcctcgtataaatacccggccaaacctctctatgcaaattagcattcaagcacataaaaaaagagaagaagctctcccctgtttgattttccgagaaaacaggaaagtttgcgaagatgtcgggaagaggaaagggcggaaaggggctgggaaagggaggtgcaaagaggcacaggaaggtgttgagagataacatccaaggaatcacaaagccagcaattagaaggctagcaagaagaggaggtgtgaagagaattagtgggctgatttacgaggaaactagaggggttttgaagatcttccttgagaatgtgattcgtgatgctgttacttatacagagcatgctaggagaaagactgtcactgccatggatgttgtctatgctcttaagaggcaaggtcgtactttgtatgggtttgggggttaggatttatcgggtcttctatgttgcttgtattattttccttccttgggaatttagatcttctatgggctggaattgaaaaactggatctgtaattgaaacaatttgttaatcatgattcaattctt

SEQ ID NO: 2083 - DNA, 486 bp, Populus trichocarpa
aaaataaaaaaagaaaagaaaaaatcaaaccgagggaattctttgagagaaaatgtcagggagaggaaagggagggaagggattgggaaagggaggagccaagaggcatcgcaaggttcttcgtgataacattcagggcatcaccaagcctgccatacgtcgtctggctaggcgtggtggagtcaagcgtatcagtggtcttatctacgaggagaccagaggcgttctcaagatcttcctggagaatgtgattcgtgatgccgtgacatacactgaacacgctcgccgcaagacagtgactgctatggatgttgtgtatgctttgaagaggcagggccgcacactatacgggttcggtggttaaagggatatttgttttgttggtagtgtagagtgggttagggttatcttgtttcaaaatctattcagtttaaagttggagatgaaattcagtgtttagagtaaatgaatattttacaagtttgc

SEQ ID NO: 2084 - DNA, 544 bp, Rhizophora mangle
acatcagaaattagatattagaaattaattcattttgcgagacattcaacagtgaattttcagaagtcttgtaccggtttcggcgacttccccaagaagaagatgtccggccgcggtaaaggaggcaagggcctgggaaagggaggagccaagaggcacaggaaggtgttgcgagataacatccagggaattaccaagccggcgattcggcgcttggctcgcaggggcggcgtgaagagaatcagtggactcatctacgaggagacccgcggtgtcctcaagatcttcctcgagaatgtcatccgtgatgcagtcacctacacagagcacgcccgccgtaagactgtcactgcaatggacgttgtctacgctctcaagaggcagggcaggactttgtacgggtttggcggttaaggaggcgtctgtggctgggcaattgggtgttttccaaggtttcttgtttcagaccttattattgtttgttgtcaactgtagacttcttgtggccattaaaatagacaggactacttgttgccgttgcaat

SEQ ID NO: 2085 - DNA, 412 bp, Rosa hybrid cultivar
tttccggtgaaaatgtcaggccgcggcaagggaggcaaggggttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgtcacctacacggagcatgcccggaggaagaccgtcaccgccatggatgtcgtctatgctctcaagaggcaaggaaggaccctttacggtttcggaggttgatatggggattctactattatatattgggtatttagtttagaagtgattctagtagtttattgttgttagatttgggtttttttttttt

SEQ ID NO: 2086 - DNA, 530 bp, Salvia sclarea
ctacagaccttggctgtcactcagaaaaaactcatttcgcatcttcatcaccaacaaaatgtctgggcgcggcaaaggaggcaagggtttgggaaagggcggagcgaagcgtcaccgtaaggtgctgagggataacattcaggggatcacgaagccggccatccgccgtctcgctcgccgtggcggcgtcaagcgtatcagcggtctcatatacgaggagactcgcggcgtgctcaagatctttctggagaatgtcatccgcgacgccgtcacctatactgagcacgctcgccggaaaactgtcaccgccatggatgttgtgtatgctctcaagaggcagggccgtactctctacggtttcggcggctgatgtgttatggttgtttgtaaatggtctattttgctagaatttagggatttttagtcttttgttatttgttaggttgtagtttgatgtttactatgtcctactatgatctgtctcagatctttatccttcgttgaattcgcagtgagtgacaggctagtag

SEQ ID NO: 2087 - DNA, 483 bp, Solanum phureja
ctttcaatcttccaaattcaatttcaaaaccctgaaaaatgtcgggccgtggtaagggaggtaagggattaggcaaaggaggagctaagaggcacaggaaggtgttaagagataacattcagggtattaccaagccagctattcgtaggcttgctcgtagaggtggtgtgaagcgtatttctggattgatttatgaggaaactcgtggagttctgaagatctttcttgaaaatgtgattcgtgatgctgttacatacactgagcatgctaggagaaagactgtgacggctatggatgttgtttatgctcttaagaggcagggaaggaccctttacggatttggaggttagggtgttggttagtggttgtagatttggttttttagtgaagttgggttacgtttttttgtttgtttgtatgatctcgatattgtaattccttgttacacaaacaattaatggaaggggatcgtatttcgagtaa

SEQ ID NO: 2088 - DNA, 701 bp, Saccharum officinarum
ctcctcggccaataggagcggagccatccccatccaacggctggcaccatccctcgcgcccctcacgcggatggcgcccccatccgacgcctcccagctcatctcccgcctctatattattccccatctccacccgttcgtccccactccccatccatctaattcacaagctcagtcactccaccaccactccaccagcaagcgaaaaatccccaatcccttcttctccgcttgccaggatgtcgggtcgcggcaagggcggcaagggcctgggcaagggcggcgcgaagcgtcaccggaaggttctccgcgacaacatccaggggatcaccaagccggcgatccggaggctggcgcggaggggcggcgtgaagcgcatctccgggctcatctacgaggagacccgcggcgtgctcaagatcttcctcgagaacgtcatccgtgacgctgtcacctacaccgagcacgcgcgccgtaagaccgtcaccgccatggacgtcgtctacgcgctcaagcgccagggccgcaccctctacggtttcggcggctaggctgcgtctctctgtcgcggttctagtgttgctgcaattcgcacgttgtgcctaggtggggaatatggtagctactgtagcactggagcaagcatgttgcatgttgtctgtttcatattgaatcttatcctcaagaaatgccaatgatga

SEQ ID NO: 2089 - DNA, 564 bp, Saccharum officinarum
cggacgcgtgggaaaatccccaaatcttcctcgccccaaatccactcaaacctccgctcctccagcggcctcctgcccgttcgtctcgaagcagcaggcagccatgtcgggccgcggcaagggaggcaagggcctgggcaagggcggcgccaagcgccaccggaaggtgctccgcgataacatccagggcatcacgaagccagcgatccggaggctggcgaggaggggcggcgtgaagcgcatctccgggctgatctacgaggagactcgcggcgtgctcaagatcttcctcgagaacgtcatccgcgacgccgtcacctacacggagcacgcccgccgcaagaccgtcaccgccatggatgtcgtctacgcgctcaagcgccagggccgcaccctctacggtttcggcggctgagccttggctccgtccgcgtcctctggccatgtggttgtggtcaggtgctagctagggttgttgatggattaggggagtttgttactttgtgttgggtttgcactgtgcttagtgtttatgtttgtaacggagattggaaccttatcaat

SEQ ID NO: 2090 - DNA, 469 bp, Tragopogon dubius
aactaaatacatctcttgtggatctacagagcgagcgagagaaaatgtcaggaagaggaaagggcggaaaggggctgggaaagggaggagccaagcgccatcgtaaagttctccgtgacaacatccagggaatcacgaaaccggcgatccggcgtctggcgagacgtggtggtgttaagcgtatcagcggtctcatctacgaggagacacgaggcgtcctcaagatctttctagaaaacgttatacgtgatgcagtaacttacaccgagcatgctcgccggaaaaccgtgactgctatggacgttgtctacgcattgaagcgacagggccgtactctctacggttttggaggttaagagagatctagggtttgtagaattagctcaccgtgtttggaggcgttgtttcacagatctgttttaattgttcatatatgtgtaatcgaagctcttaattcaataccagcttg

SEQ ID NO: 2091 - DNA, 516 bp, Tragopogon dubius
tcgggtatgacaaaatacaaaacatttcaaatccatttctagagaaagagaaaaagatgtctggaagaggcaaaggaggaaagggactaggaaagggaggagctaagcgtcaccggaaagttctccgggacaacatccaggggattaccaaaccggcgattcgtcgtctggcccgacgaggcggcgttaagcgtatcagcggtcttatctacgaggagactcgtggtgttctcaagatctttttggaaaatgtcatccgtgacgctgttacttacaccgagcatgctcgccggaaaactgttaccgccatggatgtcgtctatgctttgaaacgccagggacgtactctatatggtttcggtggttagatctttgtttgtttaggtatcagaatcgttccgaattagatctgtactgtttaggttttgatttgccttgttgatgaaaagttatatattatattcaaatcaatcgaagctttgacgaatttaggatttactattaacaaagatcttc

SEQ ID NO: 2092 - DNA, 577 bp, Triphysaria pusilla
gccaataatcaacaaaaatatctcatcacaagaacaagagtcttttctcatttccaattacagctaccgaaaaaattagggttaagtgaaatgtcgggaagaggtaagggcggcaagggattgggaaagggtggcgcaaagcgtcatcgcaaggtgttgagggacaacatccagggcatcacaaagccggctatccggcgattggctcgccgtggtggagtcaagcgtatcagcgggctgatctacgaggagacacgtggcgtcctcaagatattcctcgaaaatgtcatccgtgacgccgtcacctacactgagcacgctcgccggaagactgtgacggcgatggatgttgtctacgcgctcaagaggcagggccgtacgctttatggcttcggcggttaggttcatagtgttacggtttcattagattagctttagacttctgttattgtgtttgaatgatttttataccgatttatctttgatctatgtatgtgcttcttttgttatgtggaatgaaatttcagtgtttgtaagactcatatcttttagtttaacatcactctttcaacattta

SEQ ID NO: 2093 - DNA, 497 bp, Triphysaria pusilla
catctcaatcacagttcccaaatctcaaacatcaaaaggtgaaatatgtcaggccgtggcaaaggaggcaagggcttaggaaaggggggagcaaaacgtcatcgtaaggtgctgagagacaacatccagggtatcactaagcccgcaattcgtcgtttggcccgcagaggtggagtcaagcgtatcagcgggctcatctacgaggaaacccgtggtgtgttgaagatctttttggagaatgtcatccgtgatgctgtcacctacactgagcacgctcgccggaaaactgtcactgccatggacgttgtctatgctttgaagaggcagggccgcactctgtacgggttcggtggttaagcaatttagggttttatatgatttgtaaaaaatgttgctttatggttcaggaatattgatgaatttgcttagtagcttaaaatggaaattagggcttgatttttatctatcttggatttgtgttcttttcaattgaaatg

SEQ ID NO: 2094 - DNA, 540 bp, Triphysaria pusilla
aatcacagctaacaagtttcagaagaaaaaaaatgtcaggacgcggcaaaggcggcaagggtttgggaaagggcggcgccaagcgccatcgcaaagttctccgcgacaacatccaaggcatcaccaagccagccattcgccggttagctcgccgtggcggagttaaacgaatcagcggtttgatctacgaggagactcgcggcgtcctcaagatcttcctagagaacgtcatccgtgacgccgtcacctacactgagcacgctcgtcgtaagaccgtcacagccatggacgtcgtatatgctctcaagaggcagggccgtactctctacggtttcggcggctaggtcgtctctagggttagggcttttgttaaatcgaaatgtatgatgtttaattctttcaatgcagcttgttctgttctaatattctatcttgagttggttaatttgaaacaatcattttagattatgcattctgtctttcgatcatatctctagaaagtataaattatgaatttcttaatacagtgatttattgaat

SEQ ID NO: 2095 - DNA, 510 bp, Triphysaria pusilla
accactcacaaatcaacaatcagctcagttttcatttcttcagtctgataacacttctctgcgataaaatgtctggccgtggaaagggaggcaaggggcttggcaagggcggagcaaagcgacatcgcaaggtgctccgtgataacatccagggcataacgaagccggcgatccggcgtctggcaaggagaggtggagtgaagagaatcagtggtcttatatatgaggagacaaggggagttttgaagatattcctcgagaatgttatcagagatgcagtgacctacactgagcatgctaggaggaagacggtgactgccatggatgttgtctatgctttgaagaggcagggacgtactctttatggattcggtggttaatttttgtatttctaccctctttcttattttcattgttcttttttttttttttcctttccggccttgatttgaagttcagattgttggtgatttgtagatcgtggcttctgtcagtgtaattgaacgattt

SEQ ID NO: 2096 - DNA, 506 bp, Triphysaria pusilla
atcaaatctgaatctccaattttaccaactgaagaaaagagggaatataaaatgtctggaagaggcaagggaggtaagggattgggcaagggcggggcaaagcgtcaccgtaaggtcttgagagataacatccagggcatcaccaaaccggccattcgtcgtctagctcgtcgtggtggtgttaagcgcatcagcggcctcatttacgaggagacacgtggcgtcctcaagatcttcctcgagaatgtcatccgagacgccgtgacctacaccgagcacgcccgccggaaaaccgtgacggcgatggatgttgtctatgcgctcaagaggcagggccgtactctctacggctttggtggttaagttcctagggttaggttttattgaatgtaaatttaggagttttctgtttccgtcaagttcatggttgtgtaatttgtatcagattgtggtatgttttactctagttttttatgaatgaaatattaaattgtgatttaaatggc

SEQ ID NO: 2097 - DNA, 501 bp, Triphysaria pusilla
aaaatcatctctcaatcacagttcccaaatctcaaacagcaaaagctgaaaaatgtcaggccgcggcaaaggaggcaagggcttaggaaagggaggagcaaaacgtcatcgtaaggtgttgagggacaacatccagggcatcacaaagcccgcaattcgccgtttggcccgcagaggtggagtcaagcgtatcagcgggctcatttatgaggaaacccgtggtgtgttgaagatctttttggagaatgtcatccgtgacgccgtcacctacactgagcacgctcgccggaaaactgtcactgcgatggacgttgtctatgctttgaagaggcagggccgcactctatacgggttcggtggttaagaatttaggatttgggatttgtaaaaaatttgtgctttatgattctagaatattggtgaatttgcttagtagcttaaaatggaaattagggtttgtttttatctatcttagatcttgtgttcttttcaattgaaatg

SEQ ID NO: 2098 - DNA, 717 bp, Amborella trichopoda
  misc_feature (441)..(441): n is a, c, g, or t
tttttcgcgcgtttctctttcaattcctgtgtttgaaatatcagggagaccccaagatgtcaggtcgtggaaagggaggcaagggtttgggaaaaggaggagctaagcgtcacaggaaagttctacgtgataacattcaggggaatcacaaaaccggccattcgtaggttggctagaaggggtggagtgaagcgtatcagcggtctgatatatgaagaaacccgtggggttctgaagatttttctggaaaacgttatcagggatgctgtgacctacactgagcatgccaggcgtaagactgtgaccgccatggatgtggtgtatgctctgaagaggcaggggaggaccctgtacgggtttggtggttagcttgtttccctataataaagtcttgctgtcaagaagatgtaacagtgtgttttgtatggggaacttctggtnctctctttctctccccctcactccaggcctctgtagaaggctgcttgccctgtagtttttcggcgcattctaattttcactgacatttactgatatgaaagtgtaatgttcatttttattttcctcttggattttccgaatttggcatctgcaattatctatcattgattaagtcaaatctatctgtaagggcttcaattagggtagttatggattagttataattgttcctcgagtaattatatacctattgagcttgggaaatgtccttatttt

SEQ ID NO: 2099 - DNA, 629 bp, Amborella trichopoda
ttatagagagaaagggagaatgtcaggaagagggaagggtggcaagggtttgggaaagggaggagctaagaggcacaggaaggtgcttcgagataacattcaggggatcacaaagccagccattaggcgtttagcgagaaggggaggggttaagcgtatcagcggcctcatctatgaggagacgaggggtgttctgaaaattttcttggagaatgtcatcagagacgctgtgacatacactgagcacgccaggaggaagactgtgacagccatggatgtggtttatgctctcaagaggcaggggaggaccctctatgggtttggcggttagggttagggtttccgcttgggtatgaaaatgagagggccagtgcctctctctctgtcatgctatcttttctctctctctctcgctctctttccctatatttctttctctctctacatgtatctctctctctctctctatcaatctctgtagagtgaaggtggatggtgttttcttgtagagatttactcaggaacatgaattaggacatggcttctcttttccattatattttgaatgcagtctgtgccgctgttcttgtagaaattggcttctgaaattaaaattggaaattcctttc

SEQ ID NO: 2100 - DNA, 391 bp, Antirrhinum majus
aaaatgtcaggccgtggtaaaggaggcaaaggtttgggcaaaggcggagcaaaacgacaccgtaaggtcctccgcgacaacatccagggcatcacaaagccggcgattcgccgtttggctcgtcgtggtggagtgaagcgtattagcgggctcatctacgaggagacacgtggcgtgctcaagatcttcttggagaatgtgatccgtgacgccgttacctacacggagcacgctcgccggaaaactgtgacggcgatggatgttgtgtatgctctcaagaggcagggtcgtactttgtatggatttgggggttagggttagggtttctgagagataattacgacaggatttgtgatttctgcaatttgtgttagtttgagcagtgaaatga

SEQ ID NO: 2101 - DNA, 492 bp, Antirrhinum majus
acaaacttcactcatcaaaaatgtcaggaagaggaaagggaggcaagggtttgggcaaaggcggagcaaagcgtcaccgcaaagttcttagagacaacatccagggcatcactaagcccgcgattcgccgtcttgctcgtcgaggcggcgttaagcgtatcagcggcttgatctacgaggagactcgcggcgtgttgaagatcttcttggagaatgttattcgcgatgcagtgacttacacagagcacgctaggaggaagactgtgacggcgatggatgtcgtttacgcgctcaagaggcaggggcgtacgctttacggatttgggggatgaggaattagggttagggtttgtgtagatttgggtgtgttattgctgtttattaggagttttatgttgaatcgggtagaatttgtgtttctgtaattcaagattacttgaatgtataatggttttaattgcagtttaagtttatgaattgggtttatttcgt

SEQ ID NO: 2102 - DNA, 477 bp, Antirrhinum majus
  misc_feature (446)..(446): n is a, c, g, or t
ttcaatcaaaaaatgtcaggtcgtggtaagggcggcaagggtttgggcaaaggcggagcaaaacggcaccgtaaggtcctccgcgacaacatccaggggatcacaaagcccgcgattcgtcgattggcgaggagaggcggagtgaagaggatcagcgggttgatctacgaggagacacgtggcgtcctgaagatattcttggagaatgtgattagagacgctgtgacctacactgagcacgctaggaggaagactgttactgctatggacgttgtttatgctttgaagaggcaggggaggactctgtacggatttggaggatgattttgatttgattatcttttgtgttagtttgttttgattttattagctagtaggtgttttgtgaatctgggtttatgttgatgtggcgaatgtatgaatgaaattgttttaacttcagttcncaataggaaaattacttctgcgccaaaaaaa

SEQ ID NO: 2103 - DNA, 569 bp, Antirrhinum majus
  misc_feature (9)..(9): n is a, c, g, or t
  misc_feature (556)..(556): n is a, c, g, or t
cacaaattncaaatcttcttcaacaattcaaaatctcacagcatctacacaatgtcaggtcgtggtaaaggcggcaaaggtctaggcaaaggcggagcaaaacgacaccgtaaggttctccgcgacaacatccaggggatcacgaagcccgcaattcggcgtctggcccgaagaggaggtgtgaagcgtatcagcgggctgatctacgaggagacacgtggcgtgctgaagatctttttggagaacgtgattcgtgatgcggtgacgtacactgagcacgcgaggaggaagactgttacggctatggatgttgtttatgcgttgaagaggcagggtcgtactttgtacggattcggtggttagggtttgtaattgtgttttttatgagaaattaggtttaagtattgtagttaggtgtctgtttggggaattgatgttttttttaggtttatcagtttgttgctatgaaattgggcgtttgccttgtttttgattcggattgcaatattatatctaatttgcagctacctcagctgtagttctgttattttaagtncaaatgttttgat

SEQ ID NO: 2104 - DNA, 380 bp, Antirrhinum majus
tcaaaaatgtcaggccgtggtaaaggaggcaaaggattgggcaaaggcggagcaaaacgacaccgtaaggtgctcagagacaacatccagggcatcacaaagcctgcgattcgccgtttggctcgccgaggcggagtcaagcgtatcagtggactcatctacgaggagacacgtggcgtgctcaagatcttccttgagaacgtgatccgtgatgcggttacgtacacagagcacgctcgccggaaaactgtgacggcgatggacgttgtttatgcgctaaagaggcagggccgtactctgtacggttttggcggttgatttggtggaattagggtttgtgtttaggtgtttgtagatttagggattattatgtgttttta

SEQ ID NO: 2105 - DNA, 563 bp, Antirrhinum majus
caaaaccctaattcccaaatttaaaaaaaaaaaaaaaatgtcaggtcgcggcaaaggcggtaaaggtttgggcaaaggcggagcaaaacgacaccgtaaagtcctccgcgacaacatccaggggatcacgaagcccgcaattcgccgtttggcccgaagaggaggcgtcaagcgtatttcgggcttgatctacgaggagacacgtggcgttctcaagatcttcttggagaacgtgattagagacgctgtgacgtacacagagcacgctaggaggaagactgttactgctatggacgtggtttatgctctgaagagacaaggaaggaccttgtacggatttgggggttaggtttaagagctgaaaatttggggatttttgaatttgatttgttgttttgttagtgtttgttttagttaatgtgttgttatctgtaattaacttgctcgttttagtttcgttgtggaattgggttgtttttgatgttgatgaaactgaaagattgtcaatttaatggcacatttgtggaatgaagcttgggtgagattttggatcaaaaaaaaaa

SEQ ID NO: 2106 - DNA, 501 bp, Antirrhinum majus
  misc_feature (501)..(501): n is a, c, g, or t
catcactcatttcaatctcaaatcacttcaaattttcttctaatcaaaaaatgtcaggaagaggaaaaggcggtaaaggtctgggcaaaggcggagcaaaacgacaccgtaaggttctaagagacaacatccaagggatcacaaagcccgcaattcggcgtttggcccgaagaggaggtgtgaagcgtatcagcgggctgatctacgaggagacacgtggcgtgctcaagatctttttggagaatgtgattagagatgctgtgacttacaccgagcacgcgaggaggaagactgtgacggctatggatgttgtgtatgctctgaagaggcagggccgaacgctttacggatttggaggttgatttgatagagatttgggcgttttagatgtagatttagggtttatgcattttgtttctatgatcgttcgtagatcgttatatgtttgtttgtgcttcctttttgtgcaattgaaatggaaattagtgtgatgaaattgtn

SEQ ID NO: 2107 - DNA, 551 bp, Malus domestica
ctccactctctcaccaaaccctctaacaacggcaccgtaatcatcgaagatgtcaggacgcggaaagggaggcaagggcctgggcaagggcggagcgaaacggcaccgtaaggtcctccgcgacaacatccagggcatcaccaagccggcgattcggaggctggccagaagaggcggggtgaagagaatcagcgggctaatctacgaggagaccagaggcgtcctcaagatcttcttggagaacgtgatccgtgacgctgtgacgtacaccgagcacgcccgcaggaagacggtcaccgccatggacgtcgtctatgctctcaagaggcagggtaggaccctctacggattcgggggttaattttgtaaattcaatccttggggtttcgaatgggtcggagttttagattcgggttgtaatttgtcgcaaaagtttggaaattgaaaggatcctttgcttttttggatttagcaaagtagtactcggctgttgttggcttgtcgttttcaacagcgacctgaattaattttgttatttaaatcaaaaaaaa

SEQ ID NO: 2108 - DNA, 615 bp, Arabidopsis thaliana
aaacacaactttcattcattaaggcctcaaagcctcaagagaggaaagttgatacaagctacgataatacaacagaaagaaagatacaagttaatcccaccactttgtactcgaagtaacatactttttacaatcacatttttgaagaactttcattccataaatctacagatctttgtgtatcaagtaaagagatgtcaggaagaggaaagggaggaaaaggattgggaaagggaggagcgaagaggcacaggaaggttctgagggataacattcaaggaatcaccaagcctgctattcgtcgtcttgctcgtagaggtggtgtcaagcgtatcagtggtctcatctacgaagagaccagaggtgtcctcaagatcttcctcgagaatgttatccgtgacgccgttacctacactgagcacgccaggaggaagacggtgaccgccatggatgttgtctacgctttgaagaggcaaggtcgtactctctacggtttcggaggttaatccgatttgggggattagggtttatgcaagtttggggatttcttcttgtttctgagatccgtgttaaatggtttgaattagtcaaaagtaaattcaggagttagttttt

SEQ ID NO: 2109 - DNA, 610 bp, Arabidopsis thaliana
atatccgtcaaattcaattgatcctctctccaaatcatcttaaaatcacagatctttgggtatcaagtaaaactgtgaagtgatgtcgggaagaggaaagggaggaaaaggattgggaaagggaggagcgaagaggcacaggaaggttctgagggataacattcaaggaatcaccaagcctgccattcgtcgtcttgctcgtagaggtggtgtcaagcgtatcagtggtctcatctacgaagagaccagaggtgtcctcaagatcttcctcgagaatgtcatccgtgacgccgttacttacactgagcacgctagaaggaagacggtgaccgccatggatgttgtctacgctttgaagaggcaaggtcgtactctctacggtttcggaggttaatccgatttgggggattagggtttatgcaagtttggggatttcttcttgtttctgagatctgtgttaaatggtttgaattagtctaaagtaaatctaggagtgttagctactgcttttgttttctattgtgatgtcgttgttagccaatgcggtgtagttgaaaatctttgcaaacttaaagctaagaaaatctaatgaggatgaacaatttactcg

SEQ ID NO: 2110 - DNA, 490 bp, Arabidopsis thaliana
ctcaaatcatctcaatctcaattgaaatcttaaaatccaaaattttcccgagaaaaattaaagtttcctgagaaaatgtcaggtcgtgggaagggaggcaaaggattgggcaaaggaggagctaaacgtcacaggaaggttctgagagacaacatccaaggaatcactaagccggcgattcggagattggctcgtagaggtggagtcaagcgtattagtggtttgatctacgaggagacacgtggcgttctcaagatctttttggagaatgttatccgtgacgccgttacttacactgagcacgctcggaggaagacggtgactgctatggatgttgtttatgctcttaagagacaaggaagaactctctacggattcggcggctagggtttttgattgttgttttttgtgtttctacgtttattaggatgttaattttcagaatttggtgttaacttcgaaaaaattaaagaattgaaggttgttgttg

SEQ ID NO: 2111 - DNA, 518 bp, Arabidopsis thaliana
ctcaaatcatctcaatctcaattaaatcttcaaatcgaaaaatttccgaagaaaaattcaagttcccttagaaaatgtcaggtcgtggaaagggaggcaaaggtttgggcaaaggaggagccaaacgtcataggaaggttctgagagacaacatccaaggaatcactaaaccggcgattcggagattggctcgtagaggtggtgttaaacgtattagtggtttgatctacgaggagacacgtggcgttctcaagatctttttggaaaatgttatccgtgacgccgttacttacactgagcacgctcggaggaagacggtgactgctatggatgttgtttatgctcttaagagacaaggaagaactctctatggattcggtggttgaggattttagtgttttagagtgttgtctaggatttgctttagtgatttcattttggaatttcagatcgatttgtattcgcgtttgcgttgtaatgttgttccggataaatattcacggttgcgttttgatata

SEQ ID NO: 2112 - DNA, 558 bp, Arabidopsis thaliana
atcctatataacaaactcaattttcatttcaatcaatcaacacaatttggtaaaatcaaatagtctttttactattttctaaggttcgaatttaatttcccaagagaaaaatgtcaggccgaggaaagggaggaaaaggattaggaaagggaggagccaagaggcatcggaaagttctccgagacaacatccaagggattaccaaacctgcgattcgtcgtctcgcgagaagaggaggcgtgaagcgtatcagtggtttgatctatgaagagactcgcggcgttctcaagatctttctcgagaacgtgattcgtgacgccgttacttacacggagcacgctcgccggaaaactgttacggcgatggatgtcgtttacgctctcaagagacaaggacgaactttgtatggattcggcggctaaatccttatgatttcaacttcggattttgtaaactctttaatttcaagttctagggatttcagatttgtaatttctcagttaaacgatgaatgaattgaaaaaggaattatcttcgagtttaatttttaatcatata

SEQ ID NO: 2113 - DNA, 594 bp, Arabidopsis thaliana
aatttcacatctttctcacccaaatctactcttaaccgtacttcttcttctacagacatcaatttctctcgagataaactaaatcttcgctgaaaaaatgtcgggtcgtggaaagggaggaaaaggtttgggtaaaggaggagccaagcgtcacaggaaggttctgagagacaacatccaaggaatcaccaagcctgcgattcgaagattggctcgtagaggtggagtcaagcgtatcagtggtctcatctacgaggagactcgtggcgtcctcaagatctttctcgagaacgtgattcgtgatgctgtcacttacaccgagcacgctaggaggaagactgtgaccgccatggatgttgtctacgctctcaagaggcaaggaaggactctttacggattcggtggttaattagagtttttcagatccgcgtttgtgttttctgggtttctcacttaagcgtctgcgttttacttttgtattgggtttggcgtttagtagtttgcggtagcgttcttgttatgtgtaattacgctttttcttcttgcttcagcagtttcggttgaaatataaatcgaatcaagtttcactttatc

SEQ ID NO: 2114 - DNA, 953 bp, Arabidopsis thaliana
  misc_feature (1)..(4): n is a, c, g, or t
  misc_feature (7)..(9): n is a, c, g, or t
  misc_feature (402)..(402): n is a, c, g, or t
nnnnttnnntcaaccataacacattctcactacagattttcattaacctcaaaagttttgattccaagatcaatgttcttaatcctccctattttcccaaataaacacacaactaacctaatttcaagggagaacaaaactagcattctccttaatcacatgtatatctatcacatacaatgttaaccaaacgaagcaaataattttgtgaaagaaaacacaactttcccagagcgctcctttaacttgatgaatcttaccaattgcgtatcaacggctcagatgtcatcaggcataatgacgcggatagcaaacagatccaacggtccaaaatcattaaattataaacacgcggatagatgataacgaccgtcgataaactcagatccaacgacacacaanttcctaaagttttgtaaaaaacacaagcactcctcctcttctcgtcgtctcatcctatataacaaactcaattttcatttcaatcaatcaaaaccattcggcaaaatcaaataatctttttcttagttcgaatttaatttcccaagagaaaaatgtcaggccgaggaaagggaggaaaaggattaggaaagggaggagccaagagacatcggaaagtactcagagacaacatccaagggattaccaaacctgcgattcgtcgtctcgcgagaagaggaggcgtgaagcgtatcagtggtttgatctatgaagagactcgcggcgttctcaagatctttctcgagaacgtgattcgtgacgccgttacttacaccgagcacgctcgccggaaaactgttacggcgatggacgtcgtttacgctctcaagagacaaggacgaactttgtatggattcggcggctaaatcgttcggattgcaatttcggattttgtaaactctttaatttcaagttctagggatttcagatttgtaatttctcagttaaacgat

SEQ ID NO: 2115 - DNA, 506 bp, Artemisia annua
acgcagtactccgacggggacacacaaacacaccaaatccaattctaaaaaatgtcaggaagagggaaaggaggaaagggattaggcaaaggaggagcaaaacgacatcgtaaggtgcttcgcgacaacatccaggggatcactaagcctgctataaggaggttagcgagaagaggcggagtgaagaggataagcgggttgatttacgaggagacacgtggcgttctgaagatatttttggagaatgtgattagagatgcggtgacgtacactgagcatgcgaggaggaagacagtgactgctatggatgttgtttatgctttgaagaggcaaggaaggactctttatggttttgggggttagatgaattaggtggtgtttggttaggtggataatggattagatctggtttattattgtgttacgttttgttgtggctgtgtagtttaatttaagatgtgtttaatgaatgaatttgaaatcctgttccaaaaaaaaaaaaaaaa

SEQ ID NO: 2116 - DNA, 461 bp, Artemisia annua
gacaaacacaccaaatccaattctaaaaaatgtcaggaagagggaaaggaggcaaaggattaggcaaaggaggagcaaaacgacaccgtaaggtgctccgagacaacatccaggggatcactaagccagcgataaggaggttagcgagaagaggcggagtgaagaggataagcgggttgatttacgaggagacacgtggcgttctgaagatatttttggagaatgtgataagagatgcggtgacttacactgagcatgcgagaaggaagacagtgactgctatggatgttgtttatgctttgaagagacaaggaaggactctttatggtttcggtggttagatgaattaggtggtgtttggttaggtggattagatctggtttattattgtgtttggttttgttatggttgtgtagttgtattgaagatgtgtttaatgaatgaattttaaatcctgtttc

SEQ ID NO: 2117 - DNA, 776 bp, Artemisia annua
  misc_feature (214)..(214): n is a, c, g, or t
actagttctagtcgcgacggccgcccttttttttgttttttaattggataattagtgcttctttctttaaaccctcgtcacaaaatgctttaataagagcgcccatgacttctaaactccacttgagtcctctcatgttcaagatttcaaagaactcccacgcgtctttggcactattaccctttcttctcataatcgtgatcattatagagcntgttacatgatcaggttcaacattgcattgttccatcgtctcaaatatgctccaagcatcatcatacctcccacaatccgaaagagcagaaatggcggaattaaacacatgaacttgcttatactccacagaatcaggcaaactttcattcaaaatcaaccaaaacccaaaaaggaaatcaatcatgtcaggacgtgggaagggaggaaagggactaggcaaaggcggagcaaagcgtcacaggaaagtgttacgagacaacattcaaggaatcacgaaacccgcgataagacggttggcgagacgaggaggagtgaagaggataagcgggttgatttacgaagagacgagaggtgttttgaagatctttttggagaatgtgattcgtgacgctgttacgtacactgagcatgcgagaaggaagactgttactgctatggatgttgtttatgctttgaaaagacaaggcaggactttgtatggtttcgggggttagatagttctttagaatggtgttgttgttacgatgttctttgtacggttttatggatctattgtgtaa

SEQ ID NO: 2118 - DNA, 542 bp, Artemisia annua
agtactccgacggggaacacacacaaacaacaatccattaatccaaacaccaccaaattcaattacaaaaaaatgtcaggaagaggaaagggaggaaagggattaggcaaaggaggagcaaagcgtcacaggaaagtcctccgcgacaacatccaaggtatcaccaagcctgccatccgtcgtcttgctcgtcgtggaggtgtgaagcgtatcagcggtctgatttacgaggagacacgtggcgtcctcaagatctttttggagaatgtgatccgtgatgccgtcacctacactgagcacgctcgccgtaagactgtgactgccatggatgtggtttatgctttgaagaggcaaggaaggactctttacgggtttgggggttagaattggaattagggtttgttgttatggttaggatttggaagttgttatgtggttaagattgttatgttttagatctggttaggtgcttgtgtagatggggtttgttacatcttgtaattgaatctctgtttcggattaatatgaatttaagtatttcc

SEQ ID NO: 2119 - DNA, 573 bp, Artemisia annua
acgagtgcgtaacaggaacgcagtactccgacggggacacacacaaaaaacaatcaattaatccaaacacccccaaattcattcaaaatcaagaaatgtcaggaagaggaaagggaggaaagggattgggcaaaggaggagcaaagcgtcatcgcaaggttcttcgcgataacatccagggtatcaccaagcctgccatccgtcgtttggctcgtcgtggaggtgtgaagcgtatcagcggtctgatttacgaggagacacgtggcgtcctcaagatctttttggagaatgtgatccgtgatgccgtcacctacactgagcacgctcgccgtaagacagtgactgcaatggatgtggtgtacgcgttgaagaggcaaggaaggactctttacgggtttgggggttagagttgaaattagggtttgttgttatggttaggatgtggaagttgttatgtggttaagtttgttatgttttagatctggttaggtgcttgtgtagatggggtttgttacatcttgtaattgaatctctgttgcgaattaatttgaatttaagtactttctgtttaaa

SEQ ID NO: 2120 - DNA, 523 bp, Artemisia annua
tactccgacggggacacaaataacaatcacacaaaacccaaatccaaacacacccaattcaaaaaaaatgtcaggaagaggaaagggaggaaagggactaggcaaaggaggagcaaagcgtcacaggaaggttctccgtgacaacatccaaggtatcaccaagcccgccatccgtcgtttggctcgtagaggtggagtgaagcgtatcagtgggcttatctacgaagagacacgtggcgttctcaagatctttttggagaatgtgatccgtgatgctgttacctacactgagcacgctaggaggaagactgtgactgctatggatgttgtctatgctctcaagaggcaaggccgtaccctttacggtttcggcggttaaatttgttggatctagggtttctagggttagggtttcgaagttgggtcttattgtgttgtttagtgattaatgattaatatctgattaatcattttaatttgtatttcgtattttatgttttaatgaaatgaaatttgaattctg

SEQ ID NO: 2121 - DNA, 583 bp, Artemisia annua
atcaacgcagtactccgacggggacaatcaattctaacacacatagtttcagatctcgttactacacaaaaccatacgaaaatgtcaggaagaggaaagggaggaaaaggactaggcaaaggaggagcaaagcgtcacaggaaggttctccgtgacaacattcaaggtatcactaaacccgccatccgtcgtttggctcgtagaggtggagtcaagcgtatcagtgggcttatctatgaagagacacgtggcgttctcaagatctttttggagaatgtgatccgtgatgctgttacctacactgagcacgctaggaggaagactgtgactgctatggatgttgtctatgctctcaagaggcaaggaaggaccctttacggtttcggtggttaagttttttatcagtgtttgttaagtcttgctgtcaagaaagaaatgtgtttagggtttaagtctgtttggaatttggatggtttagttagcgttttgttggtattgaatgtagttagtgtttgtgtttagatgttttaatgatgaatcaagtaatgaagttgattttcatatcaatttgagtttgtttttg

SEQ ID NO: 2122 - DNA, 542 bp, Artemisia annua
acaatcaattctaacacacatagtttaagatctcgttactacacagaaccaagcaaaaatgtcaggaagaggaaagggaggaaaaggactaggcaaaggaggagcaaagcgtcacaggaaggttctccgtgacaacattcaaggtatcactaagcccgccatccgtcgtctggctcgtcgaggtggagtcaagcgtatcagtgggcttatctacgaagagacacgtggcgttctcaagatctttttggagaatgtgattcgtgatgctgttacctacactgagcatgctaggaggaagactgtgactgctatggatgttgtctatgctctcaagaggcaaggaaggaccctttacggtttcggtggttaagttttttatcagtgtttgttaagtcttgctgtcaagaaagaaatgtgtttagggtttaagtctgtttggaatttggatggtttagttagtgtttcgttggtaatgaatgtagttagtgtttgtggttagatgttttaatgatgaatcaagtaatgaagttgatttttgtatc

SEQ ID NO: 2123 - DNA, 549 bp, Artemisia annua
acgagtgcgtcagtggtatcaacgcagtactccgacggggacaaacaacaatcaattaatccaaacacccccaaattcaaaatcaaaaacaaaatgtcaggaagaggaaagggaggaaagggattaggcaaaggaggagcaaagcgtcacaggaaagtcctccgcgataacatccagggtatcaccaagcctgccatccgtcgtctggctcgtcgtggaggtgtgaagcgtataagcggtctgatttacgaagagacacgtggcgtgttgaagatctttttggagaatgtcatccgtgatgctgtcacctacaccgagcacgctcgccgtaagacagtgactgcaatggatgtggtttatgctttgaagagacaaggaaggaccctctacgggtttgggggttagatttgaaattagggtttgttgttatggttaggctgtggttgttgttttatgttttaagatttggttaggtgtttgtgtagatggggtttgttacatcttgtaattgaatctctgtttcggattaatatgaatttaagtactttc

SEQ ID NO: 2124 - DNA, 795 bp, Artemisia annua
aacttgcgtatgatactcctactagttatgcaacacaaaccattccacgtcaccgatccacaacctccttctaaaacagtcaatccatccattaaacccatcacacggatcaccaatcccaaccgtccattttcattttcatttttcactatcccgcttctttcaaattccaaatttttttaaaaaaccccaaaaagcgtgtttataaaaacccacatccacatttcaacaaaatatcaaaaacccaattaactttcattcaatcaattaaaatacttaaaaaatgtcaggacgtgggaagggaggaaaggggctcggcaaagggggagcgaagcgtcacaggaaagtgttaagagacaacattcaaggaatcacaaagccggctattcgtcgtttagctcgtagaggaggagtcaagaggatcagcgggttgatttacgaagagaccagaggtgttttgaagatctttttggagaatgtcatccgtgatgctgtcacctacaccgagcacgctcgccgtaagactgtcactgctatggatgttgtttatgctttgaaaagacaaggcaggactttgtatggtttcgggggttaggttgattagtattatgttgtcgttacgatgttctttgtacggttttatggatctattgtgtaattgaaagttcatcaatccaatgaatctgaatttagctcttttgtttattcattgttactgtattaaattgtgttaatgattattataaggattattactagtgtttataagttgtcattagttattcttcaaatgaa

SEQ ID NO: 2125 - DNA, 794 bp, Artemisia annua
  misc_feature (257)..(257): n is a, c, g, or t
  misc_feature (273)..(273): n is a, c, g, or t
aacttgcgtatgatactcctactagttatgcaacacaaaccattccacgtcaccgatccacaactccttctaaaacagtcaatccatccattaaacccatcacacggatcaccaatcccaaccgtccattttcattttcatttttcactatcccgcttctttcaaattccaaatttttttaaaaaaccccaaaaagcgtgtttataaaaacccacatccacatttcaacaaaatatcaaaaacccaattaactttcnttcaatcaattaaaanacttaaaaaatgtcaggacgtgggaagggaggaaagggactcggcaaagggggagcgaagcgtcacaggaaagtgttaagagacaacattcaaggaatcacaaagccggctatccgtcgtttagctcgtagaggtggagtcaagaggatcagcggcttgatttacgaagagacgagaggtgttttgaagatctttttggagaatgtcatccgtgatgctgtcacctacaccgagcacgctcgccgtaagactgtcactgctatggatgttgtttatgctctcaagagacaaggcaggactttgtatggtttcgggggttaggttgattagtattatgttgtcgttacgatgttctttgtacggttttatggatctattgtgtaattgaaagttcatcaatcaaatgaatctgaatttagctattatctttattcattgttactgtattaaattgtgttaatgattattataaggattattactagtgtttataagttgtcattagttattcttcaaatgaa

SEQ ID NO: 2126 - DNA, 630 bp, Artemisia annua
tactccgacggggatcacaatcaattctcacacacatagtttcagatcccgtttccaaacagaacagtaaaaatgtcaggaagaggaaagggaggaaagggactaggcaaaggaggagcaaagcgtcacaggaaggttctccgtgacaacatccaaggtatcactaaacccgccatccgtcgtctggctcgtcgtggtggagtcaagcgtatcagtgggcttatctacgaagagacacgtggcgtgttgaagatctttttggagaatgtgattcgtgatgctgtgacctacactgagcatgctaggaggaagactgttactgctatggatgttgtctatgctctcaagaggcaaggaaggactttgtatgggtttggtggttaggtgtgtttgggattgggttttaagtcttgctgtcaagaaagaaatgtgtttagggttttattctgttgaaatttggatggtttagttagcgtttcgttggtagtgaatgtagttagtgtttgtggttagatgttttaatgatgaatcaagtaatgaagttgattttcgtatcaatttgagtttgtttttgccgaaaggcttccaaggcacgcttctgacacaaggtttctgccatgtcaatatact

SEQ ID NO: 2127 - DNA, 658 bp, Persea americana
gagaaagagagagagagagaagatgtcaggaagaggcaaaggagggaagggtcttggcaagggtggtgccaagcgccacaggaaagttctgagggataacatccagggcatcaccaagcctgccatcaggcgccttgcacgccgtggaggagtcaagcgcatcagcggtctcatctacgaagagacgaggggagtgctcaaaatcttcctagagaacgtcatccgtgatgctgtcacttacaccgagcatgcaagaaggaagactgtaactgcaatggatgttgtgtatgctctcaagaggcaaggcaggaccctctatgggttcggtggttaggtctcttccttgtagtgtttctgcaaatgtaatcgcctaatcacgaaatagtttgtacttggagcttcttctttccaatactcaatctaatggtgtggattgaatttctcaaaaaaaaaaaaaaaaacttcgaggcctcacaagtctcccttttcgccagagagagagagagagatggatggtcccccagcgaacgacgtctgctccgtctgtcacgataacttcaaccttccttgccaagcaaattgctctcattggttttgcgctcattgtattatgcgggtgtggcattttggctcagcacttcagccatgtaaatgtccc

SEQ ID NO: 2128 - DNA, 685 bp, Persea americana
  misc_feature (24)..(24): n is a, c, g, or t
tgggtaaacgcagcaaatacattntgagagagagagagagagagagaagatgtcaggaagaggcaaaggagggaagggtcttggcaagggtggtgccaagcgccacaggaaagttctgagggataacatccagggcattaccaagcctgccatcaggcgccttgcacgccgtggaggagtcaagcgcatcagcggtctcatctatgaagagacgaggggagtgctcaaaatcttcctagagaacgtcatccgtgatgctgtcacttacaccgagcatgcaagaaggaagactgtaactgcaatggatgttgtgtatgctctcaagaggcaaggcaggaccctctatgggttcggtggttaggtctcttccttgtattgtttctgcaaatgtaatcgcctaatcacgaaatagtttgtacttggagcttcttctttctaatactcaatctaatggtgtggattgaatttctcaaaaaaaaaaaaaaaaacttcgaggcctcacaagtctcccttttcgccagagagagagagagagatggatggtcccccagcgaacgacgtctgctccgtctgtcacgataacttcaaccttccttgccaagcaaattgctctcattggttttgcgctcattgtattatgcgggtgtggcattttggctcagcacttcagccatgtaaatgtccc

SEQ ID NO: 2129 - DNA, 529 bp, Brassica juncea
agtacgcggggatcgcactctccttcacacgtgtgaaaaaacaacttcctttttttctctgattttaaaaccttttcccgagaaaaagaaaatgtctgggcgtggtaagggaggaaagggacttggaaagggaggagccaagaggcacaggaaggttctccgcgacaacatccagggcatcaccaagccggcgattcgtcgtttagcgaggagaggcggcgtgaagcgtatcagcgggttgatctacgaggagactcgcggcgttctcaagatcttcctcgagaatgtgattcgcgacgctgtgacttacactgagcacgcgaggaggaagactgtgacggcgatggatgttgtgtacgcgttgaagaggcaggggaggactctgtatgggttcggcggctgaggggattggattagggtttttgtaaatctcgtctgggttgtttttagggtttgttaagagctttaagctgttgtgatggtttcgtttcgaatgtttcggtgatttgaatttaatgaaaacgctttt

SEQ ID NO: 2130 - DNA, 559 bp, Brassica juncea
caacgcagagtacgcggggatcgcagtctataacacctctctctctgatttaaaaacttttcgagcaaagaaagatgtctgggcgtggaaagggaggaaagggattgggaaagggaggagccaagaggcacaggaaggttctccgtgacaacatccaggggattacgaagccggcgattcgtcgtttggcgaggagaggcggtgtgaagcgtatcagcgggttgatttacgaggagactcgcggtgttctcaagatcttcctcgaaaacgtgattcgtgacgctgtgacttacaccgagcacgctcgtaggaagacggtgacggcgatggatgttgtttatgctttgaagaggcaaggtcgcactctctatggattcggtggttaaaattcggtttagatttggtctgggtggtgctgttgttactgattaataagtcttgctatcaagaaatctcgggtttacttcattcgtctttgttggttcctttcttggtttgtgattaggatttgggtaactgcagtactgtattgaacttttatcttttggtataatgaaag

SEQ ID NO: 2131 - DNA, 446 bp, Brassica juncea
atattattctctctcatcgaagcttttgaatattaacatttcccgagaaaaaaatgtcagggcgaggaaagggaggaaaaggattgggaaagggaggagccaagaggcatcggaaagttctccgagacaacatccaaggaatcaccaaaccagcgatccgtcgtctagcgagaagaggaggtgtgaagcgtatcagcggtttgatctacgaagagactcgcggcgttctcaagatctttctagagaacgtgattcgcgacgccgttacgtacacggagcacgctcgccggaaaacagtgacggccatggacgttgtctacgctctcaagaggcagggtcggactctgtacggattcggcggttgattcgattgtttcagtttcagatcttgtaaaatctttttcagaatcaatgggaaaataatcaatatgtatctttttccgaac

SEQ ID NO: 2132 - DNA, 407 bp, Brassica juncea
gaatcatcgtcaaatctcattttgatatcctctccgatccatcaattaacagatctttggaattttagtgaggagaaatgtcaggaagagggaagggaggaaagggattgggaaagggaggagccaagaggcacaggaaggtgcttagggataacatccaaggaatcaccaaacccgccattcgtcgtcttgctcgtagaggtggtgtcaagcgtattagcggtctgatctacgaggagacaagaggagtcctcaagatctttctcgagaatgtcatccgtgacgccgtcacttacacagagcacgctaggaggaagactgttactgctatggatgttgtctatgctttgaagaggcaaggacgtactctctacggcttcggcggttaatcaaggattgagatttta

SEQ ID NO: 2133 - DNA, 522 bp, Brassica juncea
ggtatcatctgaaccttaaacactcaatcatctaaatctcgagaaagttctaatgtcaggaagaggcaaaggaggcaaggggttgggcaaaggaggagcgaagaggcacaggaaggttctgagagacaacatccaaggaatcaccaagcctgcgatcaggcgtctcgctcgtagaggaggcgtgaagagaatcagcgggttgatctacgaagagaccagaggagttctgaagatctttctcgagaatgtgattagagacgccgtgacgtacacggagcacgcgaggaggaagacggttacggcgatggacgttgtttatgctttgaagaggcaagggcgtactctttatggattcggtggttaaaaccggtttaagatttcggtttggtttatgggtgctacttaattaagtcttgctgtcaagaaatctagtaggttttaggctttatcactcctttgctggtttgtttctttgtttgtgtaatttctcttttgggatttataaaagaatcaattactaac

SEQ ID NO: 2134 - DNA, 579 bp, Brassica juncea
gagacatcgcactctacttcacacgtgtgggaaacaactttctttttctgatttttaaaaactttttccgagaaaagaaaaatgtctggaagaggaaagggaggaaagggattgggaaagggaggagccaagaggcacaggaaggttctccgtgacaacatccaggggattacgaagccggcgattcgtcgtttagcgagaagaggtggtgtgaagcgtatcagcggtttgatctacgaggagactcgcggtgttcttaagatcttcctcgagaatgtgattcgtgacgctgttacttacactgagcacgctcgcaggaagactgtgacggcgatggatgttgtctacgcgttgaagaggcagggaaggactctctacgggttcggcggctgaggggattgattctgggattaatgtaaatcgcgtttgtttgtttttagggtttgttaagacctttaagctgctgttagggtttcgtttctaatgtttcggttatttgaattgaatgaaaatgctttatttatcacatcgttggttgctaacaatagattagctccatcaacttgtttagtggttaaa

SEQ ID NO: 2135 - DNA, 394 bp, Brassica juncea
gatcgcccatctcatttgcaattctctcaatcacataaaggaatcgaaacttgtgaggagatatgtcaggaagaggaaagggaggaaagggattgggaaagggaggagccaagaggcacaggaaggtgcttagggacaacatccaaggtatcaccaagcctgctattcgtcgtcttgctcgtagaggtggcgtcaagcgtattagcggtctcatctacgaagagaccagaggagtcctcaagatctttctcgagaatgtcatccgcgatgccgtcacctacaccgagcacgcccggaggaagactgttactgctatggatgttgtttatgctttgaagaggcaaggtcgcactctctacggcttcggaggttaaatcgacggagatgagtaaaa

SEQ ID NO: 2136 - DNA, 504 bp, Brassica juncea
  misc_feature (387)..(387): n is a, c, g, or t
  misc_feature (390)..(390): n is a, c, g, or t
  misc_feature (392)..(392): n is a, c, g, or t
  misc_feature (411)..(411): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (423)..(423): n is a, c, g, or t
  misc_feature (430)..(430): n is a, c, g, or t
gaaacatcgcagtctttaacctttctctctctttgaatttcaaaaactttccgagaaaagaaaatgtctgggcgtggaaagggaggaaagggattgggaaagggaggagccaagaggcacaggaaggttctccgtgacaacatccaggggattactaagccagcgattcgtcgtttagctagaagaggtggtgtgaaacgtatcagtggcttgatctatgaggagactcgcggtgttctcaagatcttcctcgagaatgtgattcgtgacgctgtgacttacactgagcacgctcgtaggaagacggtgacggcgatggatgttgtttatgcgttgaagaggcagggaaggactttgtacggattcggcggttgaggggattgaatnggntnttgtaaatcgcgtttgttnttngggngnttnaatctcnctaagctgtttgttagggtttcttctgaatgttttaatttaatgaaaaagcttttatctgtttttttctcattt

SEQ ID NO: 2137 - DNA, 493 bp, Brassica juncea
catcgaatcttcttcaacgctaaactttctcagaaaaaaaaacccaatttccttctgaaaaaatgtcgggacgtggaaagggaggaaagggtttgggcaaaggaggagccaagcgtcacaggaaggttctgagagacaacatccagggaatcaccaagccggcgattcggaggctggctcgcagaggtggagtcaagcgtatcagtggtctcatctacgaggagacacgtggagtcctcaagatctttttggagaacgttattcgagacgctgtgacctacaccgagcacgctaggaggaagactgtgactgcgatggatgtggtctacgcgttgaagaggcaagggaggacgctttacgggtttggtggttaagggtctcttgtagattcgcgttttgcgtttctgggtttctttaggcgtgttcttatggaagtttctaatcaaatcatgttttccttagcgtttgtgttttgaattccgtttgagttcga

SEQ ID NO: 2138 - DNA, 368 bp, Brassica juncea
gaccagaagcgaatttactcatatattttcttttttaagtacttcgaggagatgtcaggaagaggaaagggaggaaagggattgggaaagggaggagctaagaggcataggaaggtgcttagggataacattcaaggtatcaccaagcctgccattcgtcgtcttgctcgtagaggtggtgtcaagcgtattagtggtctcatctacgaagagaccagaggagtcctcaagatctttctcgagaatgtcatccgtgacgccgttacttacaccgagcacgccaggagaaagaccgtcaccgctatggatgtggtttatgctttgaagaggcaaaggaccgcactctctacggtttcggcggctaatca

SEQ ID NO: 2139 - DNA, 520 bp, Brassica oleracea
gatcgcactctcctacacacgtgtgagaaacaactttctttttttctctgattttaaaaccttttcgaggaaaagaaaatgtctgggagaggaaagggaggaaagggattgggaaagggaggagccaagaggcacaggaaggtcctccgagacaacatccaggggattaccaagccggcgattcgtcgtttagcgagaagaggcggtgtgaagcgtatcagcggtttgatctacgaggagactcgcggcgttctcaagatcttcctcgagaatgtgatccgtgacgctgtgacttacactgagcacgcgaggaggaagactgtgacggcgatggatgttgtgtacgcgttgaagaggcaggggaggactctgtacgggttcggcggctgaggggattgaattagggttttgtaaatcgcgtctgggttgtttttaggccttgttaaggcctttaagctgttgtgatggtttcgtttcgaatgtttcgatgatttgaattgaatgaaaacgcttttattac

SEQ ID NO: 2140 - DNA, 541 bp, Brassica oleracea
gaccatcaaagctgcaagcgaatttacttttcctttttcttaaatactttgtgaggagatgtcaggaagagggaaaggaggaaaaggattgggaaagggaggagccaagaggcacaggaaggtgcttagggataacatccaaggtatcaccaagcctgctattcgtcgtcttgctcgtcgaggtggcgtcaagcgtattagcggtttgatctacgaggagaccagaggagtcctcaagatcttcctcgagaatgtcatccgcgacgctgtcacctacactgagcacgcgaggaggaagactgttactgctatggatgtggtttatgctttgaagaggcaaggacgtactctctacggtttcggcggttaaatcgacggagattggattaagggtttgggaagtttggggatctgaatttgggaattttttttttggtttctgattagccgaagtaaatccacgactgttgtatcgttttctgatgtgttgttgttagccaatattatgttaaattaatgttaatcaaaagttgtgctgtgg

SEQ ID NO: 2141 - DNA, 484 bp, Brassica oleracea
  misc_feature (174)..(174): n is a, c, g, or t
gcggggacaatctgaatctaatacttagttatatattctagagaaagtttccaaagaaaaatgtcaggaagaggaaagggaggaaagggattgggaaaaggaggagcgaagagacacaggaaggttctgagagacaacatccaaggaattaccaagcctgcgatcaggcgtctngctcgcagaggaggcgttaagcgaatcagcggtttgatctacgaagaaacgagaggagtcctgaagatctttctcgagaatgtgatcagagacgccgtcacttacaccgagcacgcgaggaggaagacggtgacggcaatggatgtggtttatgctttgaagagacaaggacgtactctctacggattcggtggttgaatcgttttcgatttgttgtgttgtgttgctactattaagtcttgcggtcaagaagtgttgtaacgaagttcttctctttatcggttaatggaaatatgattaatcagatctc

SEQ ID NO: 2142 - DNA, 570 bp, Brassica oleracea
  misc_feature (554)..(554): n is a, c, g, or t
gatcgaatcttcttcaacgctaaacttttctcaagaaaaaaaaaacccaatttccttctgaaaaaatgtcgggacgtggaaagggaggaaagggtttgggcaaaggaggagccaagcgtcacaggaaggttctgagagacaacatccagggaatcaccaagccggcgattcggaggctggctcgcagaggtggagtcaagcgtatcagtggtctcatctacgaggagacacgtggagtcctcaagatctttttggagaacgttattcgagacgctgtgacttacaccgagcacgccaggaggaagactgtgactgcgatggatgtggtctacgcgttgaagaggcaagggaggacgctttacgggtttggtggttaagggtctcttgtagattcgcgttttgcgtttctgggtttctttaggcgtgttcttatggaagtttctaatcaaatcatgttttccttagcgtttgtgttttgaattccgtttgagttcggtcttttgtgtgttgcgttagcgtttcgttatatgtaattacgcaattttatctatgangctattcgaggctatg

SEQ ID NO: 2143 - DNA, 544 bp, Brassica oleracea
gatcgtcaaatctccgtctccaatcaattaacatatctacataagcttgtgaagagagatgtcaggaagaggaaagggaggaaagggactgggaaaaggtggagcgaagaggcacaggaaggttcttagggataacatccaaggcatcaccaagcctgcgattcgtcgtcttgctcgcagaggtggagtcaagcgtattagcggtctgatctacgaggagaccagaggagtcctcaagatcttcctcgagaatgtcatccgcgacgccgtgacttacaccgagcacgctaggaggaagacggttactgctatggatgtggtgtatgctttgaagaggcagggacgcactctctacgggttcggcggttaaatctacgatgtgttgtggaagaggggattagtgttctcttgtcttgttcttgtagctaaaatcttagcaatgttatgttaatgagatttgagaataaacaatattatgtctttggttctcttagtttgatatgtgaatccaagctcaagtttaactttcatactttgtccaaaa

SEQ ID NO: 2144 - DNA, 614 bp, Brassica oleracea
gcggggacaattcaactctaacctcgattcttcttcatcacaaactttctcaatcggaaaaaaatgtcgggccgtggaaagggaggaaagggtttgggcaaaggaggagccaagcgtcacaggaaggttctgagagacaacatccaagggatcaccaagccggcgattcggagactggctcgtagaggtggagtcaaacgtatcagtggtctcatctacgaggagacacgtggcgtcctcaagatctttttggagaacgtcatccgtgacgccgtcacctacaccgagcacgctaggaggaagaccgtgactgcgatggacgtcgtctatgcgctgaagaggcaggggaggactctctacgggttcggcggttaagggtcttcttagattcgcgtttgcgtttctgggtttcttttccggaaatttctaatcaaatcatgttctacttagcgtttgcgtttgaattatgtctgggtacggcgtttatgtgttgcggtagcgtttcgttttatatgtaattacgccttttatcttatgtttttagcgatgcaatgtcgaagtaatccaaggttaagtttctggaaaaatatattcgaattttatttacacaaggc

SEQ ID NO: 2145 - DNA, 538 bp, Brassica oleracea
gatgtatgttcatatataaacctctcatcatcctctcagatctacacatcgaaaacacacaagcgaatctcaattaaaaactttccgagaaaagaaaaatgtctgggcgaggaaaaggaggaaaggggttgggaaagggaggagccaagaggcacaggaaggttctccgtgacaacatccagggcatcacgaagcccgcgattcgtcgtctagctagaagaggtggcgtgaagcgtatcagcggtttgatctacgaggagactcgcggtgttctcaagatctttctcgagaatgtgattcgcgatgccgttacttacactgagcacgctaggaggaagacggtgacggcgatggatgttgtctatgcgttgaagaggcaaggacgaactttgtatggattcggcggttgagggatgagattggagtttgtaaatcgcgtttgtctttagggtttgtttaatctattaaagctgttttagagtttcgtttagaatgtttcagcgatttgaatttaatgaaaacactttttatctactat

SEQ ID NO: 2146 - DNA, 487 bp, Brassica oleracea
gacacaaaaccaaaaaaaaaagggtccttgagaaaatctgagatttagtgttgttgaaaaatgtcgggtcgtggaaagggaggcaagggtttggggaaaggaggagccaagcgtcacaggaaggttctcagagacaacatccaaggaatcaccaagcctgcgattcgtcgtttggctcgtagaggaggcgtgaagcgtatcagcggtctgatctacgaggagacacgtggcgtcctcaagatctttttggagaacgttatccgtgacgccgtcacatacaccgagcacgcgcggaggaagacggtgacggccatggatgtggtgtatgctctcaagaggcaagggaggactctctatggattcggcggctggggttttaaaattgttttcgttaaatcaaatctcagatgtgattctattttagtaatttcagcttctctttatgcttttgtatcatcaaaatatatgaaattcacatttgactatc

SEQ ID NO: 2147 - DNA, 726 bp, Brassica rapa
  misc_feature (171)..(171): n is a, c, g, or t
  misc_feature (173)..(173): n is a, c, g, or t
  misc_feature (176)..(176): n is a, c, g, or t
  misc_feature (180)..(181): n is a, c, g, or t
  misc_feature (183)..(183): n is a, c, g, or t
tttgctatcctctccgatcgatttttcaggtatcgtcttcttcttcttcttcctcgtgtttctgcaattatccgattcgttttgcaggtttcatattaaatcgagtttcatttcagataaatatgaattgattaggatttgggaatctagggtttcttgattcctgattgntntcntctnngntcgatttttcaggtcttttgaaaactaactgaggagagatgtcgggaagaggaaagggaggaaagggattgggaaagggaggagcgaagaggcacaggaaggtgctgagggataacatccaaggtatcaccaagcctgccatccgtcgtcttgctcgcagaggaggtgtcaagcgtattagcggactcatctacgaggagacaagaggagtcctcaagatctttctcgagaatgtcatccgcgacgctgttacctacaccgagcacgctaggaggaagactgttacggctatggatgtggtttacgcgttgaagaggcaaggacgtactctctacggtttcggcggttaatcaaagattgtgatttttaggagatgggattagtgttacgggttatctgggagtgtattgtttctgttatccaatttgattagtgaaaagtaaaaacaaagagttagcttttgtgctaggtcttgtagccaatgtgatcgattgttaaatgaaagaatctttgaactaatatcatctcaaattcattttcatt

SEQ ID NO: 2148 - DNA, 592 bp, Brassica rapa
  misc_feature (79)..(79): n is a, c, g, or t
ctccgatcaattaacaggtatcgtcttcttcttcttcttatcgattgaattttcaatatcaaatgttaaatccactgtntcgtcaaatctccgtctccgatcaattaacagatctacataaagcttgcgaagagagatgtcaggaagaggaaagggaggaaagggattgggaaaaggaggagcgaagaggcacaggaaggtgctgagggataacatccaaggcatcaccaagcctgcgattcgtcgtcttgctcgcagaggaggcgtgaagcgtataagcggtctgatctacgaggagaccagaggagtcctcaagatcttcctcgagaatgtcatccgcgacgccgttacttacaccgagcacgctaggaggaagacggttactgctatggatgtggtttatgctttgaagaggcagggacgcactctctacgggttcggcggttaaaacgacgatggacttagtaggggattagtgttatctgtcttgttcttgttatgctaatgagttgtcaaattaaagctgagaatgattaatattatgtctttgattctcttagtttgatttgtgaatccaagctcaagtttaact

SEQ ID NO: 2149 - DNA, 529 bp, Brassica rapa
  misc_feature (19)..(19): n is a, c, g, or t
  misc_feature (463)..(463): n is a, c, g, or t
  misc_feature (465)..(465): n is a, c, g, or t
  misc_feature (478)..(478): n is a, c, g, or t
gacacatcgcactctcctncacacgtgtgaaaaaacaacttccttttttttttctctgattttaaaaactttcccgagaaaaagaaaaatgtctgggcgtggtaagggaggaaagggacttggaaagggaggagccaagaggcacaggaaggttctccgcgacaacatccagggaatcaccaagccggcgattcgccgtttagcgagaagaggcggcgtgaagcgtatcagcgggttgatctacgaggagactcgcggcgttctcaagatctttctcgagaatgtgatccgtgacgctgtgacttacactgagcacgcgaggaggaagactgtgacggcgatggatgttgtgtacgcgttgaagaggcaggggaggactctgtatgggttcggcggctgaggggattcaattagggtttttgtaaatcgcgtttgggttgttttttagggtttgttttaagancnttaagctgttgtnatggtttcgtttcgaatgtttcggtgatttgaatttaatgaaaacgctttt

SEQ ID NO: 2150 - DNA, 647 bp, Brassica rapa
ctcgaacctctcgatcacacgcttgtcaataccaccaagcttgtagatcaagtgaccagtggtggtagacttcccggaatcgacgtggccgatgaccacaatgttgatgtgaaacttctctttacccatggctgctcgtcaagtacagtcttcaaaactctctcttacattcaaaagcaaagaaaaaaatgtctggacgaggaaagggaggaaagggactgggaaagggaggagccaagaggcacaggaaggtcctccgcgacaacatccaagggatcacgaagcctgcgattcgtcgtttagcgaggagaggcggtgtgaagcgtatcagcggtttgatatacgaggagactcgcggcgttctcaagatcttcctcgagaatgtgattcgtgacgctgtgacttacactgagcacgctaggaggaagactgtgacggcgatggatgttgtgtacgcgttgaagaggcagggaaggactctgtacgggttcggcggctgaggggatttaattagggatttgtaaatcgcgtttgttgtttttagggtttggttaatttggggagattaagatctctttaagctgtctgaagggttttatctgaatgttttaagtggtttttaattgaatgagaaaagtttttatctg

SEQ ID NO: 2151 - DNA, 619 bp, Brassica rapa
acaattcaactcttaatttgttcaaaaaaattcagcatcaaactatctcaaaagcggaaaaaaaatgtcgggccgtggaaagggaggaaagggtttgggcaaaggaggagccaagcgtcacaggaaggttctgagagacaacatccaagggatcaccaagccggcgattcggagattggctcgtagaggtggagtcaagcgtatcagtggtcttatctacgaggagacacgtggcgtactcaagatctttttggagaacgttatccgtgacgctgttacctacaccgagcacgctaggaggaagacggtgaccgccatggacgtcgtctatgctctgaagaggcaggggaggactctctacggtttcggcggttaagggtcttcttagattcgcgtttgcgtttctgtatttcttttctggaaatttctaatcaaatcatgttctacttagcgtttgcgtttgaattatgtttgggtacggcgttttatgtgttgcggtagcgtttcgttttatatgtaattacgccttttatcttatgtttttagcgatgcaatgtcaatgtaatccaatgtcaagaaatatattcgagttttatttacacaagtcaaaaaaaaaaaa

SEQ ID NO: 2152 - DNA, 512 bp, Brassica rapa
gtgatatctccgtctccgatcaattaacagatctagataagcttgtgaagagagatgtcaggaagaggaaagggaggaaagggattgggaaaaggaggagcgaagaggcacaggaaggtgctgagggataacatccaaggcatcaccaagcctgcgattcgtcgtcttgctcgcagaggtggagtcaagcgtataagcggtctgatctacgaggagacaagaggagtcctcaagatcttcctcgagaatgtcatccgcgacgccgttacttacaccgagcacgctaggaggaagacggttactgctatggatgtggtgtatgctttgaagaggcaaggacgtactctctacgggttcggcggttaatctacgatggattagcgttctctgtcttgtcttgtagctaaagcttatgctaatgagttgtcaaatgaaagctgagaatcattaatattatgtatttggttctcttagtttgatatatgaatctaagttcaagtttaactctcaag

SEQ ID NO: 2153 - DNA, 556 bp, Brassica rapa
atcagaaatttactctattgctttccttaaacacttgttagaagatgtcaggaagagggaaaggaggaaaaggattgggaaagggaggagccaagagacacaggaaggtgcttagagataacatccaaggtatcaccaagcctgctattcgtcgtcttgctcgtcgaggtggtgtcaagcgtatcagcggtttgatctacgaagagaccagaggagtcctcaagatcttcctcgagaatgtcatccgcgacgctgttacctacaccgagcacgccaggaggaagactgtcactgctatggatgttgtttatgctttgaagaggcaaggtcgcactctctacggtttcggcggttaaattgagggagattggattagggattccaaagtttggggatctgaatttgggaatttttattttttttcgtttctgattagccgaagtaaatcgtacgactgttgtatcattttctaatgcgttgttagccaatattctgttaaattaatcttaatcaaaagttgtgctgtgatattcctccatcttcaaataaattttat

SEQ ID NO: 2154 - DNA, 519 bp, Brassica rapa
  misc_feature (518)..(519): n is a, c, g, or t
attttgctatctcgatttttcagatctttgaaaacttactgaggagatatgtcgggaagaggaaaaggaggaaagggattgggaaagggaggagccaagaggcacaggaaggtgctgagggataacatccaaggtatcaccaagcctgccatccgtcgtcttgcccgcagaggaggtgtcaagcgtataagcggactgatctacgaggagaccagaggagtcctcaagatcttcctcgagaatgtcatccgtgacgctgttacatacaccgagcacgctaggaggaagactgttacggctatggatgtggtttacgcgttgaagaggcaaggacgcactctctacggtttcggcggttaatccaaagattgagattagtgttacggttatctgggagtgtattgtttctgttatccatttgattagtaaaaagtaaagcaatgtcttgtagcctatgtgatcttcatgtagctaaaatctctgcaatggattcttaaatgaaagttgtttttgaaccnn

SEQ ID NO: 2155 - DNA, 525 bp, Brassica rapa
gaattcatcatctgaaccttaaacactcaatcatctaaatctcgagaaagttctaatgtcaggaagaggaaaaggaggcaaggggttgggcaaaggaggagccaagaggcacaggaaggttctgagagacaacatccaaggaatcaccaagcctgcgatcaggcgtctcgctcgtagaggaggcgtgaagagaatcagcgggttgatctacgaagagaccagaggagttctgaagatctttctcgagaatgtgattagagacgcggtgacgtacacggagcacgcgaggaggaagacggttacggcgatggatgttgtttatgctttgaagaggcaagggcgaactctttatggattcggtggttaaaaccggtttaagatttcggtttggtttatgggtgctactgaattaagtcttgctgtcaagaaatctagtaggtttttaggctttatcactcctttgctggtttgtttctttgtttgtgtaatttctcttttaggatttataaaagaatcaattactca

SEQ ID NO: 2156 - DNA, 506 bp, Musa acuminata
  misc_feature (90)..(90): n is a, c, g, or t
gagaaagagatgtcgggacgcgggaagggagggaagggtttggggaagggcggggcgaagcggcatcggaaggtgctgcgggacaacatncaggggatcacgaagccggcgatccggcgactggcccggcggggtggggtgaagcgcatctcggggctcatctacgaggagacccgcggcgtgctcaagatcttcctggagaacgtcatccgcgacgccgtcacctacacggagcacgcccgccgcaagaccgtcaccgccatggacgtcgtctacgccctcaagcgccagggccgcaccctttacggcttcggcggataggcgccggccctcctcgctctgcctagaggaagaaagagatagcgcgttggattagggcttgatttcctcttcttcctcatttctgctttggtttgatggagatgtcgaaggaaatgctccgcgcttgtgggtgattgtaaacttgtagtctttcgtagaattgtcgatcacagccgttggttttc

SEQ ID NO: 2157 - DNA, 633 bp, Musa acuminata
ggggatcgcttcgagctttccgattcccgcaatctgagaaatttgtagatctagcttcggtcggcggcgatgtccgggcgaggaaagggcggcaagggcttgggcaagggcggggccaagcgccaccgcaaggttctccgggacaacatccagggcattaccaagcccgcgatccggcgcttggcgaggaggggcggtgtgaagcgtatcagcggccttatctacgaggagactcgtggcgtccttaagatcttcctcgagaatgtgatccgcgatgctgtgacctacactgagcacgcccgtcggaagactgtcaccgcgatggacgtcgtgtatgccctgaagaggcagggaaggactctctatggttttggtggttagggcttcacgtttgattaaagtcttgctgtcaagaaatccaaaaaactgaaacaatgtagattgaatttgagactatgtggctagggtatcagcatccgcttatggggcttctgatgttagaattgctcatctagggttttctttggtcatctgtccgtcggtaatttaagctgttgttgctggaagctccgtgtgtaggtactgatgtgcgactcgtccgcagtttatgaattatatctcattgtgtttggt

SEQ ID NO: 2158 - DNA, 564 bp, Musa acuminata
gaccttttcctcttctccaagcgttcccttttggatcgatcgactgtgggcttaatgtccggccgcggaaagggaggcaagggtctcggcaagggcggggcgaagcgtcaccgaaaggttctccgcgacaacatccagggcatcaccaagccggccatccgccgccttgcccgccgtggtggtgtcaagcgcatcagtggccttatctacgaggagacccgcggcgtcctcaagatcttcctcgagaacgtcatccgagatgccgtcacgtacacggagcacgcccgccgcaagaccgtcaccgccatggacgtcgtctacgctcttaagcgccagggccgtactctctacgggttcggtggttgagctgtcccttttcgagtgccgccgtcgacgtcggcggcggggtttggggccctaggctagctagggttagggttagggttagggttcgtcttttggttagatttctgaagaagatgtgttgagatagtaagttcggaaaatgagatgagcaatgtcactgatgaaaatagaaattgcaaaaagatacaagaaatttgg

SEQ ID NO: 2159 - DNA, 528 bp, Musa acuminata
cttctacctttattttcttggatcgatctgcgccatgtctggtcgcggtaagggaggcaaggggctaggcaagggcggcgcgaagcgccaccgcaaggtactccgcgacaacatccaggggatcaccaagccggcgatccgtcgtctcgcacgccgtggtggcgtgaagcgaatctccggtctcatctacgaggagacccgcggcgtcctcaagatctttctcgagaacgtcatccgtgatgccgtcacctacaccgagcacgctcgccgcaagactgtcaccgccatggacgtcgtctacgcactcaagcgccagggtcgcaccctctacgggttcggaggttgagctcgttctttggcggtgctggcgatggaagtgtgggtcgcaagtgttagggttttgcgttctttgggttcgttctgaaagggctgatgttgtcttgtaaaaaggacctacctttggttgcgttgtaacaggagaactgtagctttgtgttatcaagatgcattgcttaatgcttgctgtag

SEQ ID NO: 2160 - DNA, 581 bp, Hordeum vulgare
cggcacgagggatcgacaatccccaccgcccctcccacttccacatctgctcgcagctcgaagaggatcagtcgtcagccatgtccgggcgcggcaagggaggcaagggtctgggcaagggcggcgccaagcgccaccggaaggtgctgcgcgacaacatccagggcatcaccaagccggccatccgtcgcctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggcccgctggtggtcgtcagtcttcctgcagactccgattgcttgatgaggccgcgacttgtgtagttctctgtttcctctgtacttcgaactgaatcgtgcaacaaagatattcgcttctgtcgttggaaatcaaacttgtctctgcaaatatagtgcttgtgattttgtcttgctaacaaaaaaaaaa

SEQ ID NO: 2161 - DNA, 585 bp, Hordeum vulgare
cggcacgaggcaagctacagcccccaaaggagttcctcttcttcctaatacacactctctcggagcggagcggagcgaagcggcgatgtcagggcgcggcaagggcggcaagggtctgggcaagggcggcgccaagcgccaccggaaggtcctccgcgacaacatccagggcatcaccaagccggcgatccggaggctggccaggaggggaggcgtcaagcgcatctccggcctcatctacgaggagacccgcggcgtcctcaagatcttccttgagaacgtcatccgcgacgccgtcacctacaccgagcacgcccgccgcaagaccgtcaccgccatggacgtcgtctacgccctcaagcgccagggccgcaccctctacggcttcggaggctagattccagccgtgttgtgctggtggaggtcgtgttacctgtgtgatatgtgccgtggttgatgggatttacttctctgtcgtgcgtttgtgctcagtacgctgtagtaacagtatgcgttcaatgagtgtaccccgatcccgaattctgatgaaactcttcagttatgaatcgtgttaccgtttttccc

SEQ ID NO: 2162 - DNA, 552 bp, Hordeum vulgare
tcaccgcaccgccgcaacaaccacacacccacagaacccaagctcgccggagggagaagccgtcaaccatgtctggccgcggcaagggaggtaaggggctgggcaagggtggcgccaagcgccaccggaaggtgctccgcgacaacatccagggcatcaccaagccggccatccgtcgtctggctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcggcaggggcgaaccctctacggattcggcggctagtccgcgccgctccggtcggatccacctcgcggccgtcggattcgtagctagccatggttgttgttcagtgttcattgtcttgagtgtaacggaatggccgcatctcgctgctgtgtgttgtttcgatgtggtaccgctagcatggaatggaaatctcagcgctttatccctg

SEQ ID NO: 2163 - DNA, 573 bp, Hordeum vulgare
atctcaccgcaccgccgcaacagcacacacccacagaacccaagctcgccggagggagaagccgtcaaccaccatgtctggccgcggcaagggagggaaggggctgggtaagggtggcgccaagcgccaccggaaggtgctccgtgacaacatccagggcatcacgaagccggccatccgtcgcctggctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacaggggcgaaccctctacggattcggcggctagtccgcgccgctccggtcggatccacctcgcgccgtcggattcgtagctagccatggttgttgttcagtcttcattgtctccggtgtaacggaatggccgcatctcgctgctgtctgttgtttcgatgtactactgctagcattagcatggaatggaaatctcagcgctttgtccttgaattcgccttc

SEQ ID NO: 2164 - DNA, 827 bp, Hordeum vulgare
cggcacgagggtcaccaccaccgtacctcagattccacatccgctctctcgctcgctcacaggtcgagatcgtcagccatgtccgggcgcggcaagggaggcaaggggctcggcaagggcggcgccaagcgccaccggaaggtgctgcgcgacaacatccagggcatcaccaagccggcgatccggcggctggctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggccaccaggccatcagctagctttgtttggcacaccccagtagtagtgttcgtggccggtcctcgggtgtaatcgccgcatctcgctgctgtttgccctggccttgtttagtttgtcgtctggatgtgctaggatggaatggaaactgtagcagtttgtttacccttgaattcttgtgtaatccgtgttgtctgtcgatgtctgttcgtgcaagtggtcagatattcaccgtgttcttcagttgtccatattccccctttttgaatttctgccccccaaatccgattctgttggcgccagtgttttggagtagactgaaaaccagttgtgttggtttcagtgtttggtggatcgaggctgaacaagagttcttcgctgctccatcctgatgtcgaacttgtgctggaattattcccctagctggaatgtgttggact

SEQ ID NO: 2165 - DNA, 567 bp, Hordeum vulgare
cggcacgagggtcaccaccaccgttcctcacattccacatccgctcgctcgctcgcagctcgagatcgtcagccatgtccgggcgcggcaagggaggcaaggggctcggcaagggcggcgccaagcgccacaggaaggtgctgcgcgacaacatccagggcatcaccaagccggcgatccggcgtctggcgcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggccgcaccctctacggattcggcggctaggccatcagctagctttgtttggcacacagtggtagtagtgttcgtggccggtcctgggttgtaatcgccgcatctcgctgctctttgccctggccttggtttcgtttgtcgtctggatgtgctacgatggaatggaaattgaagctgtttgtttacccttgaaaaaaaaaagaggcaaaaa

SEQ ID NO: 2166 - DNA, 843 bp, Hordeum vulgare
cacggctttgttcaattaccctcccaaagcctttgttaaatcaggatggcccagttggtggtcgacttcgccagagtcgaacttggccaattgaccacgatgttgatgtgggtcttctccttacccatggcttgaaactcgaaggaaggagacgagaggagggggcggcggcgggcctcagattcaacatccgctcgcagctcgaagaggatcaatcgtcagccatgtctgggcggggcaagggaggcaaggggctcggcaagggcggcgccaagcgccacaggaaggtgctccgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgctatggacgtcgtctacgccctcaagcgtcagggccgcaccctctacggcttcggcggctagggccgtcaggctttctcgcagcctgcagactcccgaagcttgatgaaaccacgacttgtgtggttcgctgttccctctgtagttcgaattgaatcttggagcaaagttaatcgcgtatgtcgttgaaaaggaaacttctctctgtgcaatccgtgttcctgattttgcttcgttggtgggtggcgatgagttggtttgccataatttgccaggagcctcggatgaatcgtacgtactacttgtttgcaggctgatttgtaatgtgatgaaaacgccacagggactgaacaagcatttgctctgtttc

SEQ ID NO: 2167 - DNA, 723 bp, Hordeum vulgare
ccactcctcctccacctccatccgctcgcagctggaaccagggagagatcgtcagccatgtccgggcgcggcaagggaggcaagggtctgggcaagggcggcgccaagcgccaccggaaggtgctgcgcgacaacatccagggcatcaccaagccggccatccgtcgcctggccaggaggggcggcgtgaagcgcatctcgggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctaggcccctcgtcgtcgtcagtcttcctcgccgcctgcagactccaatcgcttgataggaccgcgacttgtttagttgtctgtttcctctgtagttcgaactgaatcgttggaaatcgaactctgtgcaaattgcttgctactgattttgtcttgttggttggtctgctgcatctccgctgtgtaccattgttgtttctttgtgatgcaagatcgtgtgcgcttgatgtggcgattagttgatttgccatatctgtctgcaggctaatctgtaatgttaaagaatgccgttgactgaacaattgcgtgtctcgattcaggaacatcgttcctccatttctgctattttatccgatgg

SEQ ID NO: 2168 - DNA, 746 bp, Hordeum vulgare
gcacgaggatcaccaccgctcctccaacttccacaatcccctacagctcgaagaggatcgtcagccatgtccgggcgcggcaagggaggcaagggtctcggcaagggcggcgccaagcgccaccggaaggtgctgcgcgacaacatccagggcatcaccaagccggccatccgtcgcctggcgaggaggggcggcgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggcccctcgtcgtcgccagtcttcgtcgccgcctgcagattccgaatcttagttgaatctgccttgtttagttcgctccctctctctgtatgttgaaatgtatcgtggagcaaagtcattacaatgtggagttgggaatcagacttgtctctccaaatgcagcgcttctcattcggtttcgcgagttggtctgctatatcttgggttacgattgttgcttcttgtgtctttaaaattttggttcgaccgagttggtgatgaccatgcctttgggacggtggatcttgcaaacctataatctgaaagaatgccagtgcctgaatcggtgtgtataactgaaatcgggacgacattttgaactgcttctgc

SEQ ID NO: 2169 - DNA, 710 bp, Hordeum vulgare
ctctcctgctaggcagcttccacctcctctccgacgatgtctgggcgtggcaagggcggcaaggggctcggcaagggcggcgccaagcgccaccggaaggtgctccgtgacaacatccagggcatcaccaagccggcgatccggaggctcgcgaggaggggcggcgtgaagcgtatctccgggctcatctacgaggagacccgcggtgtgctcaagatcttcctcgagaacgtcatccgcgacgccgttacctacaccgagcacgcccgccgcaagaccgtcaccgccatggacgtcgtctacgccctcaagcgccagggccgcaccctctacggcttcggcggctgagcgccatcggcgcgccggctcacctgactctgctgcttattgcttttctctgtagtcgtgcttccaacttctagtttgtctagtgagatccaacttctagttgtaactcctatcgtttcgtttagctggaatggcaagttaattccaatctcagtaaaaccaccatgtctgattctagaaggaagggaaattgagtgacagctgaagttaattcttatggtgtatagaactggaagaacactgctggtttgttccccagagtagcgaaatccggcctctaggcgcttgatgtgtttgtccctgttctgttttttactccgattcgcactgtcggcagttggccagtaaactgcatttttctg

SEQ ID NO: 2170 - DNA, 732 bp, Hordeum vulgare
cggcacgagggcggctccaaatctctcctgctaggcagcttccacctcctctccgacgatgtctgggcgtggcaagggcggcaaggggctcggcaagggcggcgccaagcgccaccggaaggtgctccgtgacaacatccagggcatcaccaagccggcgatccggaggctcgcgaggaggggcggcgtgaagcgtatctccgggctcatctacgaggagacccgcggtgtgctcaagatcttcctcgagaacgtcatccgcgacgccgttacctacaccgagcacgcccgccgcaagaccgtcaccgccatggacgtcgtctacgccctcaagcgccagggccgcaccctctacggcttcggcggctgagcgccatcggcgcgccggctcacctgactctgctgcttattgcttttctctgtagtcgtgcttccaacttctagtttgtctagtgagatccaacttctagttgtaactcctatcgtttcgtttagctggaatggcaagttaattccaatctcagtaaaaccaccatgtctgattctagaaggaagggaaattgagtgacagctgaagttaattcttatggtgtatagaactggaagaacactgctggtttgttccccagagtagcgaaatccggcctctaggcgcttgatgtgtttgtccctgttctgttttttactccgattcgcactgtcggcagttggccagtaaactgcatttttctg

SEQ ID NO: 2171 - DNA, 646 bp, Hordeum vulgare
cggcacgaggctccatttccatctcagtcagctccaagggaggaaggaagccgtcaaccatgtccggtcgcggcaagggagggaagggcctcggcaagggcggcgccaagcgtcaccggaaggtgctgcgcgacaacatccagggcatcaccaagccggccatccggcgtctggcccggcgtggcggcgtgaagcgcatctcggggctcatctacgaggagacccgcggcgtgcttaagatcttcctcgagaacgtcatccgcgacgccgtcacctacaccgagcacgcccgccgcaagaccgtcaccgccatggacgtcgtctacgcgctcaagcgacagggacgcaccctctacggattcggcggctgacctgcgcccgctgctccagtctccatcgagtaggctctgctagctgctgcggctgtttctggtgctgtggtttcgtttctgaattctgagtgtgtgcgtgcgttgttgttccatctgtccgtgtagttagtggaaggcgatggatctgaatgcagtcagttggtcagagtgcgtgtgttggttgtcctgccggtctctgtagccagttcctcagttgcaatgggaggtgatgaatatgaatgcaatgcgattgttggttctctgtaaaaaaaaaa

SEQ ID NO: 2172 - DNA, 632 bp, Hordeum vulgare
gatcactagcttcaacatccgcgccactcacttcttctcccaaatccagcgacgatgtccgggcgcggcaagggcggcaagggtctgggcaagggcggcgccaagcgccaccggaaggtcctccgcgacaacatccagggcatcaccaagccggcgatccggaggcttgccaggaggggcggcgtcaagcgcatctccggcctcatctacgaggagacccgcggcgtcctcaagatattcctcgagaacgtcatccgcgacgccgtcacctacaccgagcacgcccgccgcaagaccgtcaccgccatggacgtcgtctacgcgctcaagcgccagggccgcaccctctatggcttcggaggctagatgcgttgcgtagtggagcaacttgctcgtttgctctgcgtgatgtgtgctgtggtgtgtgttctgtctttgggttcagtaggctgtgtaataccatgctctgttcaatgcaatcagttcgattctgaatcctgacgaaatgcttcagtgctgaatcgtgttttcttttttccaagacggactgatttgatctctctggtaaaaaagaaagaaagatcgtatagctgcactgaatcagtcttatttgttgtatctgaaaaaaaaaa

SEQ ID NO: 2173 - DNA, 492 bp, Hordeum vulgare
gcaaccacctcacaaagacaaagtcaacctcaccggagagagaagcgagaagatgtcgggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccggggcgtgctcaagatcttcctcgagaacgtcatccgcgacgcagtcacctacaccgagcacgcccgccgcaagaccgtcaccgccatggacgtcgtctacgcactcaagcgccagggacgcaccctctacggcttcggaggctaggccgtcaaccagatttagattgttctagggtcgactggtcgttgatgtaaccgcagcatctcgctgttgtttgctgtcttttgtggaatcgaatggactgcaatggaaatttaactagttcttgtctg

SEQ ID NO: 2174 - DNA, 538 bp, Hordeum vulgare
cggcacgaggcccacctccaaagaccagtcaacctcaccggagagaagacaagagagaaaggagaagatgtcggggcgcggcaagggcggcaaggggctgggcaagggcggcgccaagcgccaccggaaggtcctccgcgacaacatccagggcatcaccaagccggcgatccgtcgtcttgcgcgtcgcggcggcgtgaagcgcatctcagggctcatctacgaggagacccgcggcgtgctcaagatcttcctcgagaacgtcatccgcgacgccgtcacctacaccgagcacgcccgccgcaagaccgtcactgccatggacgtcgtctacgccctcaagcgccagggacgcaccctctacggcttcggaggctaggctcctgccagccagatccagctcgcaccgcttgattgatcagattaacagtagctaggcattgttcagtgttaatggtgatggatgtaatctatgatgtatgctgccttttcgtttgaatggatcaaatcgcagttagttacccttaaaaaaaaaaaa

SEQ ID NO: 2175 - DNA, 782 bp, Hordeum vulgare
cggcacgaggcacattcccccttcctcctccacctccatcccgctcgcagctcgaaccaaggagaggtcgtcagccatgtccgggcgcggcaagggaggcaagggtctcggcaagggcggcgccaagcgccacaggaaggtgctgcgcgacaacatccagggcatcaccaagccggccatccgtcgcctggcgaggaggggcggcgtgaagcgtatctccggcctcatctacgaggagacccgcggcgtcctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggctcttcctcgccccccctgcagattccggtgtgtttacctgcctgtgcgcggagtccatctgtcgaaaaatcttagatgaaccgaaatccccatgtttattgccactgtttctgtttcattagtaggttcatactgtatcctgagacgaaactttcacatctggagttaaacttgtttctgagcaaacgctgtgtttctgctctggttttttatgttcagactgtatgaatatgattgttgttcctcctgtcatgcaagtttatctgcagagcagacagtaaattctacttgcaggctaacttgtgatatgaatgatctttattggccaaaacatcatgtggttcttgatagttgttatatgtaatcagcatgtcatgtgcacatttctgttt

SEQ ID NO: 2176 - DNA, 683 bp, Hordeum vulgare
gccgccgccaccacagagctcctcatccatctccatctccatctccatctccatctccatctccatctccatctcagtcagctccaagggaggaagccgtcaaccatgtccggtcgcggcaagggagggaaggggttgggcaagggcggcgccaagcgccaccggaaggtgctccgggacaacatccagggcatcaccaagccggccatccggcggcttgcacggcgtggcggcgtgaagcgtatctcggggctcatctacgaggagacccgcggcgtgctcaagatcttcctcgagaacgtcatccgcgacgccgtcacctacaccgagcacgcccgccgcaaaaccgtcaccgctatggacgtcgtctacgccctcaagcgccagggccgcaccctctacggcttcggcggctgacctgcacccgccgctgctccaccgagtcaaccctggtagctgctgctgctgttccggtgctatggtttcgtttctgaattccgtatgcatgcgttgctgttccgtcggtctgtgtagttagcgggaaggcgatggatctgaatgtaatggaattgttggttcttgcaagaaatgaatctgaatgcaatggaatttgtactgcatctcatgatacgactgtacctcctggcttgtttctgtacattttagtaaaatttctcagcaag

SEQ ID NO: 2177 - DNA, 708 bp, Hordeum vulgare
ctccatctcagtcagctccaagggaggaagccgtcagccatgtccggccgcggcaagggagggaagggcctcggaaagggcggcgccaagcgccaccggaaggtcctccgcgacaacatccagggcatcaccaagccggccatccgccgtctggcccggcgtggcggcgtgaagcgcatctccggactgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctgacctgcgcccgccgctgccctcttgagtcggccctgctagctgctgctgctgttccggtgctatggtttcctttctgaattctttatgcgtgcgttgttgttccgtcggtctgtgtagttagcgggaaggcgatggatctgaatgtaatggaattcttgtttcttgcaaggaatgaatctgaatgcaatggaatttgtactgtcagctggtgctaccagctcctttgcaggccagcctcaaccccagaaagtgcttgctcaagttcagcagaaggctgaagaaatgtgcccctttctctatctaaacgggcgatgcagtctgctgctgttatgctatctccgatgcccttatatatca

SEQ ID NO: 2178 - DNA, 552 bp, Hordeum vulgare
ctccatctcagtcagctccaagggaggaagccgtcagccatgtccggccgcggcaagggagggaagggcctcggaaagggcggcgccaagcgccaccggaaggtcctccgcgacaacatccagggcatcaccaagccggccatccgccgtctggcccggcgtggcggcgtgaagcgcatctccggactgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctgacctgcgcccgccgctgccctcttgagtcggccctgctagctgctgctgctgttccggtgctatggtttcctttctgaattctttatgcgtgcgttgttgttccgtcggtctgtgtagttagcgggaaggcgatggatctgaatgtaatggaattcttgtttcttgcaaggaatgaatctgaatgcaatggaatttgtactg

SEQ ID NO: 2179 - DNA, 601 bp, Hordeum vulgare
cggctagcagccggcgccgttccctcagattccgcatccgcttgctcgcagctcgagaccgtcagccatgtccgggcgcggtaagggaggcaaggggctcggcaagggcggcgccaagcgccacaggaaggtgctgcgcgacaacatccagggcatcaccaagccggcgatccggcgcctggcgcgcaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtgtacgcgctcaagcgccagggccgcaccctctacggattcggcggctaggccaccagtggccatcagctagctttgcttggcacgccgcggtagtagtgctcgtggccggtcctcggttgtaatcgccgcatctcgctgctgtttgccctggccttgttttcgtttgtcgtctcgatgtgctaggatggaatggaaattgcagtagtttgaactgaatcgtggaacaaagttacatgcatgtcttgtcggaaacgaaaccttgctctgtgc

SEQ ID NO: 2180 - DNA, 611 bp, Hordeum vulgare
gtcaccaccaccgtacctcagattccacatccgctcgctcgctcgctcacaggtcgagatcgtcagccatgtccgggcgcggcaagggaggcaaggggctcggcaagggcggcgccaagcgccaccggaaggtgctgcgcgacaacatccagggcatcaccaagccggcgatccggcggctggctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggccaccggaccaccagctagctttgtttggcgcaccgcggtagtagtgttcgtggccggtccttgggtgtaatcgccgcatctcgctgctgtttgccctggccttgtttagtttgtcgtctggatgtgctaggatggaatggaaactgtagcggtttgtttacccttgaattcttgtgtgatccgtgttgcctgtcgatgtctgttcgtgcaagtggtcagatattaaccg

SEQ ID NO: 2181 - DNA, 502 bp, Hordeum vulgare
actcacttcttctcccaaatccagcgacgatgtcagggcgcggcaagggcggcaagggtctgggcaagggcggcgccaagcgccaccggaaggtcctccgcgacaacatccagggcatcaccaagccggcgatccggaggctggccaggaggggcggcgtcaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagatgcgttgcgtagtggagcaacttgctcgtttgctctgcgtgatgtgtgctgtggtggatgggtctaccgatttggcgtgcgccgttgtgttctgtctttgggttcagtaggctgtgtaataccatgttctgttcaatgcaatcagttcgattctgaatcc

SEQ ID NO: 2182 - DNA, 545 bp, Hordeum vulgare
tctagatcgcaagcttcaacacccgcggcactcacttcttctcccaaatccagcgacgatgtccgggcgcggcaagggcggcaagggtctgggcaagggcggcgccaagcgccaccggaaggtcctccgcgacaacatccagggcatcaccaagccggcgatccggaggctggccaggaggggaggcgtcaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagatgcgttgcgtagtggagcaacttgctcgtttgctctgcgtgatgtgtgctgtggtggatgggtctaccgatttggcgtgcgccgttgtgttctgtctttgggttcagtaggctgtgtaatagtaccatgttctgttcaatgcaatcagttcgattctgaatcctgacgaaatgc

SEQ ID NO: 2183 - DNA, 535 bp, Hordeum vulgare
caccaccgctcctcctccattttcttccagttccatcagctccaagaaaaccatgtccggccgcggcaagggagggaagggcctcggcaagggcggcgccaagcgtcaccggaaggtgctccgcgacaacatccagggcatcaccaagccggccatccggcgtcttgcacggcgtggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaaacgacagggacgcaccctctacggattcggcggctaggcctcctgctccatccagtcgaacccacctcgcgcccccagattcgtagctagccatgcttgttgttcagtgttcattttgttcagtgtaatggccgcatctcgctgctgttcattgctctgtgtttggatgtactacgatggaatggaaatcgcagtgttttaaccctgg

SEQ ID NO: 2184 - DNA, 978 bp, Hordeum vulgare
aaaagcgggactccccgcggggcggccgtctaactatggacccccgggctgcagattcggccgagccaccaccgccgatccaatccactccaccgagcgagaaggagaggaagatgtcgggccgcggcaagggaggcaaggggctgggcaagggcggcgccaagcgccaccggaaggtgctccgcgacaacatccagggcatcaccaagccggcgatccggcgcctggcgcgtcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggcttcggaggctaggccttccctgccccgctcgcgacgtccgccgtccgctagggtagtcgtgtccagtctagggttcgtcgttcctcgtgtagtgtcttgctggtgtttgctcgcgtcttgtgagctgatgttgctgttgttgggatgtactgggtcaagtttggaatggaaattgcagtactagttttctcccaggacaaataaaaaaaaaaaacttaggggggccagacccattcccctataggagccattacattatggccgaggtaacacggggacgggaaaccggcgtaccactaatggctgggacatccctttcccctgcgtaaacgaaggccgccaacgccttcacatggcacctatggaaaggattggcccgtaatttaaaataacctatttgtaataatattttccaggggaagggaagcttaaccaaaaccaaaggtaggggccgtgaaaggccttaaagccccggagggaacctagggggcggaaccacaaggtttgggggaaccttggtatgcccttgaaggaagcaggaagaaagaaagggcggtggttccct

SEQ ID NO: 2185 - DNA, 898 bp, Hordeum vulgare
aatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacgggggcggttcgccgcccccgacgtcgcgagaagtccattgaaccttatcatttagaggaaggagaagtcgtaacaaggtttccgtaggtgaacctgcggaaggatcattgacaagcttcagcaccacttcctcttccccccaaccacacctctctacgagtcaaggcggagcggcgatgtctgggcgcggcaagggcggcaaggggctgggcaagggcggcgccaagcgtcaccggaaggtcctccgcgacaacatccagggcatcaccaagccggccatccggaggctggccaggaggggcggtgtgaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggttccccgattccgctggcggcagtagcagtagtacgaatgtatcgggtgtcctctgtggtaggtgggatgtaccactgatttcgcgtgcgttgttgtgttccatgttcagttggctgtaataccttgttgcggtcaatgaaaccagttatgttctgaatccaacaaaaaaaaaaaagggcggccgcctcagccagcagcatggacatgccaacaacctcgatccagatccg

SEQ ID NO: 2186 - DNA, 720 bp, Hordeum vulgare
aaaccagacccatatccagcattgcctccataggcagcggcaggacaactcaacctcaccggagagaagcgagaagatgtcgggccgcggcaagggaggcaagggtctcgggaagggcggcgccaagcgccaccggaaggtcctccgcgacaacatccagggcatcaccaagccggcaatccgtcgcctggcccggcggggaggcgtgaagcgcatttcggggctcatctacgaggagacccgcggcgtcctcaagatcttcctcgagaacgtcatccgcgacgccgtcacctacaccgagcacgcccgccgcaagaccgtcaccgccatggacgtcgtctacgccctcaagcgccagggacgcaccctctacgggttcggaggctaggccaccaaccagattagagtgtctagggttcgtggtcgttggtttaatcgcagcatctcgctgttgtttgctatcttctgtaggatcgaatggaatggaatggaaattgctagttcattgttgaaatctgttgagcctgttaaattccccatatactgtctgtctctcagcctttctgtgctcgaatcggttttgtttgttctggttcatacaattcgaactactatctcaactttttagtctctgcagtgtcaaatgtccactcccaaccctatccaagttccaaatccgtccagtgagggcttgcaggcaccgatccaccccgttgcagc

SEQ ID NO: 2187 - DNA, 649 bp, Hordeum vulgare
cggcacgaggcacaccactcctccaacccacccactcgctcagcagctcgaagaggatcgtcggccatgtccgggcgcggcaagggaggcaagggtctcggcaagggcggcgccaagcgccaccggaaggtgctgcgcgacaacatccagggcatcaccaagcctgccatccgtcgcctggcgaggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggcctaggcgtccatctgcgcccgcagcccgtcgcctcctcgccgtccgcagtccgcaccctctacggcttcggcggctagtctctttgtagctccccgcatattccgatgtgtttctaagactgcgcgcaggtgtctctctgtggagacttcttagatgaagtgaaatccccatgtttatttccactgtctgcttattagtaggatgaactgtatcgtgaaacagagttattggcctctgaagcttgaatccaaacttgtttccgtgcaaa

SEQ ID NO: 2188 - DNA, 1013 bp, Hordeum vulgare
aaacccaccgcagcaaagggacagcggcggagatgtcgggccgtggcaagggaggaaaggggctcggaaagggcggcgccaagcgccaccggaaggtgctgcgcgacaacatccagggcatcaccaagccggccatccgtcgcctggcgcgccgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggtttcggcggttaggcccgccagatccgtcgcccgcggaaaccagattaggagctagcctctgtttaggattcatgttctgttgtggggtaattgcagtatctcgctgtcttgtttcctctgttctgctgtttggtgcatggacaaactgatcactgctggtttgctagaatggaatggaatggaaatttcacccttgaattcttatgcaatctcctagctctgctgatatcccggttctgtcgctctgtattatctttgtcctcaaattaattgatgtgtgctacagcgttcgatttgaatgatgcctgaattttttctatctgaatttcgtaagtccaccacaatctgatttaaatcccaaattcgagaacccgttgagaagtagctgcagaacagagaggaactgaaccgtgtgttgataatatggtagaagtgtcttgataattgttcgtttattgatgaaaagaatgtggcacaaattgcaggtaaccataggcgccatggagtgggggaaagtctacttggtggaagacgttgtgacggaggctgcagcctgcagtggatggaacaaagcgaaaaactggccacagacctgttgaaaatggctgctgaaaatctaggaaggttgaaacggagctgctcgtccaaatgcaggtcttcttctcttgcccgggaaactgg

SEQ ID NO: 2189 - DNA, 659 bp, Hordeum vulgare
cggcacgaggctccaccaaccacgagtcaaacccaccgcagcaaagggacagcggcggagatgtcgggccgtggcaagggaggaaaggggctcggaaagggcggcgccaagcgccaccggaaggtgctgcgcgacaacatccagggcatcaccaagccggccatccgtcgcctggcgcgccgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggtttcggcggttaggcccgccagatccgtcgcccgcggaaaccagattaggagctagcctctgtttaggattcatgttctgttgtggggtaattgcagtatctcgctgtcttgtttcctctgttctgctgtttggtgcatggacaaactgatcactgctggtttgctagaatggaatggaatggaaatttcacccttgaattcttatgcaatctcctagctctgctgatatcccggttctgtcgctctgtattatctttgtcctcaaattaattgaagggtgcttcagtgttcgatttgaa

SEQ ID NO: 2190 - DNA, 623 bp, Hordeum vulgare
gcgcattgtgttgtaccgggaatcggcattacggcgggatctcaccgcaccgccgcaacaaccacacacccacagaacccaagctcgccggagggagaagccgtcaaccatgtctggccgcggcaagggaggtaaggggctgggcaagggtggcgccaagcgccaccggaaggtgctccgcgacaacatccagggcatcaccaagccggccatccgtcgtctggctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcggcaggggcgaaccctctacggattcggcggctagtccgcgccgctccggtcggatccacctcgcggccgtcggattcgtagctagccatggttgttgttcagtgttcattgtcttgagtgtaacggaatggccgcatctcgctgctgtgtgttgtttcgatgtggtaccgctagcatggaatggaaatctcagcgctttatccctgaattcgccttcaatctattgctcttttgtt

SEQ ID NO: 2191 - DNA, 608 bp, Hordeum vulgare
cacgcgtccgacctcatctctccacctcacaaggataagtcaccctcaccggagagaagcgagaagatgtcgggccgcggcaagggaggcaaggggctcggcaagggcggcgccaagcgccaccggaaggtcctccgcgacaacatccagggcatcaccaagccggcgatccgtcgtctcgcgcgcaggggcggcgtgaagcgcatctcggggctcatctacgaggagacccggggcgtgctcaagatcttcctcgagaacgtcatccgcgacgccgtcacctacaccgagcacgcccgccgcaagaccgtcaccgccatggacgtcgtctacgcactcaagcgccaggggcgcaccctctacggcttcggaggctaggccaccaaccagatttagagagttctagggttcgtggtcgttggtgtaatggcagcatctcgctgttgtttgctgtcttctgtagaatcgaacggaatcgaatggaaattggtgtggattatgcctgaatttttcagcggtctaccattgtgttgcctgatcccccattctgtggctctattttgctgtctgcaaattgtcgaatgtaggagctcccggcttccgatttc

SEQ ID NO: 2192 - DNA, 552 bp, Hordeum vulgare
aaatccccaaatccttcttcttccccgggaaaaaacacggagctgcggagatgtctggccgcggcaagggcggcaaggggctcggcaagggcggagcgaagcgccaccggaaggtgctgcgcgacaacatccagggcatcacgaagccggcgatccggcggctggcgcgtcgtggtggcgtgaagcgcatctcggggctcatctacgaggagacccgcggcgtgctcaagatcttcctcgagaacgtcatccgcgacgccgtcacctacacggagcacgcgcgccgcaagaccgtcacggccatggacgtcgtctacgccctcaagcgccagggccgcaccctctacggcttcggcggctagggttttcctttccttcctcgtagaggcttgttttatcgagcgatgcctgggcatcctggtggtggtagtttggtgtcggatctggtgttcctgatgtaaccgtgctctgttgcagtgaagtgaatcctggtgtttatttcaagaacgccccttctaatcagagtaatccagaatgcgtgcgcttctcttt

SEQ ID NO: 2193 - DNA, 688 bp, Hordeum vulgare
cctcagaatccacatccgctcgcagctcgaagaggatcaatcgtcagccatgtccgggcgcggcaagggaggcaaggggctcggcaagggcggcgccaagcgccacaggaaggtcctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgtcgcaagaccgtcaccgccatggacgtcgtctacgcgctcaagcgccagggccgcaccctctacggcttcggcggctagggccgtcaggctttctcgcagcctgcagactcccgaagcttgatgaaaccacgacttgtgtggttcgctgttccctctgtagttcgaattgaatcttggagcaaagttaatcgcgtatgtcgttgaaaaggaaacttgtctctgtgcaatcggtgttcctgattttgtttcgctggtgggtggcgatgagttggtttgccataatttaccaggagcctcggatgaatcgtactacttgtttgcaggataatttgtaatgtgatgaaaacgccacagggactgaacaagcatttgctctgtttcaaaaaaaaaaaaaagggcggccgc

SEQ ID NO: 2194 - DNA, 685 bp, Hordeum vulgare
attcggcacgagggccacatccgctcgcagctccagatcgtcgtcagccatgtccgggcgcggcaagggaggcaaggggctcggcaagggcggcgccaagcgccacaggaaggtcctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgtcgcaagaccgtcaccgccatggacgtcgtctacgcgctcaagcgccagggccgcaccctctacggcttcggcggctagggccgcccgatggccgccagtgtctgtcgccgcctgcagatttcaaaagctcgatgaaaacctcgacgtgtttagttcagtatttcctctgtagttcgaactgaatcatggagcacatatcttgttggaaatgaaacctgtctctgtgcaactgctgtctttctaattttctcttgcttgttgctctctgttgggttgggtacgatattgaggtggagacgagttgatttgccatgatttaccaggagcctcggatgaatcgtacttgtttgcaggctaatttgtaatgtgaaaaaaacgccacagggactgaacaagcatttg

SEQ ID NO: 2195 - DNA, 601 bp, Hordeum vulgare
gccgccgctcctcgtccatctccatctcagtcagctccaagggaggaggccgtcagccatgtccggccgcggcaagggagggaagggcctcggcaagggcggcgccaagcgccaccggaaggtcctccgcgacaacatccagggcatcaccaagccggccatccggcgtttggcccggcgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggattcggcggctgacctgcgcccgccgctgctccatcgagccgactctgcttgctgctgctgctgttcttgtgctatggtttcctttctgaattccgagtgcgcgcgtgcgttgttgttccgtcggtctgtgtagttagcggcaaggcgatggatgtgaatgcagtcagttcgtcagagtgcgtgtgttgtagccagttcctcaatgcaaggtgatgaacatgaatgcaatgggattgttggttc

SEQ ID NO: 2196 - DNA, 620 bp, Hordeum vulgare
cggcacgaggcgcagccgccgctcctcgtccatctccatctcagtcagctccaagggaggaggccgtcagccatgtccggccgcggcaagggagggaagggcctcggcaagggcggcgccaagcgccaccggaaggtcctccgcgacaacatccagggcatcaccaagccggccatccggcgtttggcccggcgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggattcggcggctgacctgcgcccgccgctgctccatcgagccgactctgcttgctgctgctgctgttcttgtgctatggtttcctttctgaattccgagtgcgcgcgtgcgttgttgttccgtcggtctgtgtagttagcggcaaggcgatggatgtgaatgcagtcagttcgtcagagtgcgtgtgttgtagccagttcctcaatgcaaggtgatgaacatgaatgcaatgggattgttggttctctct

SEQ ID NO: 2197 - DNA, 1368 bp, Hordeum vulgare
actcatctcttccacccaccaaatccccgctccaaaatccccaaatcccacccactcacctcccaagccactcggagcaggcagccatgtcggggcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggcggctgaagagccgcggcgctggctgaccgtggcgcacaagccctggctcgcggtcaagaaactgccggaggggagaaatctgtagttcatctaggtcctgtgccttgtatgcttggtagtaggaccctatgtttagtagtttgcttccgtgttctgaacctgatgggcaaatactgtgtttgccgagttgtatggttccagagttaacaaaattgtccttctgttatgaaattatgctaccgactacgctgttcttgtttaaaaaaaaaaaaaaaaataaaacctcccaagcaatcctcaccccgcgccccagcaaagcaagtcctcccgccccgatggcccgcacgaagcagacggcgaggaagtccaccggcggcaaggccccgcggaagcagctggcgacgaaggcggcccgcaagtccgcgccggccaccggcggcgtgaagaagccgcaccgcttccgccccggcaccgtcgcgctccgggagatccgcaagtaccagaagagcacggagctgctcatccggaagctccccttccagcgcctggtgcgtgagatcgcgcaggacttcaagaccgacctccgcttccagagctccgccgtctccgcgctccaggaggccgacgaggcctaacctcgcgggcttttcaagggccccaacctttgggccatccacgccaagcgcgtagccatcatgcccaaggacatccaactcgcccgccgcatccctggcgagagggccctagctccttccttggttcccagcgtcggatcttggtccccgaggggagaaaaatgttttgggtttctagataggtccggccctgttggttgttgcaatccgtctgttgtggccctaccggggtcctatgttttgggatgcccccaccctgtggtgtcgaacaacaaagggcgaagttcgtcccttttttttttttccctcgccataacacaatctggacaaaagcccgggcg

SEQ ID NO: 2198 - DNA, 776 bp, Hordeum vulgare
cggcacgaggcccacctccaaagacatattcaccggagagaagaagagagaagcgagaagatgtcgggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggcttcggaggctaggccgtcaaccagatttagattgttctagggtcgactgctcgttgatgtaatcgcagcatctcgctgttgtttgctgtcttctatagaatctaatggaatcgaatggaaattggtgtggattatgcctgaatttttcagcggtcccttgcattaaccaaaattataggaaaaagacctcaaggggggggccccggtaccccaattcggcccctaaagtaaagtccgtttttacaaatatcaatgggcccttcggatttaaaaaacgtatggtgaaattgggaaaaaaacccatggtgctgtttcccccaactttaaattcggcttgggcatcggacaatcccccctttttcaccagaatgtgggcgtatatatccaaaaaaaggccccgcaacctaaataccccc

SEQ ID NO: 2199 - DNA, 526 bp, Hordeum vulgare
ggggatcagccacagcagcaacccacctccaaagacatattcaccggagagaagaagagagaagcgagaagatgtcgggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggcttcggaggctaggccgtcaaccagatttagattgttctagggtcgactgctcgttgatgtaatcgcagcatctcgctgttgtttgctgtcttctatagaatctaatggaatcgaatggaaattggtgtggattatgcctgaatttttcagcggtc

SEQ ID NO: 2200 - DNA, 706 bp, Hordeum vulgare
gttctagggcgcttccagccaccaagccccgctccaaaatccccaaattctcccccctctcttccaagcagcagccatgtcgggtcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtgtacgcgctcaagcgccagggccgcaccctctacggcttcggcggctgaagagccgcggcgccggtgctggctggccggccgtggcgcacatgccatggctcgcggtcaagaaattgcttgagaggagaaagctgtagtagatctggattctatgccttctatgcttagtagtaatatgcgttgtagtagcggccgtagagttggctgtttaatgtttgcttacgtgttctgaatttctgatgggcaaatactgtgtttgccgagttatatgaatccagagttgacaaaaattgtactcctgcagatccaaaactatgaattattgctaatgacgatggtgttttgtccttctgccaaaaaaaaaaa

SEQ ID NO: 2201 - DNA, 588 bp, Hordeum vulgare
cggacgaggacatctccatctcagtcagctccaagggaggaagccgtcagccatgtccggtcgcggcaagggagggaagggccttggcaagggcggcgccaagcgccaccggaaggtgctgcgcgacaacatccagggcatcaccaagccggccatccggcgcctggctcgccggggcggcgtgaagcgcatctcggggctgatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggcggctgacccgcgcccgctgctgccccctcttgtcgaccctgctagcggctgctgctgttcggtgctatggtttcgtttctgtatgcgtgcgttgttgttccatcggtcagtgtagttagtggaaggctatggatctgaatgcaatggaattgttggttcttgcaagaaatgaatttgaatgcattcgaatttgtactgcatctcatgatccgactgtacctcctggcttg

SEQ ID NO: 2202 - DNA, 935 bp, Hordeum vulgare
cctctgcttcgctgatccgatgattcatgataactcgacggatcgcatggcctttgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctagcagcagccgccaccaccgctcctcctccgctcccatccaagatccattcaactccatctgctcggggctccaccatcatgtccggccgcggcaagggcgggaagggtctgggcaagggcggcgccaagcgccaccggaaggtgctgcgggacaacatccagggcatcacgaagccggcgatccggcggctggcgcggcggggtggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgacagggccgcaccctctacggcttcggcggctgatctgctgctgctgctccgtccagtctccgccggctgctgtcccatcagccggagtgcgcgtgttgttccgtcggtctgtgtagtagtggagtatgaatgcaatgaaatcagtcttggatgcatctctcgatatgtttctgtgagcttgttaaattcttcccagcaagaaaggttagggaatgatgtagctgaggtaaacgtcggatattcatgaaacaatcacaggaaactgctacaggtgtt

SEQ ID NO: 2203 - DNA, 659 bp, Hordeum vulgare
gccaccaagccccgctccaaaatccccaaatcctcccccctctcttccaagcagcagccatgtcgggtcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtgtacgcgctcaagcgccagggccgcaccctctacggcttcggcggctgaagagccgcggcgccggtgctggctggcggccggccgtggcgcacatgccatggctcgcggtcaagaaattgctggagaggagaaagctgtagtagatctgggctctatgccttctatgcttagtacgtagtattatatgcgttgtagtagcggccgtagagatgtctgtttaatgttcgcttccgtgttctgaatttctgatgggcaaatactgtgtttgccgagttatatgaatccagagttgacaaaaattgtactcctgcagatccaaaactatgaattattgct

SEQ ID NO: 2204 - DNA, 852 bp, Hordeum vulgare
ggacgccaccaccgccgctcgtcccagttccacacccgctcgcagctggaaccagggagagatcgtcagccatgtccgggcgcggcaagggaggcaagggtctgggcaagggcggcgccaagcgccaccggaaggtgctgcgcgacaacatccagggcatcaccaagccggccatccgtcgcctggcgaggaggggcggcgtgaagcgcatctcggggctcatctacgaggagacccgcggcgtcctcaagatcttcctcgagaacgtcatacgcgacgccgtcacctacaccgagcacgcccgccgcaagaccgtcaccgccatggacgtcgtctacgcgctcaagcgccagggacgcaccctctacggattcggcggctaggcctaggcgtccatctgcgcccgcagcccgtcgcctcctcgccgtccgcagtccgcaccgccgtcggccaacaactctgccccgccgtggccgcaggcgcgaagaaacagccatgtcttttgttcagtagcagtcgtatccggagcaatgttactacctgttctcccattagcccatcgcagaattcctctagtgagcatgtagctccatgagcccagttgtggaatcgaatgtaccgtcttcctgcccgtgcgaacaaatgcttccaagattcgtgaaaaggttggggtttcaaaaaaaaaaaaaacaaacccggaggggagggcccgtgccccaatacacccttatgaggagagcgattaaacattaacatggcccgtgattttaaacaagaagagtctagggaaaagacctggggggtagaccactataagccgcctgggagaaaaacccgctttgagcaagtggg

SEQ ID NO: 2205 - DNA, 542 bp, Hordeum vulgare
gatcacaagcttcaacatccgcgccactcccttcttctcccaaatccagcgacgatgtcagggcgcggcaagggcggcaaggggctgggaaagggcggcgccaagcgccatcggaaggtcctccgcgacaacatccagggcatcaccaagccggcgatccggaggcttgccaggaggggcggcgtcaagcgcatctccggcctcatctacgaggagacccgcggcgtcctcaagatcttcctcgagaacgtcatccgcgacgccgtcacctacaccgagcacgctcgccgcaagaccgtcaccgccatggacgttgtctacgcgctcaagcgccagggccgcaccctctacggcttcggaggctagatccgttgcgtagtggagcaacttcctcgtttgctctctgtgatctgtgctgtggtggatgagatttactgattttgtgtgcgtcgttgtgttctgccttgggttcagtaggctgtgtaataccatgttctgttcaatgcaatcagttcggttctgaatcctgacgaaatgcttca

SEQ ID NO: 2206 - DNA, 570 bp, Hordeum vulgare
ctacagcccccaaaggagttcctcttcttcctaaccacacactctctcggagctgagcggagcgaagcggcgatgtcagggcgcggcaagggcggcaaggggctgggcaagggcggcgccaagcgccaccggaaggtcctccgcgacaacatccagggcatcaccaagccggcgatccggaggctggccaggaggggcggcgtcaagcgcatctccggcctcatctacgaggagacccgcggcgtcctcaagatcttccttgagaacgtcatccgtgacgccgtcacctacaccgagcacgcccgccgcaagaccgtcaccgccatggatgtcgtctacgcactcaagcgccagggccgcaccctctacggcttcggaggctagattcctgccgtgttgtgctggtggaggtcgtgttacctgtgtgatatgtgccgtggttgatgtgatttacttctctgtcgtgcgtttgtgctcagtacgctgtagtaacagtatgcgttcaatgagtgtaccccgatcccgaattctgatgaaactcttcagttatgaatcgtgttaccgtttttc

SEQ ID NO: 2207 - DNA, 556 bp, Hordeum vulgare
ccaccataacacacgccagccaagtcaagagaagaagctcgccggagagagaagaagcgtcggcgatgtccggccgcggcaagggagggaaagggctgggcaagggcggcgccaagcgccaccgaaaggtcctccgcgacaacatccaggggatcacgaagccggcgattcggcggctggcgcggcggggcggagtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggcttatcgcgccggtccagtcgaatccacctcgcgccgccacctatgcttgttcggtgtttactgtcttcattgtaacggccgcatctcgctgctcttgttcagtgttcagtgttcagtgtttcgatgtagtactatgatagaatggaaatcgcagcattttacccgcgaaaaaaaaaa

SEQ ID NO: 2208 - DNA, 613 bp, Hordeum vulgare
cccccaaatccatccgatttccatctccaagaaagcaagccgtcgaggatgtccggccgcggcaagggcgggaaggggctgggcaagggcggcgccaagcgccaccggaaggtgctgcgggacaacatccagggcatcaccaagccggccatccgccgcctggcgcggcgtggcggcgtgaagcgcatctcgggactgatctacgaggagacccggggcgtgctgaagatcttcctcgagaacgtcatccgcgacgccgtcacctacactgagcacgcccgccgcaagaccgtcaccgccatggacgtcgtctacgcgctcaagcgacagggccgcaccctctacggcttcggtggctaggcccccctgctccgtccggtcactgctcccgctgtcccatctgtccgagcgcgtgcgtgtgttgatccgtcgctgggtttggtctgtgtagttagtacaaggcgatgtgtatgaatgcaatgaggaatcatgcaatcagcgtttatgttatcttggctgcatctctgtcagtacattctaggtcctactcttctgcttttttactgatgggtgtgtgattcagtgacgctgtatttgcttaattcagtttttt

SEQ ID NO: 2209 - DNA, 609 bp, Hordeum vulgare
cggcacgaggcacaccgcagctcctcctccattcccaaactccgtcaaccatgtccggccgcggcaagggcgggaagggcctgggcaagggcggcgcgaagcgccaccggaaggtgctgcgggacaacatccagggcatcaccaagccggccatccgtcggctggcgcggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggattcggcggctgatctgctagctgctgctgctccggcaagtccctgctagctgcctgtgttccggtgctatgtggttttcttctgagttcgtgcgtcgttgttccatcggtctgtgtagttatcgaatatgaatggaattgaatcaatgttcctgtggtatcatcttggctgcgtctctcgatatgttcctatttagtcactaccaatttgtgacatcctgattcttctcggcaatgaagttggcgcactgattgtgggg

SEQ ID NO: 2210 - DNA, 638 bp, Hordeum vulgare
gcgcgcattgtgtaggtaccgggaatcggccattacggccggggatacagcaccagtctccaccaccgttcctcagaatccacatccgctcgcagctcgaagagcatcaatcgtcagccatgtccggccgcggcaagggaggcaaggggctcggcaagggcggagccaagcgccacaggaaggtgctccgcgacaacatccagggcatcaccaagccggcgatccggcgtctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctagggccgtcaggctttgtcgccgcctgcaggttcccgaagcttgatgaaaccacgacttctgtggttcgctattcctgattctgtagttcgaactgaatcgtggaacaaaattaatcgcgtatgtcgttggaaaggaaacttgtctctgtgcaatcggtgttcctgattttgtttcgctggtgggtggcgatgagttggtttgccataa

SEQ ID NO: 2211 - DNA, 618 bp, Hordeum vulgare
cggcacgaggaccaccgctcctcatccattcccatctcagtcagctccaaggaaggaagccgacaaccatgtccggccgcggcaagggcgggaagggcctcggcaagggcggcgccaagcgccaccggaaggtgctgcgggacaacatccagggcatcaccaagccggccatccggcggctggcgcgtcgtggcggcgtgaagcgcatctcggggctcatctacgaggagacccgcggtgtgctcaagatcttcctcgagaacgtcatccgcgacgccgtcacctacaccgagcacgcccgccgcaagaccgtcaccgccatggacgtcgtctacgcgctcaagcgacaggggcgcaccctctacggcttcggcggctgacctgcacctgctgccccgtcgagtgaactccgctagctgctgctgctgttcttgtgatatggtttcgtttctgagtgcgtgcgttgttgttccatgtgcctgtgtagttagtggaaggcaatggatctgaatgcagtcagttcgttagagtgcgtgtgtctgtctctgtactctgtagccagttcttcaatggaatgtgatgaatatgaatgcaatggaattgttggttctctcaaaa

SEQ ID NO: 2212 - DNA, 563 bp, Hordeum vulgare
ccaccgctcctcctccattttcttccagttccatcagctccaaggaaaccatgtccggccgcggcaagggcgggaagggcctcggcaagggcggcgccaagcgtcaccggaaggtgctccgggacaacatccagggcatcaccaaaccggccatccgccgtctggctcgccgtggcggcgtgaagcgcatctcggggctgatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggacgcaccctctacggcttcggcggctaggccgcgccggtccaggcgaatccacctcgcgcctccagatcagtgtagctagctatggttgttgttcagcgttcattttattcagtgctatggctgcatctcgctgctgttcagtgttctgtgtttggatgtacccctgaactcgtcagtaatctatggctctgtcgatgtgtgttcagagattaccagtgcgttcttcat

SEQ ID NO: 2213 - DNA, 491 bp, Ocimum basilicum
attaacattctcatctgtcaaatttcaacttcatcaaaatgtctgggcgcggcaaaggaggcaagggtttgggaaagggtggagcgaaacgacaccgtaaggtgctgagggacaacattcaggggatcacgaagccagctatccgtcgattggctcgccgaggtggcgtcaagcgcattagcggtctcatctacgaagagacgcgcggtgttctcaagatctttttggagaacgttattcgtgatgctgttacctatactgagcacgctcgccgcaaaaccgtcactgccatggatgtcgtgtatgctctcaagaggcaggggcgtactctctacggctttggcggctaagctattgggttttagatgtaactgaaatggcctgctcttgtagaattagggcgcttaaatgctggcttttttagatgtaattttagttgaaatttaatgcatttttaatgtctgtcgattatatatgaaattgcctcgtgc

SEQ ID NO: 2214 - DNA, 505 bp, Ocimum basilicum
taacatttacttccattaacattctcatctgtcaaatttcaacttcatcaaaatgtctgggcgcggcaaaggaggcaagggtttgggaaagggtggagcgaaacgacaccgtaaggtgctgagggacaacattcaggggatcacgaagccagctatccgtcgattggctcgccgaggtggcgtcaagcgcattagcggtctcatctacgaagagacgcgcggtgttctcaagatctttttggagaacgttattcgtgatgctgttacctatactgagcacgctcgccgcaaaaccgtcactgccatggatgtcgtgtatgctctcaagaggcaggggcgtactctctacggctttggcggctaagctattgggttttagatgtaactgaaatggcctgctcttgtagaattagggcgcttaaatgctggcttttttagatgtaattttagttgaaatttaatgcatttttaatgtctgtcgattatatatgaaattgcctcgtgc

SEQ ID NO: 2215 - DNA, 752 bp, Phaseolus coccineus
agtgcccattatggccggggacaacaacacgcatagcttcttctccctgcaactctccaacacagaatttgattcggcttggtcaaggttgtgctcagcaagatgtctggtcgtggaaagggtggcaagggattgggaaagggaggagcgaaacgacaccgtaaggttcttcgcgataacattcagggaataacgaagccagcgattcggcgattggctcgcaggggtggcgtgaagcgtatcagcggtttgatttacgaggagactcgtggggttctcaagatctttttggagaacgtgattcgtgacgccgttacctacacggagcacgcaaggaggaagaccgttacggctatggatgttgtgtatgctctgaagaggcagggaaggaccctctacggatttgggggttagggttttggtttgtacggtcgcttgattttcctcgttggggaaaagtcttgctgtcaagaaaaaaatggcagggattgaaattaggttttggttttttctctgtagctgaaagggaaaaacctagttgtgattatcagatttatgttttgtgcaataggtattttacttggtttgtttgatcatgtgatgtgatgtaactagctttcttgagatttagaattttatctgatttcagttcccagttcactgcatctccaattacatctgtcactcaattttctgcgtttcactttggaatgctatgttgtctaacatagttttgaagaaatcgaattctg

SEQ ID NO: 2216 - DNA, 638 bp, Phaseolus coccineus
tggccgggggagacgcaattctcctaatcagcttctccttcgattgtgattgtttgttgttgtcaacgcgattttgcgaacaagatgtctgggcgtggaaagggaggcaagggtttgggaaagggaggagccaaacgacaccgtaaggtgttgcgcgataacatccagggaattacgaagcctgccattcggcgtttggcgcgtaggggtggcgtgaagcgtatcagtggtctcatctacgaagagactcgcggcgttctcaagatctttcttgagaacgtgattcgcgacgccgttacttacactgagcacgccaggagaaagaccgttacggcaatggacgtggtctatgcactgaaaagacagggaagaaccctgtatggatttgggggctaggttttttagtttcttgctttcttgttaggctatgggactgcttgaagcccttggcattaggaaatttagtgatgaagtacaaatttgtaaggttggctctgttagggttccggtggtgttttaggaatggtggctacagtaacatgaattgtactgatgtatcttacttgttgttactgcctattctgtaatttaatctttttcctcttggatattaaagtgttcttctgttcattgcttca

SEQ ID NO: 2217 - DNA, 667 bp, Phaseolus coccineus
aagcagtggtatcaacgcagagtgttcctattatggccggggatcgcaactgaattcaaaactacaaatccctaaatccgagtttgtagcaaaactgtactgagaaaatgtcaggtcgtggaaaaggtggcaagggtttgggcaagggaggggcaaagaggcacaggaaggtgcttcgcgataacatccagggaataaccaagcctgccattcgtagattggcaagaagaggtggcgtgaagaggatcagcggtttgatctatgaggagactagaggtgttctcaagattttcttggagaatgtaattcgtgatgcagttacctacactgagcatgctaggaggaagactgttactgctatggatgttgtttatgcactcaagagacaaggaaggactctctacggtttcggaggctgaaaaattcttagatctattacattgtgttttagagtgaaacttcttgttctgctaatttcatgtgatgtttagcttcatggatacctgtaaactttggtcgtattctgttcaggtatgaatgagacctgtgcaagttcaattgaagtcaaacgaaggatattgttttgttcatgttgtggcgtaaacatttattctctagatttagttgtcgagaatgaaagtataatattttaactctttctgtgccg

SEQ ID NO: 2218 - DNA, 580 bp, Phaseolus coccineus
tggccggggatcaaatcgaaatccctaatttctcagttcttcagaaaatcccaattcgaatttcaactgaacaatgtcgggtcgtggaaagggaggcaagggtttgggaaagggaggcgcgaagaggcatcgcaaggtgctccgcgacaacatccagggcatcacgaagcccgctattcggaggttggcgaggagaggcggcgtgaagagaatcagtgggttgatctacgaagagactcgcggagttctcaagatctttctggagaacgtgattcgtgatgcggtgacgtacacggagcacgcgaggagaaagactgtgacggccatggatgtcgtttacgcgctcaagaggcagggaaggactctctatggattcggaggttaagggattaggtttttgggcctattggcttggattctgtcttgttcgctttcgttttgtaaatgtaagcaatctgtgatatctgcaatttgtgatgtactgcttcatagggatgatgtaatcaagtttctcatgttattcttattctccttttaattgcaagcttatcagttgaattagaacaaatttgctgaaaaa

SEQ ID NO: 2219 - DNA, 583 bp, Phaseolus coccineus
gggccaagttatttttctttcatattcagttccgtattagagacaaaagaaaaatcatcagccatgtctggaagaggaaagggtggcaaggggctcggaaaaggaggtgcgaaacgtcaccgtaaggttctgagggataacattcagggaatcaccaagcccgcgattcgccgtctcgcaagacgtggtggcgttaaacgtatcagtggtcttatctacgaagaaacccgtggtgttctcaagatctttctcgagaacgtgattcgcgacgctgtcacctataccgagcacgctcgccgcaagaccgtcaccgccatggacgttgtctacgccctcaagaggcagggcaggaccctctacggtttcggtggatagaaaattggggatttctgcaatgcctcgggaattagggtttcttataatgtcaatttcgctgttgatattgaaattagttcttctgctatagcttagtgtttcaagaattgttcttgtttggctttgagtagtagctctgagaattattaatggtaatcagaatgatttggacatttttcaagcaaaaacattgtgtagttatgttttc

SEQ ID NO: 2220 - DNA, 590 bp, Phaseolus coccineus
tggccggggattcaaatccagaaaccaaaccaaaaaccctaaatcttcaaattcgatcgaaatctttctctggagtctccttcttccaatccaatctagaagaaaaccttaaatcctgagtttggatcgatttttgcctgaaaagctgttgagaaaatgtctggtcgtgggaagggaggaaagggattgggcaagggaggtgcgaagaggcacaggaaagtgcttcgcgacaacattcagggcataacgaaaccggcaattcggcgattggcgagaagaggtggtgtgaagaggatcagtggattgatctacgaggagacgaggggagtgctgaagatattcttggagaatgtgattcgcgacgctgtgacctataccgagcacgccaggaggaagacggttacggccatggacgttgtgtatgcgctgaagaggcagggaagaaccctctatggttttggaggttgatcttttaaattctgtagtcacatcacaaatactttgcttttttcgtaatccttgttatgcttcgtaacaaacaaagttactgggttctgttgaatgaaaaaaataaagaacatcaattgagt

SEQ ID NO: 2221 - DNA, 678 bp, Phaseolus coccineus
aaatcctcaagttcgataaaaatctttctctggagtctccttcttccaatccaaactagaagaaaaccctaaatcctgagattggatcgattttgcgcggaaaggtgttgagaaaatgtctggtcgtgggaagggaggaaagggattgggcaagggaggtgcgaagaggcacaggaaagtgcttcgcgacaacattcagggcataacgaaaccggcaattcggcgattggcgagaagaggtggtgtgaagaggatcagtggattgatctacgaggagaccaggggagtgctcaagatattcttggagaatgtgattcgcgacgctgtgacctataccgagcacgccaggaggaagacggttacggccatggacgttgtgtatgcgctgaagaggcagggaagaaccctctatggttttggaggttgatcttttgaattctgttgtcacatcacaaatacttgtttttttcgaatccttgctatgttccgtaacaaaaaaagttactgggttctcagtagaatgaaaagaatgaagaacatcaattgagttaaatgtagtaattttttttgttgggtttaacttttctttttactgtttttgtgtagttctatttgatctagtttgtattatgataatatatgtaataaaaatattaaaatgctgatcaattttgcttt

SEQ ID NO: 2222 - DNA, 580 bp, Phaseolus coccineus
tggccggggatacttcaatctcctcatcaaccttctccttcgattgtgattgttgttgttgacgcgattttgcaagcaagatgtctgggcgtggaaagggaggcaagggtttgggaaagggaggagccaaacgacaccgtaaggttttgcgcgacaacatccagggaattacgaagcctgccattcggcgtttggcgcgtaggggtggcgtgaagcgtatcagtggtctcatctacgaagagactcgcggcgttctcaagatctttctcgagaacgtgattcgcgacgccgttacttacactgagcacgccaggagaaagaccgttacggcaatggatgtggtctatgcactcaagagacagggaagaaccctgtacggatttgggggctaggtttttttcttttcttgcttccttgttagtgataaagtacaaatttgaaaggttgtatttgttaaaaattccggtggtgttttaggaatgatgtctgcaatatcatgaattgaactgatgtatcttcccttctattgccgcgaaattgtaatttaatctttgtatgttgaatatcgccatcttccttt

SEQ ID NO: 2223 - DNA, 563 bp, Phaseolus coccineus
tggccggggaagcagtcgtatcaacccagagtgaccattatggccggggaattcgaaactgttagaaacggaaggagaggaagaagaagaagagaaagaggagtgtaaagatgtctggtcgtggaaagggagggaaaggtttgggaaagggaggagccaagaggcacaggaaagttcttcgtgataacattcagggaattaccaaacctgccattcgccgtttggctcgcagaggcggtgttaagagaatcagtggtctcatctacgaggaaactcgcggtgtcctcaagatcttccttgagaatgttattcgtgatgctgttacctacactgagcacgctaggaggaagactgttactgccatggacgttgtttacgccctcaagaggcaaggcaggactctctacggttttggtggttgattctcctcttctaagttagggttttaacgggaatcaatgtatattgtggtttcttatgattatgtgatttgttcttagttgtaactgattttattttcttcaattgaaatgagcaatgtggatgaattaaaagtttagctg

SEQ ID NO: 2224 - DNA, 645 bp, Phaseolus coccineus
cgcggggattgcaattgaattgaattcaaaactacaaatccctaaatccgagttagtagccaaactgtactgagaaaatgtcaggtcgtggaaaaggtggaaagggtttgggcaagggaggggccaagaggcacaggaaggtgcttcgcgataacatccagggaataaccaagcctgccattcgtaggttggcaagaagaggtggcgtcaagaggatcagcggtttgatatatgaggagaccagaggtgttctcaaaatcttcttggagaatgtaattcgtgatgcagttacctacactgagcatgctaggaggaagactgttactgctatggatgttgtttatgcactcaaaagacaaggaaggactctctacggtttcggaggatgaagaattgttagatctattacattgtgtttcagagtaaaacttcttgttctgctaatttcatgtgatgtttagcttcatggatacctgtaaactttggtcatattctgttcaggtatgaacgagacctgtgcaagttcaattgaagttaaacgaagggtattgttttgttcatgttgtggcgtaaagatttattctctatatttagttgtcaagaacgaaagtataatattgatctatttttattccaaaaaaaaaa

SEQ ID NO: 2225 - DNA, 577 bp, Phaseolus coccineus
cgattgtgattgttgttgttgacgcgattttgcaagcaagatgtctgggcgtggaaagggaggcaagggtttgggaaagggaggagcgaaacgacaccgtaaggtgttgcgcgacaacatccagggaattacgaagcctgccattcggcgtttggcgcgtaggggtggcgtgaagcgtatcagtggtctcatctacgaagagactcgcggggttctcaagatctttcttgagaacgtgattcgcgacgccgttacttacactgagcacgccaggagaaagaccgttacggcaatggatgtggtctatgcactcaagagacagggaagaaccctgtacggatttgggggctaggtttttttcttttcttgctttcttgttaggttctgtttggttggtttagaggctatgggactgcttgaagctatggcattaggaaatttagtgataaagtacaaatttgaaaggttgtatttgttaaaaattccggtggtgttttaggaatgatgtctgcaatatcatgaattgaactgatgtatcattccttctattgccgcgaaattgtaatttaatctttgt

SEQ ID NO: 2226 - DNA, 533 bp, Phaseolus coccineus
gattgcattttgaatctgaaacctcaaatccctaaattcgagtttgttggaaagttctttgaaaaatgtctggccgtggaaaaggtggtaagggtttgggaaagggaggcgccaagagacacagaaaggtgctccgcgataacattcagggcatcacaaaacctgcaattcgtagattggccagaagaggtggcgtcaagagaatcagcggtttgatctatgaggaaactagaggtgtgctcaagatattcttggagaacgtgattcgagatgcagtgacttacaccgagcacgcaaggaggaagactgtaactgcaatggatgttgtttatgcgctcaagaggcagggaaggactctctacggatttggaggctgaacagttctttcttttgttttcctatggttcctttcttatgaatgtttctagttttagggttctatttttgtaatagggacttgtttggttttactaggtctgatacataatgtgaaacgtttgaaattatatggattaacattctctttgttggaa

SEQ ID NO: 2227 - DNA, 525 bp, Phaseolus coccineus
ttgtgattgttgttgttgttaacgcgattttgcaagcaagatgtctgggcgtggaaagggaggcaagggtttgggaaagggaggagcgaaacgacaccgtaaggtgttgcgggataacatccagggaataacgaagcctgctattcgtcgtttggcgcgtaggggtggcgtgaagcgtatcagtggtctcatctacgaagagactcgtggcgtcctcaagatctttcttgagaacgtgattcgcgacgccgttacttacactgagcacgccaggagaaagaccgtcacggcaatggatgtggtctatgcactcaagagacagggaagaaccctttacggatttgggggctaggttttttcttttcttgcttttttgttaggtttcgtttgtttggtttagaggctatgggaatgcttgaagctctggcattcgaaaatttagtgataaagtaaaaatttgaaaggttggatttgttaaaaattccggtggtgttttaggaatgatggctgcaatatcatgaattg

SEQ ID NO: 2228 - DNA, 630 bp, Brachypodium distachyon
gccacctccaattccaatctcttctctcgcgcagctccgaggcaaaaaggggatcagcagccatgtccggacgcggcaagggcgggaaggggctcggcaagggcggcgccaagcgccaccggaaggttctccgcgacaacattcagggcatcaccaagccggcgatccggcgcctggcgaggagaggcggcgtgaagcgaatctccgggctcatctacgaggagacccgcggcgtcctcaagatcttcctcgagaacgtcatccgcgacgccgtcacctacaccgagcacgcacgccgcaagaccgtcactgccatggacgtcgtctacgccctcaagcgccagggccgcaccctctacggcttcggcggctaatccggtgccccgattcgacccccgcctgcagtgttctgatgtttgtgccgccgtgctcacgagtcttgcggtcaagaaatcgtagatggaaccacattgtttagtttcctgtctatcgtcagtaggtttgtctgaatcgtgcaattgtggaacaaaatttgtgctcgatggaaatggaaatcagatttgtttctgtgcaaatactgcgattgctattttcccttgagtacgattgaatttggatctgcatttgagc

SEQ ID NO: 2229 - DNA, 536 bp, Brachypodium distachyon
gcagctccgaggcaaaaaggggatcagcagccatgtccggacgcggcaagggcgggaaggggctcggcaagggcggcgccaagcgccaccggaaggttctccgcgacaacattcagggcatcaccaagccggcgatccggcgcctggcgaggagaggcggcgtgaagcgaatctccgggctcatctacgaggagacccgcggcgtcctcaagatcttcctcgagaacgtcatccgcgacgccgtcacctacaccgagcacgcacgccgcaagaccgtcactgccatggacgtcgtctacgccctcaagcgccagggccgcaccctctacggcttcggcggctaatccggtgccccgattcgacccccgcctgcagtgttctgatgtttgtgccgccgtgctcacgagtcttgcggtcaagaaatcgtagatggaaccacattgtttagtttcctgtctatcgtcagtaggtttgtctgaatcgtgcaattgtggaacaaaatttgtgctcgatggaaatggaaatcagatttgttt

SEQ ID NO: 2230 - DNA, 620 bp, Brachypodium distachyon
atcatcaaatccccaaatcggcaattccccttccccgcagctaacagatcccccctcgaaccagctccccaaagcacagcagccatgtcgggccgcggcaagggaggcaagggcctgggcaagggcggcgcgaagcggcaccggaaggtgctccgggacaacatccagggcatcacgaagccggcgatcaggaggctggcgcggcgtggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggacgcaccctctacggcttcggaggctgagcggcagggcggcctgctgggttgtgctaggatctagggttgcgatggagttctgcggtagcttatgctgtcctgtttgtgtagtagtagctgtgctgtgtaatgggttcaacttcgaactggaaacagatgtggttatttctttctgattattactccgtactgtgctgtactgttcgacaactcaaccatcttgatttactgacgattttctttgccttctg

SEQ ID NO: 2231 - DNA, 320 bp, Brachypodium distachyon
cagccatgtcgggccgcggcaagggaggcaagggcctgggcaagggcggcgcgaagcggcaccggaaggtgctccgggacaacatccagggcatcacgaagccggcgatcaggaggctggcgcggcgtggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggacgcaccctctacggcttcggaggctgagcg

SEQ ID NO: 2232 - DNA, 576 bp, Brachypodium distachyon
atcccaccaaatccaagcaccagtacccagccacctcctctctcgcgcagctccgaagcaaaaggggatcagcagccatgtctggccgcggcaagggagggaaggggctcggcaagggcggcgccaagcgccacaggaaggtcctccgcgacaacatccagggcatcaccaagccggcgatccggcgcctggcgaggaggggcggcgtgaagcgcatctccgggctcatctacgaggagacccgcggcgtcctcaagatcttcctcgagaacgtcatccgcgacgccgtcacctacaccgagcacgcgcgccgtaagaccgtcaccgccatggacgtcgtctacgccctcaagcgccagggccgcaccctctacggcttcggcggctaatcgtccctcccgcccaatcgtccgtgttgcctcgccatggcccccaccggtctcgcagaggcgaaactgctgtttatttgccaagtttgttcattcagtactagttgtaggttgaacaatgcagcttgtagctctatatgagcccagatttggaattcgaaatcaaatatattgtctagtcgagaaa

SEQ ID NO: 2233 - DNA, 362 bp, Brachypodium distachyon
ccacctcctctctcgcgcagctccgaagcaaaaggggatcagcagccatgtctggccgcggcaagggagggaaggggctcggcaagggcggcgccaagcgccacaggaaggtcctccgcgacaacatccagggcatcaccaagccggcgatccggcgcctggcgaggaggggcggcgtgaagcgcatctccgggctcatctacgaggagacccgcggcgtcctcaagatcttcctcgagaacgtcatccgcgacgccgtcacctacaccgagcacgcgcgccgtaagaccgtcaccgccatggacgtcgtctacgccctcaagcgccagggccgcaccctctacggcttcggcggctaatcg

SEQ ID NO: 2234 - DNA, 659 bp, Brachypodium distachyon
atccacccaccaccgcagagcatctacaaccgcaaacacagccagatcacaagaaagggagaggagagaagcttcagcggcggcggcgatgtctggaagaggcaagggagggaaggggctcggcaagggcggagccaagcggcaccggaaggtgctgcgcgacaacatccagggcatcaccaagccggcgatccggcgtctggcgcgcaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgcgatggacgtcgtctacgcgctcaagcgccagggacgcaccctctacggcttcggcggctaggccgggcgatctgaggctccaccaccagaagatgctaggcgttatttaggctttgtggtactcattgtaatagctctcctttgcagttgttttgctcctgtccaccttgatgttgggagtggtatgagcgatggttcgtcagaagtcatggtcagaatagtaaatcgcagtcgtttggctcttgtcctcctgtttggagtgtcatgagctatggttcgtcaaattaaatgagctaataggaattctcagtggtttgaca

SEQ ID NO: 2235 - DNA, 642 bp, Brachypodium distachyon
cagagcatctacaaccgcaaacacagccagatcacaagaaagggagaggagagaagcttcagcggcggcggcgatgtctggaagaggcaagggagggaaggggctcggcaagggcggagccaagcggcaccggaaggtgctgcgcgacaacatccagggcatcaccaagccggcgatccggcgtctggcgcgcaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgcgatggacgtcgtctacgcgctcaagcgccagggacgcaccctctacggcttcggcggctaggccgggcgatctgaggctccaccaccagaagatgctaggcgttatttaggctttgtggtactcattgtaatagctctcctttgcagttgttttgctcctgtccaccttgatgttgggagtggtatgagcgatggttcgtcagaagtcatggtcagaatagtaaatcgcagtcgtttggctcttgtcctcctgtttggagtgtcatgagctatggttcgtcaaattaaatgagctaataggaattctcagtggtttga

SEQ ID NO: 2236 - DNA, 766 bp, Brachypodium distachyon
tcaccagaaggaattccccaatctcaactcttttcgtctcatcgttttcaagctccctctcatctgcggcaatgtcggggcgcggcaagggaggaaaggggctgggcaagggcggcgccaagaggcaccggaaggtgctccgggacaacatccaggggatcacgaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggacgcaccctctacggcttcggcggctgatcaccttctggtcgtcgtatggttcggcttgttagggtttgtgctgtgtgtgctgtttggggggtcgatggcttgtactctgggatggaatttatggcatatgaatgaacagatttggtcttgctgggtagttgatttggtgttacaggaattagtgtatgtttgttggttggttccagttttttttttgttcgataccggtggttaactgcggtatctgaaggctaagctattctggactggaaccctgaagactcatttttcgaaccctctgtttctctgttaaattgtctgaacttaatactctgtacaagattcagtcacatggtctgatctctgatggttgtatcagtattattgtagtctatgcagcgtaatttgat

SEQ ID NO: 2237 - DNA, 652 bp, Brachypodium distachyon
ccccaatctcaactcttttcgtctcatcgttttcaagctccctctcatctgcggcaatgtcggggcgcggcaagggaggaaaggggctgggcaagggcggcgccaagaggcaccggaaggtgctccgggacaacatccaggggatcacgaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggacgcaccctctacggcttcggcggctgatcaccttctggtcgtcgtatggttcggcttgttagggtttgtgctgtgtgtgctgtttggggggtcgatggcttgtactctgggatggaatttatggcatatgaatgaacagatttggtcttgctgggtagttgatttggtgttacaggaattagtgtatgtttgttggttggttccagttttttttttgttcgataccggtggttaactgcggtatctgaaggctaagctattctggactggaaccctgaagactcatttttcgaaccctctgtttctctgtt

SEQ ID NO: 2238 - DNA, 666 bp, Brachypodium distachyon
caaactccacagcgactccaattttcccttggtagacagcttccatctcatctccggcgatgtctgggcgcggcaagggcggcaaggggctgggcaagggcggagccaagcgccaccgcaaggtcctgcgcgacaacatccagggcatcaccaagccggcgatccggaggctggccaggaggggcggcgtgaagcgcatctcggggctgatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctgaagagccgcggcgctggctggccggccgtggcgcacaagccctggctcgcggtcaagaaagtggaggagaggagaaagctgtagttgatctgggttccatgccttctatgattagtagtaatatctgtagtagcagtagctggttgttcaatggttgcttcagtgttctgaatttctgatgggcaaatactgtgtttgccgagttatatgaatccagagttaacaaaattgtcctaaaactatgaattattgctaatgacgatgctgttctgttttaaaactctttgtgctaccgc

SEQ ID NO: 2239 - DNA, 507 bp, Brachypodium distachyon
agttctcttcctccaaaatcaaatctcacacagccaagaggagcggggctttcggcgatgtctgggcgcggcaagggcggcaaggggctgggcaagggcggagccaagcgccaccgcaaggtcctgcgcgacaacatccagggcatcaccaagccggcgatccggaggctggccaggaggggcggcgtgaagcgcatctcggggctgatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagatttggtggatggtggtcgtggggctgcagtttagtatttgtgtgatatgttccgtcgtagattaggtctactactcctgtgtcgtgtgtagttgtgttcctgcttccgtgttccgaaggatgtagtacttcgttgtg

SEQ ID NO: 2240 - DNA, 630 bp, Brachypodium distachyon
cacaacacactcaccaaatccccaaattcccaaatcatccagtttcgtcgttccgagctagagagaactcagccatgtcgggccgcggcaagggaggcaagggcctgggtaagggcggcgcgaagcgccaccggaaggtgctgcgggacaacatccagggcatcacgaagccggcgatccgtcgcctggcgcgccgtggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctgatcccgtcctgtccgcatccggatctgggctccgctcggttctctggtttccttgttggtggtggggtgtggctgtgttcgtgaggatgggattgctagggttacttgttcctttggtgctggaggtggttgttgggtttgtgctgtgaattgcaatgcgattgatgcatatgtttaatggaatggattcggttcctttcggtattttgccttgttgtataccatctgagatctgtgcttctgtt

SEQ ID NO: 2241 - DNA, 338 bp, Brachypodium distachyon
cgagctagagagaactcagccatgtcgggccgcggcaagggaggcaagggcctgggtaagggcggcgcgaagcgccaccggaaggtgctgcgggacaacatccagggcatcacgaagccggcgatccgtcgcctggcgcgccgtggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctgatcccg

SEQ ID NO: 2242 - DNA, 681 bp, Brachypodium distachyon
ccaccaaatccaagcaccagtgctctcagccctctctaccaattcaagccgctccgctcctctcgagcagctccgaagcagccatgtccgggcgagggaagggaggtaaggggctcggcaagggcggcgccaagcgccaccggaaggtgctacgcgacaacatccagggcatcaccaagccggcgatccggcgcctggcgaggaggggcggcgtgaagcgcatctccgggctaatctacgaggagacccgcggcgtcctcaagatcttcctcgagaacgtcatccgcgacgccgttacctacaccgagcacgcccgccgcaagaccgtcaccgccatggacgttgtctacgccctcaagcgccagggccgcaccctctacggcttcggcggctaagccggtgccgcgcttcttacctgcagcctcatcgtccctgtcgccttgccagcgtcccaccagtgccggaggaggcgaaaatgcagtatctgtgttagttttttagattatccattcagtattagtttttgctggaaagatgttgttagtagcttgtagctctttatgggcccagatttggaattcgaaatcaaatatgttgactcatcgagaaattgcagtgtattacaatttggagtattggttatccatgccatgtttagttcagtattttttcttagcgatg

SEQ ID NO: 2243 - DNA, 599 bp, Brachypodium distachyon
tccaagcaccagtgctctcagccctctctaccaattcaagccgctccgctcctctcgagcagctccgaagcagccatgtccgggcgagggaagggaggtaaggggctcggcaagggcggcgccaagcgccaccggaaggtgctacgcgacaacatccagggcatcaccaagccggcgatccggcgcctggcgaggaggggcggcgtgaagcgcatctccgggctaatctacgaggagacccgcggcgtcctcaagatcttcctcgagaacgtcatccgcgacgccgttacctacaccgagcacgcccgccgcaagaccgtcaccgccatggacgttgtctacgccctcaagcgccagggccgcaccctctacggcttcggcggctaagccggtgccgcgcttcttacctgcagcctcatcgtccctgtcgccttgccagcgtcccaccagtgccggaggaggcgaaaatgcagtatctgtgttagttttttagattatccattcagtattagtttttgctggaaagatgttgttagtagcttgtagctctttatgggcccagatttggaattcgaaatcaaatatgttgactcatcgag

SEQ ID NO: 2244 - DNA, 526 bp, Brachypodium distachyon
acgagaaaaaatattccccaatccctcgccagttgcgtctttgcgagctctctctcacacatcgagcgtcggaaatgtcgggccgcggcaagggaggcaaggggctgggcaagggcggcgccaagaggcacaggaaggtgctccgggacaacatccaggggatcacgaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctgatcccctcccgttctggtcgtcatatgcttcggattcttagggtttatttcggctgtgtgtggtgtttggggatcgatggcttgtactctgggatggaatttatggcatatgaatgaaaggatctggtgttgatggataac

SEQ ID NO: 2245 - DNA, 325 bp, Brachypodium distachyon
gagcgtcggaaatgtcgggccgcggcaagggaggcaaggggctgggcaagggcggcgccaagaggcacaggaaggtgctccgggacaacatccaggggatcacgaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctgatc

SEQ ID NO: 2246 - DNA, 332 bp, Brachypodium distachyon
gagatgtctgggagaggcaagggcgggaaggggctgggcaagggcggcgcgaagcggcacaggaaggtgctgcgcgacaacatccaggggatcacgaagccggcgatccggcgcctggcgcggcggggcggcgtgaagcggatctcggggctcatctacgaggagacccgcggggtgctcaagatcttcctggagaacgtcatccgcgacgccgtcacctacaccgagcatgcgcgccgcaagaccgtcaccgccatggacgtcgtctacgcgctcaagcgccagggccgcacgctctacggctttggcggctaggcgataagcttcatcag

SEQ ID NO: 2247 - DNA, 318 bp, Brachypodium distachyon
gagatgtctgggagaggcaagggcgggaaggggctgggcaagggcggcgcgaagcggcacaggaaggtgctgcgcgacaacatccaggggatcacgaagccggcgatccggcgcctggcgcggcggggcggcgtgaagcggatctcggggctcatctacgaggagacccgcggggtgctcaagatcttcctggagaacgtcatccgcgacgccgtcacctacaccgagcatgcgcgccgcaagaccgtcaccgccatggacgtcgtctacgcgctcaagcgccagggccgcacgctctacggctttggcggctaggcg

SEQ ID NO: 2248 - DNA, 585 bp, Brachypodium distachyon
caaactccgcagcgattccaaatctctcgtctagtacaactgttctcagttcatcggatctccgacgatgtccggacgcggcaagggcggcaaggggctgggcaaaggcggcgcgaagcggcaccgcaaggttctccgcgacaacatccagggcatcaccaagccggcaatccggaggctggcgaggaggggcggcgtgaagcgcatctcggggctcatctatgaggagacccgcggcgtgctcaagatcttcctcgagaacgtcatccgcgacgccgtcacctacacggagcacgcccgacgcaagaccgtcaccgccatggacgtcgtgtacgcgctcaagcgccagggccgcaccctctatggcttcggcggctgattctgctggttgtgccttagcgatgtgctcttgtttcccctgtgtagagagatcaagaatcccttctgtagtttgcctgtttcgattgttcctgtagtgcgtcggtgcgtctcaacctcctgttttaaaccctgttctatcatttcgatgcaatgacatgtttattccaatcccagcaaatataattgctccgttcgcagttgcag

SEQ ID NO: 2249 - DNA, 377 bp, Brachypodium distachyon
cgacgatgtccggacgcggcaagggcggcaaggggctgggcaaaggcggcgcgaagcggcaccgcaaggttctccgcgacaacatccagggcatcaccaagccggcaatccggaggctggcgaggaggggcggcgtgaagcgcatctcggggctcatctatgaggagacccgcggcgtgctcaagatcttcctcgagaacgtcatccgcgacgccgtcacctacacggagcacgcccgacgcaagaccgtcaccgccatggacgtcgtgtacgcgctcaagcgccagggccgcaccctctatggcttcggcggctgattctgctggttgtgccttagcgatgtgctcttgtttcccctgtgtagagagatcaagaat

SEQ ID NO: 2250 - DNA, 547 bp, Brachypodium distachyon
atccaattcctaaggcgaagcaaaaatccccaaatcttccttcgtttcagagagagatgtctgggcgcggcaagggtggcaaggggctgggcaagggcggcgccaagcgccacaggaaggttctgcgggacaacatccaaggcattacgaagccggcgatccgtcggcttgcgaggaggggcggcgtgaagcgcatctcggggctcatctacgaggagacccgcggcgtgctcaagatcttcctggagaacgtcatccgcgacgccgtcacctacaccgagcatgcgcgccgcaagaccgtgaccgccatggacgtcgtgtacgcgctcaagcgccagggccgcaccctctacggcttcggcggctaggctttctctgtatggtggttgcttgttccgagagtacctgtctgtgtcgttgtgatagtctggtggtgtcaaatgttgtgtcattgatgtaatcgtacactgctgcagtgaagataatgctagttatgtttggatgaatgctactagttgtgtcccattaaatgtcagcctctgtcgta

SEQ ID NO: 2251 - DNA, 367 bp, Brachypodium distachyon
gagagagatgtctgggcgcggcaagggtggcaaggggctgggcaagggcggcgccaagcgccacaggaaggttctgcgggacaacatccaaggcattacgaagccggcgatccgtcggcttgcgaggaggggcggcgtgaagcgcatctcggggctcatctacgaggagacccgcggcgtgctcaagatcttcctggagaacgtcatccgcgacgccgtcacctacaccgagcatgcgcgccgcaagaccgtgaccgccatggacgtcgtgtacgcgctcaagcgccagggccgcaccctctacggcttcggcggctaggctttctctgtatggtggttgcttgttccgagagtacctgtctgtgtc

SEQ ID NO: 2252 - DNA, 476 bp, Bruguiera gymnorhiza
gattcgaaagccagcgatcgagaggaaggaggaaagccaaaagagagaaaatgtcggggagaggaaaagggggaaagggactgggaaagggaggcgccaagaggcacaggaaggtcctccgcgacaacatccaggggatcaccaagcctgccatccggcgcctggccaggcgtggcggcgtcaagcgtatcagcggcctcatctacgaggagaccagaggcgtcctcaagatctttctcgagaacgtcattcgcgatgctgtcacctacaccgagcacgctcgccgcaagactgtcactgccatggacgtcgtctatgccttgaagaggcagggccgcaccctctacggctttggtggttagcttagggtttcaggactaaaacgttagcttgggattagggtttcttattgtggatttctgatgattgtacttgatcacttgattcgagagacttaactttgtaaggaatagaaa

SEQ ID NO: 2253 - DNA, 620 bp, Theobroma cacao
cggggaacctcgaaacaaatagagagagaagagaaacgaaaaaagagatcaggaaatgtcgggcagaggaaagggagggaagggattgggaaaaggaggagcgaaacgtcaccgtaaggttctgagggataacatccaggggatcaccaagccagccataaggcgtctggctcgtcgtggaggagtcaagcgtatcagcggtctcatctacgaggagacacgcggcgtcctcaagatctttctggagaacgtaattcgcgacgccgttacctacactgagcacgctcgccggaagactgttacggctatggatgtcgtttatgccttgaagagacaaggccgtaccctttacggtttcggcggttaagtctctagggttagcattaggggttatggtataatttgggaatttgggaagatcaggctttttttaatgttgatatgaaatgaaggtgtttagagttttgtatctttttctttctctttctctgttcgggttatgtggaaagttggactaattatagtttggtaatggatgttcaaagttgttgcttagtgcgtttgtgtttttgtttggttactaagaaaatgtgggaaaatgggcacttaaagttttcctt

SEQ ID NO: 2254 - DNA, 585 bp, Theobroma cacao
  misc_feature (462)..(462): n is a, c, g, or t
agcctaaactcgaaacaaagatttattttcgcactttcattctctggaaaccaactttcactagaaaatgtctggccgtggaaagggaggcaagggtttgggaaagggaggagccaagaggcaccggaaggtgctccgagataacattcagggtatcaccaagccggcgattcgaaggttggctcgtagaggtggtgtgaagaggatcagcggcttgatctacgaggagacacgtggcgtccttaagatctttctggaaaatgtgatccgtgacgccgttacctatacggagcacgctaggcgcaagactgttaccgccatggacgtcgtgtacgctctcaagaggcagggcaggactctctacggtttcggtggttaggttgatttagccgggttgattggttggattgtaaatcttttgcaacagtttgttgtaggcttttgtatcactcttctgtagtntgatgttttaggctttatttttttagtttctattattagaatgtattttgatttcattctgaaacggaacttgtctcagaatttcatgttgaaatccaatttgagttcttaatatttgctttc

SEQ ID NO: 2255 - DNA, 842 bp, Theobroma cacao
  misc_feature (216)..(216): n is a, c, g, or t
  misc_feature (802)..(802): n is a, c, g, or t
atccaagaatgaataagcgaaaaatatattaaaactctaaagaatacaaattttataataaaataatgccatgtcatcgatccaacattaatacaaatccccaaatctcaaccgttcattaaccatcaacggtccaaaacattgccccacaagagcacacacggatcgattcccgttcaaagcttccttatagatacccaaccaccactcccctcncggggggctctcaacgtcaccaaatcaagcaatctcatagtctttcagttgtgcaaaaatgtctgggcgtggcaagggaggcaaaggattgggaaaaggaggagcgaaacggcaccgtaaggtcctccgcgataacatccaagggatcacaaagccagccatccgccgtttggctcgccgtggcggtgttaaacgcatcagcggtcttatttacgaggagacacgtggcgtcctcaaaatcttccttgaaaacgtcatcagagacgccgttacctacaccgagcacgcccgtcgcaaaaccgtcaccgccatggacgtcgtttacgcgctcaagagacaaggccgtaccctttacgggtttggtggttagggtttttgatttcgttctgtttggtggaaatttaggaatgaaaaatatcaatggtgtttttgatccgaaattgtctttgtcatttttatcatttttgttttttttatagttacactccaaatttagatgcatgcaacttgttaatggctttaagcggagtgtgggaagtgaaaactggagtgggattagctgaattgaccagtagacttgaacttntgatcgggtgtgtacgattaaaataattctatttccaggc

SEQ ID NO: 2256 - DNA, 484 bp, Theobroma cacao
cggggacacagtcaaaactcaaattcagaaaaaaagctaattcacaagtctcaagaatgtcaggccgtggaaagggtggcaaagggctaggcaagggaggagccaaacgacaccgtaaggtgctccgagataacatccaagggatcacgaagccagctatccgacgtctggcgaggagaggcggagttaagaggatcagcggcttgatttatgaggagacgcgaggtgttttgaagatctttttggagaacgtgatccgcgacgccgttacttacacggaacatgctcggagaaagaccgtcaccgccatggatgttgtttacgcccttaagagacaggggaggactctctacggtttcggcggttgaagtttttagggttttttttaatggtttttatctgatgttttcttgatttggaagggatgtgaatactgatggaaaaatgttatgagattatgaatgaaattttaagcatttaatca

SEQ ID NO: 2257 - DNA, 597 bp, Theobroma cacao
  misc_feature (279)..(279): n is a, c, g, or t
cggggtcccaacagcctaaactcgaaacaaaaaccgttgtcagactttcagcctctcgaaaccaattttcacaagaaaatgtctggccgtggaaagggaggtaagggattgggaaagggtggagccaagaggcacaggaaggtgcttcgagataacattcagggtatcaccaagccggcgattcgaaggttggctcgtagaggtggtgtgaagaggatcagcggcttgatctacgaggagacacgtggcgtccttaagatctttctggaaaatgtgatncgtgacgccgttacctatacggagcacgctaggcgcaagactgttaccgccatggacgtcgtgtacgctctcaagaggcagggcaggactctttacggtttcggtggttaggttgatttagccgggttgattggttggattgtaaatcttttgcaacagtttgttgtaggcttttgtttcactcttttgtagtttgatggtttaggtttttaatttttagtttctattattagaatgtattttgatttcaatctgaaatgaaatttgtctcagaatttcatgttgaaatccaatttgagttcttaatatttgctttca

SEQ ID NO: 2258 - DNA, 674 bp, Theobroma cacao
  misc_feature (644)..(644): n is a, c, g, or t
cgcggggagagtttccaatttaaccgccaaatcaccaaatctcaggtaaaaacaaagatgtcgggaagaggaaaggggggtaagggactgggcaagggaggagcaaagcgacaccgtaaggtcctccgtgataacatccaagggatcactaagccggcaatccggcgtttggctcgtaggggaggagtcaagcgaatcagcggtttaatctacgaggaaactcgtggagttctgaagatcttcttggagaacgtgattcgtgatgccgtcacctacactgagcacgcgaggaggaagactgtgactgctatggatgtggtctatgcactgaagaggcagggtaggactttgtacggattcggcggttaaatgaattatcatatgggtaggggaagaattggggatttgaagtcttgctgtcaagaatgtttgagcttagggtttgggttagtgtttgtaattaaggtgggtttattgaattactagaaattatagattggttagtggttttttttctttggtgatttgtaattcctgctcttaatttccaattttagtgaaatttgaagttggttttgttaatgtactttctccggtctgttaactggtgttgggtataatgccaaatgcattccttttgttcnttggttttgaatttaaatttaaattattta

SEQ ID NO: 2259 - DNA, 572 bp, Theobroma cacao
  misc_feature (177)..(177): n is a, c, g, or t
cgggattcatcatttcgttaagtctaccaaaaaacccaaaaggtttcgaagaaaatgtcgggaagaggaaagggaggtaaggggcttggaaagggaggagccaagaggcacaggaaggttttgagggataacatccagggaatcactaagcccgccattcgccgtctggctcgtagnggaggtgtgaagaggatcagcggcttgatctatgaagaaaccagaggagtcttgaagattttcttggagaacgtgattcgcgatgctgtgacatacactgagcacgcaagaaggaagactgttactgccatggatgttgtttacgcattgaagaggcagggcaggactctttatggctttggtggttaagattctgtactctttagtatagatttagctttggcattattaagtttgtcaattgtacatcttggctatagatcttgcctttatgtgattgtttcagttcccttgttgatgttcttgtaatctgtaatcttgaatatgggcgatggatttccttcatcaaagcctttgcgcgcttttccatttttaatctttcactgtttccagcc

SEQ ID NO: 2260 - DNA, 500 bp, Brassica napus
atcaacgcagagtacgcggggacacaaaaccaaaaaaaaaagggtccttgagaaaatctgagatttagtgttgttgaaaaatgtcgggtcgtggaaagggaggcaagggtttggggaaaggaggagccaagcgtcacaggaaggttctcagagacaacatccaaggaatcaccaagcctgcgattcgtcgtttggctcgtagaggaggcgtgaagcgtatcagcggtctgatctacgaggagactcgtggcgtcctcaagatctttttggagaacgttatccgtgacgccgtcacatacaccgagcacgcgcggaggaagacggtgacagccatggatgtggtgtatgctctcaagaggcaagggaggactctctatggattcggcggctagggttttaaaattgttttcgttaaatcaaatctcagatgtgattctattttagtaatttcagcttctctttatgcttttgtatcatcaaaatatatgaaattcacattt

SEQ ID NO: 2261 - DNA, 516 bp, Brassica napus
  misc_feature (506)..(506): n is a, c, g, or t
atcaacgcagagtacgcggggacacaaaaccaaaaaaaaaagggtccttgagaaaatctgagatttagtgttgttgaaaaatgtcgggtcgtggaaagggaggcaagggtttggggaaaggaggagccaagcgtcacaggaaggttctcagagacaacatccaaggaatcaccaagcctgcgattcgtcgtttggctcgtagaggaggcgtgaagcgtatcagcggtctgatctacgaggagactcgtggcgtcctcaagatctttttggagaacgttatccgtgacgccgtcacatacaccgagcacgcgcggaggaagacggtgacagccatggatgtggtgtatgctctcaagaggcaagggaggactctctatggattcggcggctagggttttaaaattgttttcgttaaatcaaatctcagatgtgattctattttagtaatttcagcttctctttatgcttttgtatcatcaaaatatatgaaattcacatttgactancactatcaac

SEQ ID NO: 2262 - DNA, 639 bp, Brassica napus
atcaacgcagagtacgcggggacacatcgaaaacacacaagcgaatctcaattaaaaactttccgagaaaagaaaaatgtctgggcgaggaaaaggaggaaaggggttgggaaagggaggagccaagaggcacaggaaggttctccgtgacaacatccagggcatcacgaagcccgcgattcgtcgtctagctagaagaggtggcgtgaagcgtatcagcggtttgatctacgaggagactcgcggtgttctcaagatctttctcgagaatgtgattcgcgatgccgttacttacactgagcacgctaggaggaagacggtgacggcgatggatgttgtctatgcgttgaagaggcaaggacgaactttgtatggattcggcggttgagggatgagattggagtttgtaaatcgcgtttgtctttagggtttgtttaatctattaaagctgttttagagtttcgtttagaatgtttcagcgatttgaatttaatgaaaacactttttatctactatattttgcaaaattgtcggtatagttaagctgaatcgtcgttttaatcaagaacaaattaaacaacttcttatctcattaaccgggataggattaaattggttattgtatatccgattggagta

SEQ ID NO: 2263 - DNA, 594 bp, Brassica napus
atcaacgcagagtacgcggggacatcgaaaacacacaagcgaatctcaattaaaaactttccgagaaaagaaaaatgtctgggcgaggaaaaggaggaaaggggttgggaaagggaggagccaagaggcacaggaaggttctccgtgacaacatccagggcatcacgaagcccgcgattcgtcgtctagctagaagaggtggcgtgaagcgtatcagcggtttgatctacgaggagactcgcggtgttctcaagatctttctcgagaatgtgattcgcgatgccgttacttacactgagcacgctaggaggaagacggtgacggcgatggatgttgtctatgcgttgaagaggcaaggacgaactttgtatggattcggcggttgagggatgagattggagtttgtaaatcgcgtttgtctttagggtttgtttaatctattaaagctgttttagagtttcgtttagaatgtttcagcgatttgaatttaatgaaaacactttttatctactatattttgcaaaattgtcggtatagttaagctgaatcgtcgttttaatcaagaacaaattaaacaacttcttatctcattaa

SEQ ID NO: 2264 - DNA, 520 bp, Brassica napus
cggggacacacaacagtcttcaaaactctctcttacattcaaaagcaaagaaaaaaatgtctggacgaggaaagggaggaaagggactgggaaagggaggagccaagaggcacaggaaggtcctccgcgacaacatccaggggatcaccaagcctgcgattcgtcgtttagcgaggagaggcggtgtgaagcgtatcagcggtttgatctacgaggagactcgcggcgttctcaagatcttcctcgagaacgtgattcgtgacgctgtgacttacactgagcacgctaggaggaagactgtgacggcgatggatgttgtgtatgctttgaagaggcagggaaggactctgtacgggttcggcggctgaggggattgaattaggggtttgtaaatcgcgtttgttgtttttagggtttggttaatttggggagattaagatctctataagctgtctgaagggttttatttgaatgttttaagtggttttaaattgaatgagaaaagcttttatttgaacta

SEQ ID NO: 2265 - DNA, 603 bp, Brassica napus
gagtacgcggggacacatcgaaaacacacaagcgaatctcaatttaaaactttccgagaaaagaaaaatgtctgggcgaggaaaaggaggaaagggattgggaaagggaggagccaagaggcacaggaaggtcctccgtgacaacatccagggcatcacgaagcctgcgattcgtcgtttagctagaagaggtggcgtgaagcgtatcagcggtttgatctacgaggagactcgcggtgttctcaagatctttctcgagaatgtgattcgtgatgccgttacttacactgagcacgctaggaggaagacggtgacggcgatggatgttgtctacgcgttgaagaggcagggacgaactttatatggattcggcggttgatgggatgattttgtaaatcgcgtttgtctttagggtttgtttaatctattaaagctgttttagagtttcgtttagaatgtttcagcgttttgaattgaatgaaaacactttttctctattagcttttgcaaaagtgtcggtatagttaagctgaatcgtcgttttaactaagaacaaattaaagcaactccttacctcgttaaacgggattgggatataattgg

SEQ ID NO: 2266 - DNA, 593 bp, Brassica napus
atcaacgcagagtacgcggggacaatcggaatctaatacttagttatatattctagagaaagtttccaaagaaaaatgtcaggaagaggaaagggaggaaagggattgggaaaaggaggagcgaagagacacaggaaggttctgagagacaacatccaaggaattaccaagcctgcgatcaggcgtcttgctcgcagaggaggcgttaagcgaatcagcggtttgatctacgaagaaacgagaggagtcctgaagatctttctcgagaatgtgatcagagacgccgtcacttacaccgagcacgcgaggaggaagacggtgacggcaatggatgtggtttatgctttgaagagacaaggacgtactctctacggattcggtggttgaatcgttttcgatttgttgtgttgtgttgctactattaagtcttgcggtcaagaagtgttgtaacgaagttcttctctttatcggttaatggaaatatgattaatcaaaaaaaaaaaataaggtcgcccgctctagaggatccaagcttcggttacgctcgcactgcggacagtccgagctcggtactagtgcagtgagctactacg

SEQ ID NO: 2267 - DNA, 625 bp, Brassica napus
  misc_feature (24)..(24): n is a, c, g, or t
cgggattcggccttatggccgggngacatcggaatctaatacttagttatatattctagagaaagtttccaaagaaaaatgtcaggaagaggaaagggaggaaagggattgggaaaaggaggagcgaagagacacaggaaggttctgagagacaacatccaaggaattaccaagcctgcgatcaggcgtcttgctcgcagaggaggcgttaagcgaatcagcggtttgatctacgaagaaacgagaggagtcctgaagatctttctcgagaatgtgatcagagacgccgtcacttacaccgagcacgcgaggaggaagacggtgacggcaatggatgtggtttatgctttgaagagacaaggacgtactctctacggattcggtggttgaatcgttttcgatttgttgtgttgtgttgctactattaagtcttgcggtcaagaagtgttgtaacgaagttcttctctttatcggttaatggaaatatgattaatcagatctctttatttcgctgatagaattcaagtttttattaaatctttataaacctgattacgatgatacggctatcttcatgaattggaattgttgctgatgcccagataaaactgaaaaatgaacatgc

SEQ ID NO: 2268 - DNA, 543 bp, Brassica napus
atcaacgcagagtacgcggggatcgcagtctcctacacacgtgtgagaaacaactctctttttttctctgatttttaaaccttttcgaggaaaagaaaatgtctgggagaggaaagggtggaaagggacttggaaagggaggagccaagaggcacaggaaggtcctccgtgacaacatccagggcatcacgaagccggcgattcgtcgtttagcgagaagaggcggtgtgaaacgtatcagcggtttgatctacgaggagactcgcggcgttctcaagatcttcctcgagaatgtgatccgtgacgctgtgacttacactgagcacgcgaggaggaagactgtgacggcgatggatgttgtgtacgcgttgaagaggcaggggaggactctgtacgggttcggcggctgaggggattgaattagggttttgtaaatcgcgtctgggttgtttttagggcttgttaaggcctttaagctgttgtgatggtttcgtttcgaatgtttcgatgatttgaattgaatgaaaacgcttttattacatc

SEQ ID NO: 2269 - DNA, 675 bp, Brassica napus
atcaacgcagagtacgcggggaccatcgaagctgcaagcgaatttactttttcctttttcttaaatactttgtgaggagatgtcaggaagagggaaaggagggaaaggattgggaaagggaggagccaagaggcacaggaaggtgcttagggataacatccaaggtatcaccaagcccgccattcgtcgtcttgctcgtcgaggtggcgtcaagcgtattagcggtttgatctacgaggagaccagaggagtcctcaagatcttcctcgagaatgtcatccgcgacgctgtcacctacaccgagcacgcgaggaggaagactgttactgctatggatgtggtttatgctttgaagaggcaagggcgtactctctacggtttcggcggttaaatcgacggaaatgagattagggtttcgaaagtttggggatctgaatttgggatttttttttttttggtttctgattattcgaagtaaatccacgactgttgtatcgttttctgctgtgttgttagccaatattatgttgaattaatcttaatcaaaagttgtgctgtgataatcctccatcttcaaagaaattttatgttataaagattacccccagtaaaaaaaaaacaaaacgtcgaataaagaaaaaataagtaaagaaacaaaacattgagggttggttg

SEQ ID NO: 2270 - DNA, 734 bp, Brassica napus
taaaaccttctctcgagtctcttgtgtactttagtttttacctctgtttattattttctctttaggatgctttgtgatgattctggtttttttgtccttattaagcaaaaaaaatatcatattctattaaaaaaaaacgaatcttcttcaacgctaaacttttctcaagaaaaaaaacccaatttcatcggaaaaaaatgtcgggacgtggaaagggaggaaagggtttgggcaaaggaggagccaagcgtcacaggaaggttctgagagacaacatccagggaatcaccaagccggcgattcggaggctggctcgcagaggtggagtcaagcgtatcagtggtctcatctacgaggagacacgtggagtcctcaagatctttttggagaacgttattcgtgacgctgtgacctacaccgagcacgctaggaggaagactgtgactgcgatggatgtggtctacgcgttgaagaggcaagggaggacgctttacgggttcggcggttaagggtctcttgtagattcgcgttttgcgtttctgggtttctttaggcgtgttcttatggaagtttctaatcaaatcatgttttccttagcgtttgtgttttgaattccgtttgagttcggtcttttgtgtgttgcgttagcgtttcgttatatgtaattacgcaattttatctatgaagctattcgagtttatgaatctggactttgattggtggtcattgaacgt

SEQ ID NO: 2271 - DNA, 583 bp, Brassica napus
gaaaactcaaacatcgaatcttcttcaacgctaaacttttctcaagaaaaaaaaaacccaatttccttctgaaaaaatgtcgggacgtggaaagggaggaaagggtttgggcaaaggaggagccaagcgtcacaggaaggttctgagagacaacatccagggaatcaccaagccggcgattcggaggctggctcgcagaggtggagtcaagcgtatcagtggtctcatctacgaggagacacgtggagtcctcaagatctttttggagaacgttattcgtgacgctgtgacctacaccgagcacgctaggaggaagactgtgactgcgatggatgtggtctacgcgttgaagaggcaagggaggacgctttacgggttcggcggttaagggtctcttgtagattcgcgttttgcgtttctgggtttctttaggcgtgttcttatggaagtttctaatcaaatcatgttttccttagcgtttgtgttttgaattccgtttgagttcggtcttttgtgtgttgcgttagcgtttcgttatatgtaattacgcaattttatctatgaagctattcgagtttatgaa

SEQ ID NO: 2272 - DNA, 522 bp, Brassica napus
gatcatctgaaccttaaacactcaatcatctaaatctcgagaaagttctaatgtcaggaagaggaaaaggaggcaaggggttgggcaaaggaggagccaagaggcacaggaaggttctgagagacaacatccaaggaatcaccaagcctgcgatcaggcgtctcgctcgtagaggaggcgtgaagagaatcagcgggttgatctacgaagagaccagaggagttctgaagatctttctcgagaatgtgattagagacgccgtgacgtacacggagcacgcgaggaggaagacggttacggcgatggatgttgtttatgctttgaagaggcaagggcgtactctttatggattcggtggttaaaaccggtttaagatttcggtttggtttatgggtgctactgaattaagtcttgctgtcaagaaatctagtaggtttttaggctttttactcctttgctgggttgtttctttgtttgtgtaatttctcttttgagatttataaaaaaattaattattcagtt

SEQ ID NO: 2273 - DNA, 532 bp, Brassica napus
gaattcatcatctgaaccttaaacactcaatcatctaaatctcgagaaagttctaatgtcaggaagaggaaaaggaggcaaggggttgggcaaaggaggagccaagaggcacaggaaggttctgagagacaacatccaaggaatcaccaagcctgcgatcaggcgtctcgctcgtagaggaggcgtgaagagaatcagcgggttgatctacgaagagaccagaggagttctgaagatctttctcgagaatgtgattagagacgccgtgacgtacacggagcacgcgaggaggaagacggttacggcgatggatgttgtttatgctttgaagaggcaagggcgtactctttatggattcggtggttaaaaccggtttaagatttcggtttggtttatgggtgctactgaattaagtcttgctgtcaagaaatctagtaggtttttaggctttttactcctttgctgggttgtttctttgtttgtgtaatttctcttttgagatttataaaaaaattaattattcagttctcag

SEQ ID NO: 2274 - DNA, 555 bp, Brassica napus
atcaacgcagagtacgcggggacacatcgcactctcctccacacgtgtgaaaaaacaacttcctttttttttctctgattttaaaaactttttcacaagaaaaataaaaatgtctgggcgtggtaagggaggaaagggattgggaaagggaggagccaagaggcacaggaaggttctccgcgacaacatccagggaatcaccaagccggcgattcgccgtttagcgagaagaggcggcgtgaagcgtatcagcgggttgatctacgaggagactcgcggcgttctcaagatctttctcgagaatgtgattcgcgacgctgtgacttacactgagcacgcgaggaggaagactgtgacggcgatggatgttgtgtacgcgttgaagaggcaggggaggactctgtacgggttcggcggctgaggggattggattagggtttttgtaaatctcgtctgggttgtttttagggtttgttaagagctttaagctgttgttatggtttcttttcgaatgtttcggtgatctgaagttaatgaaaacgcttttaacaaatt

SEQ ID NO: 2275 - DNA, 555 bp, Brassica napus
gacaattcaactctaacttcgattcttattcagcatcaaactttctcaatcggaaaaaaacatgtcgggccgtggaaagggaggaaagggtttgggcaaaggaggagccaagcgtcacaggaaggttctgagagacaacatccagggaatcaccaagccggcgattcggagactggctcgtagaggtggagtcaagcgtatcagtggtctcatctacgaggagacgcgtggcgtcctcaagatctttttggagaacgttattcgtgacgccgtcacctacaccgagcacgctaggaggaagacggtgactgcgatggacgtcgtctatgcgctgaagaggcaagggaggactctctacgggttcggcggttaagcgttttcttagattcgcgtttgcgtttcttttatggaagtttctaaacaaatcatgttctacttagcgtttgcgtttgaattatgtttgggtacggcgttttatgtgttgcggtagcgtttcgttttatatgtaattacgccttttatcttatgtttttagcgatgcaatgtcaatgtaat

SEQ ID NO: 2276 - DNA, 616 bp, Brassica napus
atcaacgcagagtacgcggagacaattcaactctaacttcgattcttattcagcatcaaactttctcaatcggaaaaaaacatgtcgggccgtggaaagggaggaaagggtttgggcaaaggaggagccaagcgtcacaggaaggttctgagagacaacatccagggaatcaccaagccggcgattcggagactggctcgtagaggtggagtcaagcgtatcagtggtctcatctacgaggagacgcgtggcgtcctcaagatctttttggagaacgttattcgtgacgccgtcacctacaccgagcacgctaggaggaagacggtgactgcgatggacgtcgtctatgcgctgaagaggcaagggaggactctctacgggttcggcggttaagcgttttcttagattcgcgtttgcgtttcttttatggaagtttctaaacaaatcatgttctacttagcgtttgcgtttgaattatgtttgggtacggcgttttatgtgttgcggtagcgtttcgttttatatgtaattacgccttttatcttatgtttttagcgatgcaatgtcaatgtaatccaatgtcaagaaatatattcgaattttatttacacaagtc

SEQ ID NO: 2277 - DNA, 682 bp, Brassica napus
tcaacatattattctctccccatcgaagcttttgaatattaaattttcctgagaaaagaatgtctgggcgaggaaagggaggaaaaggattgggaaagggaggagccaagaggcatcggaaagtcctccgagacaacatccaaggaatcaccaaaccagcgatccgtcgtctagcgagaagaggaggtgtgaagcgtatcagcggtttgatctacgaagagactcgcggcgttctcaagatctttctagagaacgtgattcgcgacgccgttacgtacacggagcacgctcgccggaaaacagtgacggccatggacgttgtctacgctctcaagaggcagggtcggactctgtatggattcggcggttgattcgattgtttcagtttcagatcttgtaaaatctttttcagaatcaatggcaaaatatgcatctttttctaaacaatcttggtcttgtttccgcgtataattatagtaaactgaaaggactctagttcgaatccccacaaggacattttgaccaatggctctttccttttggttgtgaaaactaattaatgcgcacgataaggtttttggactaaaagttatgttgaccaataaaaatgtaccaaaacgcggaaaatgtttactataatccttttttggttactatacatgttggactaaagatgttatgg

SEQ ID NO: 2278 - DNA, 709 bp, Brassica napus
cggccattatggcccggggaaccatcaacatattattctctccccatcgaagcttttgaatattaaattttcctgagaaaagaatgtctgggcgaggaaagggaggaaaaggattgggaaagggaggagccaagaggcatcggaaagtcctccgagacaacatccaaggaatcaccaaaccagcgatccgtcgtctagcgagaagaggaggtgtgaagcgtatcagcggtttgatctacgaagagactcgcggcgttctcaagatctttctagagaacgtgattcgcgacgccgttacgtacacggagcacgctcgccggaaaacagtgacggccatggacgttgtctacgctctcaagaggcagggtcggactctgtatggattcggcggttgattcgattgtttcagtttcagatcttgtaaaatctttttcagaatcaatggcaaaatatgcatctttttctaaacaatcttggtcttgtttccgcgtataattatagtaaactgaaaggactctagttcgaatccccacaaggacattttgaccaatggctctttccttttggttgtgaaaactaattaatgcgcacgataaggtttttggactaaaagttatgttgaccaataaaaatgtaccaaaacgcggaaaatgtttactataatccttttttggttactatacatgttggactaaagatgttatggccc

SEQ ID NO: 2279 - DNA, 525 bp, Brassica napus
atcgaaccttctccaacactaatcttttctcaagataataaaaaacccaatttccttctgaaaaaatgtcgggtcgaggaaagggaggaaagggtttgggcaaaggaggagccaagcgtcacaggaaggttctgagagacaacatccaaggaatcaccaagccggcgattcggaggctggctcgtagaggtggagtcaagcgtatcagtggtttgatctacgaggagacacgtggcgtcctcaagatctttttggagaacgttattcgtgacgctgtgacatacactgagcacgctaggaggaagactgtgactgcgatggatgtggtctacgcgttgaagaggcaagggaggacgctttacgggtttggtggttaagggactttttagattcgcgttttgcgtttctgcggttcttatggaagtttctaatcgaatcatgttttccttagcgtttgtgttttgaattccgtttgagttcggtcttttgtgtgttgcgttagcgtttcgttatatgtaattacga

SEQ ID NO: 2280 - DNA, 569 bp, Brassica napus
gaaaacccaaacatcgaaccttctccaacactaatcttttctcaagataataaaaaacccaatttccttctgaaaaaatgtcgggtcgaggaaagggaggaaagggtttgggcaaaggaggagccaagcgtcacaggaaggttctgagagacaacatccaaggaatcaccaagccggcgattcggaggctggctcgtagaggtggagtcaagcgtatcagtggtttgatctacgaggagacacgtggcgtcctcaagatctttttggagaacgttattcgtgacgctgtgacatacactgagcacgctaggaggaagactgtgactgcgatggatgtggtctacgcgttgaagaggcaagggaggacgctttacgggtttggtggttaagggacttttaagattcgcgttttgcgtttctgcggttcttatggaagtttctaatcgaatcatgttttccttagcgtttgtgttttgaattccgtttgagttcggtcttttgtgtgttgcgttagcgtttcgttatatgtaattacgaattttatctatgaagttattcgagtttatgaa

SEQ ID NO: 2281 - DNA, 589 bp, Brassica napus
gcatcaaatcttatttgatatcttctctcgccgtctcctatcaatctacaggatatttagaatctctacagaaactttgtgaggagatgtcaggaagaggaaagggaggaaaaggattgggaaagggaggagccaagaggcataggaaggtgcttagggataacatccaaggtatcaccaagcctgccattcgtcgtcttgctcgtcgaggtggtgtcaagcgtattagcggtttgatctacgaggagaccagaggagtcctcaagatcttcctcgagaatgtcatccgcgatgccgtcacctacaccgagcacgcgaggaggaagactgtcaccgccatggatgtggtttatgctttgaagaggcaaggacgcactctctacggtttcggcggttaaatcgacggagattggattaagggtttcggaaagtttgggaatatcttgtttctgttgtctgcgttattaatttgattagtattaagtaaatccatgatgttagctattgttgtttttgccttttgtgatggtcgttagcaatgtttccttactgtagctaaacttttagctgataaaaatcttcaatgaaa

SEQ ID NO: 2282 - DNA, 612 bp, Brassica napus
gccatcaaatcttatttgatatcttctctcgccgtctcctatcaatctacaggatatttagaatctctacagaaactttgtgaggagatgtcaggaagaggaaagggaggaaaaggattgggaaagggaggagccaagaggcataggaaggtgcttagggataacatccaaggtatcaccaagcctgccattcgtcgtcttgctcgtcgaggtggtgtcaagcgtattagcggtttgatctacgaggagaccagaggagtcctcaagatcttcctcgagaatgtcatccgcgatgccgtcacctacaccgagcacgcgaggaggaagactgtcaccgccatggatgtggtttatgctttgaagaggcaaggacgcactctctacggtttcggcggttaaatcgacggagattggattaagggtttcggaaagtttgggaatatcttgtttctgttgtctgcgttattaatttgattagtataagtaaatccatgatgttagctattgttgtttttgccttttgtgatggtcctcgtcgttagcaatgtttccttactgtagctaaacttttagctgataaaaatcttcaatgaaagttagattgaacaatag

SEQ ID NO: 2283 - DNA, 591 bp, Brassica napus
aactctaacctcgattcttcttcatcacaaactttctcaatcggaaaaaaatgtcgggacgtggaaagggaggaaagggtttgggcaaaggaggagccaagcgtcacaggaaggttctgagagacaacatccagggaatcaccaagccggcgattcggagattggctcgtagaggtggagtcaagcgtatcagtggtctcatctacgaggagacacgtggcgtcctcaagatctttttggagaacgtcattcgtgacgccgtcacttacaccgagcacgctaggaggaagaccgtgactgcgatggacgtcgtctatgctctgaagaggcaggggaggactctctacgggttcggcggttaagggtcttcttagattcgcgtttgcgtttctgggtttcttttccggaaatttctaatcaaatcatgttctacttagcgtttgcgtttgaattatgtctgggtacggcgttttatgtgttgcggtagcgtttcgtttgatatgtaattacgccttttatcttatgttttagcggtgtaatgtcgaagtaatccaaggttaagtttctggaaaaatatattcgaattttatt

SEQ ID NO: 2284 - DNA, 608 bp, Brassica napus
gacaattcaactctaacctcgattcttcttcatcacaaactttctcaatcggaaaaaaatgtcgggacgtggaaagggaggaaagggtttgggcaaaggaggagccaagcgtcacaggaaggttctgagagacaacatccagggaatcaccaagccggcgattcggagattggctcgtagaggtggagtcaagcgtatcagtggtctcatctacgaggagacacgtggcgtcctcaagatctttttggagaacgtcattcgtgacgccgtcacttacaccgagcacgctaggaggaagaccgtgactgcgatggacgtcgtctatgctctgaagaggcaggggaggactctctacgggttcggcggttaagggtcttcttagattcgcgtttgcgtttctgggtttcttttccggaaatttctaatcaaatcatgttctacttagcgtttgcgtttgaattatgtctgggtacggcgttttatgtgttgcggtagcgtttcgtttgatatgtaattacgccttttatcttatgttttagcggtgtaatgtcgaagtaatccaaggttaagtttctggaaaaatatattcgaattttatttacacaagg

SEQ ID NO: 2285 - DNA, 607 bp, Brassica napus
atcaacgcagagtacgcggggatcgatctaaagatatttagaatctctaaaggaacttcgttagaagatgtcaggaagaggaaagggagggaagggattgggaaagggaggagccaagaggcacaggaaggtgcttagggataacatccaaggtatcaccaagcctgctattcgtcgtcttgctcgtcgaggtggcgtcaagcgtataagcggtttgatctacgaggagaccagaggagtcctcaagatcttcctcgagaatgtcattcgtgatgctgttacctacaccgagcacgccaggaggaagactgttactgctatggatgttgtttatgccttgaagaggcaaggtcgcactctctacggtttcggcggttaaattgagggagattggattagggattctaatcaatatgattagtaaaagtaaatcctggtgttagctattgttggttttgctattgtgctgttcctcgtcgttaggcaatgttttcatgtagcttagaaaatcttcaaatgaaagttagatttatcccaagttcaagttcatgttcattatgtatcccaaacgggttattttatcctttgttataaataaccatgtgca

SEQ ID NO: 2286 - DNA, 618 bp, Brassica napus
atcaacgcagagtacgcgggggtcaaatctccgtctccaatcaattaacatatctacataagcttgtgaagagagatgtcaggaagaggaaagggaggaaagggattgggaaaaggaggagcgaagaggcacaggaaggttctcagggataacatccaaggcatcaccaagcctgcgattcgtcgtcttgctcgcagaggtggagtgaagcgtattagcggtctgatctacgaggagaccagaggagtcctcaagatcttcctcgagaatgtcatccgcgacgccgtgacttacaccgagcacgctaggaggaagacggttactgctatggatgtggtgtatgctttgaagaggcagggacgcactctctacgggttcggcggttaaatcaacgatgtgttgtggaagaggggattagtagtgttctctgtcttgtacttgtagctaaaatcttagcaatgttatgttaacgagatttgagaataaacaatattatgtctttggttctcttagtttgatatgtgaatccaagctcaagtttaactttcatactttgttcatgtcaatgtctaactctcaagaacaacaagacaatcgtaaataaacttcgagcggaag

SEQ ID NO: 2287 - DNA, 753 bp, Brassica napus
  misc_feature (176)..(177): n is a, c, g, or t
gatcgtcgtcaatctcattttgctatctcgatttttcaggtatcgttttcttcttcttcctcgtgtttctgcaattttccggttcgtttcgcagattctcttattaaatcgagtttcaatatatttcgaattcgattgtgaattgattagatttgggaatctagggcttcttctgnnatcgtcgtcaatctcattttgctatctcgatttttcagatctttgaaaacttactgaggagatatgtcgggaagaggaaaaggaggaaagggattgggaaagggaggagcgaagaggcacaggaaggtgctgagggataacatccaaggtatcaccaagcctgccatccgtcgtcttgctcgcagaggaggtgtcaagcgtattagcggactcatctacgaggagacaagaggagtcctcaagatctttctcgagaatgtcatccgcgacgctgttacctacaccgagcacgctaggaggaagactgttacggctatggatgtggtttacgcgttgaagaggcaaggacgtactctctacggtttcggcggttaatcaaagattgtgatttttaggagatgggattagtgttacgggttatctgggagtgtattgtttctgttatccaatttgattagtgaaaagtaaaaacaaagagttagcttttgtgctaggtcttgtagccaatgtgatcgattgttaaatgaaagaatctttgaactaatatcatctcaaattcattttcattatttgagt

SEQ ID NO: 2288 - DNA, 557 bp, Brassica napus
gaccatcagaaatttactctattgttttccttaaatacttgttagaagatgtcaggaagagggaaaggaggaaaaggattgggaaagggaggagccaagaggcacaggaaggtgcttagagataacatccaaggtatcaccaagcctgctattcgtcgtcttgctcgtcgaggtggtgtcaagcgtatcagcggtttgatctacgaagagaccagaggagtcctcaagatcttcctcgagaatgtcatccgcgacgctgttacctacaccgagcacgccaggaggaagactgtcactgctatggatgtggtttatgctttgaagaggcaaggtcgcactctctacggtttcggaggttaaatcgacggagatgagtaaatccacgactgttgtatcattttctgctgtgttgttagccaacattatgttaaattaatcttaatcaaaagttgtgctgtgataatcctccatcttcaaagaaatttattttatattataaaagattatacaaagtaaaaaaacaaaacgttgaataaagaaaaataaagtaaagaaac

SEQ ID NO: 2289 - DNA, 625 bp, Brassica napus
gacaataagaaaataaatcgaacggccacgattgattatctaagatagtcgtcttctttataactcaccatctgaatctaaaaccctcaaatcatctaaattttcctagaaagttcaaaaaaaatgtcaggaagaggaaaaggaggaaagggattgggaaaaggaggagcgaagagacacaggaaagttctcagagacaacatccaagggatcacgaagcctgcgattaggcgactggctcgcagaggaggcgtgaagcggatcagcggcttgatctacgaagagacgagaggagttttgaagatctttctcgagaatgtgatcagagacgccgtgacttacactgagcacgcgaggaggaagacggttacggcgatggatgttgtttatgctctgaagaggcaaggtcgcactctctatggattcggtggttaaaatcggttgttttcggtttggtttctgggtggtgctgttgctgctgattaagtcggtttacttttttgttggttcgtttcttggtttgttattagcgtttgggtaattgcactatcttatatattaaaatagaagtcacaaccttgattcatgtgtgatttttttaaaaatggacctaatagacatatac

SEQ ID NO: 2290 - DNA, 616 bp, Brassica napus
  misc_feature (84)..(84): n is a, c, g, or t
  misc_feature (86)..(86): n is a, c, g, or t
  misc_feature (595)..(595): n is a, c, g, or t
  misc_feature (598)..(598): n is a, c, g, or t
  misc_feature (601)..(601): n is a, c, g, or t
gatctccgtctccgatcaattaacaggtatcgtcttcttcttcttatcgattgaattttcaatatcaaatgttaaatccactgntngtgatatctccgtctccgatcaattaacagatctagataagcttgtgaagagagatgtcaggaagaggaaagggaggaaagggattgggaaaaggaggagcgaagaggcacaggaaggtgctgagggataacatccaaggcatcaccaagcctgcgattcgtcgtcttgctcgcagaggtggagtcaagcgtataagcggtctgatctacgaggagacaagaggagtcctcaagatcttcctcgagaatgtcatccgcgacgccgttacttacaccgagcacgctaggaggaagacggttactgctatggatgtggtgtatgctttgaagaggcaaggacgtactctctacgggttcggcggttaatctacgatggattagcgttctctgtcttgtcttgtagctaaagcttatgctaatgagttgtcaaatgaaagctgagaatcattaatattatgtatttggttctcttagtttgatatatgaatctaagttcaagtttaactctnaanaanaacaagacaatcgtg

SEQ ID NO: 2291 - DNA, 528 bp, Brassica napus
atcaacgcagagtacgcgggatatcatcaatctctccgatcgatttacagatctttgaaaacttagcgaggagatatgtcgggaagaggaaaaggagggaaaggattgggaaagggaggagcgaagaggcacaggaaggtgcttagggataacatccaaggtatcaccaagcctgccatccgtcgtcttgctcgcagaggcggtgtcaagcgtattagcggtttgatctacgaggagacaagaggagtcctcaagatctttctcgagaatgtcatccgcgacgctgttacatacaccgagcacgctaggaggaagactgttacggctatggatgtggtttacgcgttgaagaggcaaggacgcactctctacggtttcggcggttaatcaaagattgggattaaatgttacggttatctgggaatcaatttgattagtgaaaagtaaaacaatgagttagcttttatgctatgtcttgtagccaatgtgatcttcatgtagctaaatcgattcttaaatgaaagagtg

SEQ ID NO: 2292 - DNA, 550 bp, Brassica napus
atcaacgcagagtacgcgggatatcatcaatctctccgatcgatttacagatctttgaaaacttagcgaggagatatgtcgggaagaggaaaaggagggaaaggattgggaaagggaggagcgaagaggcacaggaaggtgcttagggataacatccaaggtatcaccaagcctgccatccgtcgtcttgctcgcagaggcggtgtcaagcgtattagcggtttgatctacgaggagacaagaggagtcctcaagatctttctcgagaatgtcatccgcgacgctgttacatacaccgagcacgctaggaggaagactgttacggctatggatgtggtttacgcgttgaagaggcaaggacgcactctctacggtttcggcggttaatcaaagattgggattaaatgttacggttatctgggaatcaatttgattagtgaaaagtaaaacaatgagttagcttttatgctatgtcttgtagccaatgtgatcttcatgtagctaaatcgattcttaaatgaaagagtgtttgatctctattatctcaaag

SEQ ID NO: 2293 - DNA, 490 bp, Brassica napus
ggtctcacccctcttttatataaaaacctcattacctcccaatctctcaacatattattttctcccatcgaaggtttttaatattgaattttcccgagaaaaaatgtcaggccgcggaaagggaggaaaaggattgggaaagggaggagccaagaggcatcggaaagttctacgagacaacatccagggaattacgaaaccagcgatccgtcgtctggcgagaagaggaggtgtgaagcgtatcagcggtttgatctacgaagaaactcgcggcgttctcaagatctttctagagaacgtgattcgtgacgcggttacgtacacagagcacgctcgccgcaaaacagtcacggccatggacgttgtctacgctctcaagaggcagggccggactctgtacggattcggcggttaattcgattgtttcagtttcagatcttgtaaaatcttttttttttcagaatcaatgggaaaatatgcatctttttct

SEQ ID NO: 2294 - DNA, 534 bp, Brassica napus
gaaatcatccaattttccttcattcaatcctaaagaaagttaaaaaaaaatgtcaggaagaggaaaaggaggaaagggattgggaaaaggaggagcgaagaggcacaggaaagttctcagagacaacatccaagggatcacgaagcctgcgattaggcgactcgctcgcagaggaggcgtgaagcggatcagcggcttgatctacgaagagacgagaggagttttgaagatatttctcgagaatgtgatcagagacgccgtgacttacaccgagcacgcgaggaggaagacggtgacggcgatggatgttgtttatgctctgaagagacaaggacgcactctctatggattcggtggttaaaatcggtttggtttcttggtggtgctgttgctgctgattaagtcttgctgtcaagaaatcgagagatttattagggtttacttcttcgtctttgttggtttgtgattatggttttgggtaattgcagtactgtatcgaagtttatcttctggtataatgaaagtcctattact

SEQ ID NO: 2295 - DNA, 536 bp, Brassica napus
gaaatcatccaattttccttcattcaatcctaaagaaagttaaaaaaaaatgtcaggaagaggaaaaggaggaaagggattgggaaaaggaggagcgaagaggcacaggaaagttctcagagacaacatccaagggatcacgaagcctgcgattaggcgactcgctcgcagaggaggcgtgaagcggatcagcggcttgatctacgaagagacgagaggagttttgaagatatttctcgagaatgtgatcagagacgccgtgacttacaccgagcacgcgaggaggaagacggtgacggcgatggatgttgtttatgctctgaagagacaaggacgcactctctatggattcggtggttaaaatcggtttggtttcttggtggtgctgttgctgctgattaagtcttgctgtcaagaaatcgagagatttattagggtttacttcttcgtctttgttggtttgtgattatggttttgggtaattgcagtactgtatcgaagtttatcttctggtataatgaaagtcctattactct

SEQ ID NO: 2296 - DNA, 562 bp, Brassica napus
atcaacgcagagtacgcggggaccatcgaagctgcaagcgaatttactttttcctttttcttaaatactttgtgaggagatgtcaggaagagggaaaggagggaaaggattgggaaagggaggagccaagaggcacaggaaggtgcttagggataacatccaaggtatcaccaagcccgccattcgtcgtcttgctcgtcgaggtggcgtcaagcgtattagcggtttgatctacgaggagaccagaggagtcctcaagatcttcctcgagaatgtcatccgcgacgctgtcacctacaccgagcacgcgaggaggaagactgttactgctatggatgtggtttatgctttgaagaggcaaggacgcactctctacggtttcggcggttaaatcgacggaaatgagattagggtttcgaaagtttggggatctgaatttgggattttttttttttggtttctgattattcgaagtaaatccacgactgttgtatcgttttctgctgtgttgttagccaatattatgttgaattaatcttaatcaaaagttgtgctgtgataa

SEQ ID NO: 2297 - DNA, 537 bp, Brassica napus
gtcgtcaatctcattttgctatctcgatttttcagatctttgaaaacttactgaggagatatgtcgggaagaggaaaaggaggaaagggattgggaaagggaggagcgaagaggcacaggaaggtgctgagggataacatccaaggtatcaccaagcctgccatccgtcgtcttgctcgcagaggaggtgtcaagcgtattagcggactcatctacgaggagacaagaggagtcctcaagatctttctcgagaatgtcatccgcgacgctgttacctacaccgagcacgctaggaggaagactgttacggctatggatgtggtttacgcgttgaagaggcaaggacgtactctctacggtttcggcggttaatcaaagattgtgatttttaggagatgggattagtgttacgggttatctgggagtgtattgtttctgttatccaatttgattagtgaaaagtaaaaacaaagagttagcttttgtgctaggtcttgtagccaatgtgatcgattgttaaatgaaagaatctttgaa

SEQ ID NO: 2298 - DNA, 541 bp, Brassica napus
ctcgatttttcagatctttgaaaacttactgaggagatatgtcgggaagaggaaaaggaggaaagggattgggaaagggaggagccaagaggcacaggaaggtgctgagggataacatccaaggtatcaccaagcctgccatccgtcgtcttgcccgcagaggaggtgtcaagcgtataagcggactgatctacgaggagaccagaggagtcctcaagatcttcctcgagaatgtcatccgtgacgctgttacatacaccgagcacgctaggaggaagactgttacggctatggatgtggtttacgcgttgaagaggcaaggacgcactctctacggtttcggcggttaatccaaagattgagattagtgttacggttatctgggagtgtattgtttctgttatccatttgattagtaaaaagtaaagcaatgtcttgtagcctatgtgatcttcatgtagctaaaatctctgcaagggattcttaaatgaaagttgtttttgaaccatgtgatctctattttctcaaattcaatttcatt

SEQ ID NO: 2299 - DNA, 453 bp, Brassica napus
  misc_feature (434)..(434): n is a, c, g, or t
  misc_feature (439)..(439): n is a, c, g, or t
ctttttttctctgatttttaagccttttcgaggaaaagaaaatgtctgggagaggaaagggtggaaagggacttggaaagggaggagccaagaggcacaggaaggtcctccgtgacaacatccagggcatcacgaagccggcgattcgtcgtttagcgagaagaggcggtgtgaaacgtatcagcggtttgatctacgaggagactcgcggcgttctcaagatcttcctcgagaatgtgatccgtgacgctgtgacttacactgagcacgcgaggaggaagactgtgacggcgatggatgttgtgtacgcgttgaagaggcaggggaggactctgtacgggttcggcggctgaggggattgaattagggttttgtaaatcgcgtctgggttgttttccgggctggagaagcctttaagctgttggtcggtttgntgagnatgtcccacactga

SEQ ID NO: 2300 - DNA, 515 bp, Manihot esculenta
taatccgatcgtaccttgaagatgtcgggccgtggaaagggaggcaagggattgggcaagggaggagccaagcggcacaggaaggttctccgagataacattcagggaatcaccaagcctgctattcgtcgtctggctcgtagaggtggtgtgaagaggatcagtgggttgatctatgaggagactcgtggagtattgaagatctttttggagaatgtgatccgtgatgctgtgacctacactgagcacgcgagaaggaagacggttactgctatggatgtggtttatgcattgaagaggcagggaaggactctatacgggttcggtggttaaacttcaaatctttttggtgtaattagtaaattaaatgttctagtttggggattttatgtgttgtagtaggatagttaatggtttttgtaactcttgcttttaatggcaactttattgcctgtaattcgtgctttgaattacaacttcaatgaaattgggttcaattctgttgaattttttcc

SEQ ID NO: 2301 - DNA, 515 bp, Manihot esculenta
taatccgatcgtaccttgaagatgtcgggccgtggaaagggaggcaagggattgggcaagggaggagccaagcggcacaggaaggttctccgagataacattcagggaatcaccaagcctgctattcgtcgtctggctcgtagaggtggtgtgaagaggatcagtgggttgatctatgaggagactcgtggagtattgaagatctttttggagaatgtgatccgtgatgctgtgacctacactgagcacgcgagaaggaagacggttactgctatggatgtggtttatgcattgaagaggcagggaaggactctatacgggttcggtggttaaacatcaaatctttttggtgtaattagtaaattaaatgtttttgtttggggattttatgtgttgtagtaggatagttaatggtttttgtaactcttgcttttaatggcaactttattgtgtgtaattcgtgctttgaattacaacttcaatgaaattgggttcaattctgttgaaaaaaaaaa

SEQ ID NO: 2302 - DNA, 566 bp, Manihot esculenta
accggatcgagcaagctcttaatctctcttatttgattctatcctcaagtttctccatatcagatccagtttctaaacaaaaatgtctgggcgtggcaagggaggcaagggcttgggaaaaggaggagccaagcgtcaccgcaaggtccttcgagataacattcaaggaatcacaaagccagccattcgtcgattggctcgcagaggtggtgtgaaacgtatcagtggtttgatctatgaagagacccgtggagtactgaagatcttccttgagaatgtgatcagagatgctgtgacctacacagaacacgcccggcgcaagactgttacagccatggatgtggtgtatgccttgaagagacaaggcaggaccctttatggatttggtggttagggcttttagttttattggattgaaagtcttgctgtcaagaaattgtgtttctttagctttaggtgtttgtgggtgtgtggttatttgtaagtaattcaatgggtttgatctgattttgagcttttgttgtaactatggtggatttggaatgaaatggtggtgtttgattcat

SEQ ID NO: 2303 - DNA, 475 bp, Manihot esculenta
ctctttagctctaatttcgatcaacgagaagatgtcgggccgcggaaagggaggaaaggggctgggaaagggaggagcgaagcggcacaggaaggttcttcgcgataacatccagggaatcactaagcctgcaattcgtcgtctggctcgaagaggtggcgtcaagaggatcagtgggttgatttacgaagagacccgtggagtcttgaaaattttcttggaaaatgtgatccgtgatgccgtgacttacactgagcacgcaagaagaaagacggtgactgccatggatgtggtgtatgcattgaagaggcagggtaggactctgtacggattcggtggttaaagttgaagctttttgttgtaattagtttttgtattttagggattgttgattattgtgtaggaaagttaatgggtttcgtttaattcatgttttggattgcaatagcaatgaaattggattcagtttctttta

SEQ ID NO: 2304 - DNA, 548 bp, Manihot esculenta
aaatcgaatcccgctgaagcttatcaatcttaaaactctctgttagaagttttcaaaatctttccgggaaaatgtctggtcgtggaaagggaggcaagggtttgggaaagggaggagccaagaggcacaggaaggtcctaagagataacattcagggcatcaccaagcctgctattcgtcgtttggctcgtagaggcggtgtgaagaggattagtggcttgatctatgaggagactcgtggagtcctcaagatcttcttggagaacgtgattcgcgatgctgtgacttatactgagcacgccaggagaaagactgttaccgcgatggacgtggtttatgccctcaagaggcagggaaggactctgtatggttttgggggttaggttttatatgtttattttgaggtaggactcttaggaattagggtggtagtttatgggattgtagatcttttctttagatctgggacttctttctgaatatggcttctaatattagtgtaattgccaccttttctcaagtaatagaatttttattttctggtagaa

SEQ ID NO: 2305 - DNA, 566 bp, Manihot esculenta
  misc_feature (427)..(427): n is a, c, g, or t
gaaagcgaatcccgctgaagcttttcaatcttaaaactctctgttagaagttttcaaaatctttccgggaaaatgtctggtcgtggaaagggaggcaagggtttgggaaagggaggagccaagaggcacaggaaggtcctaagagataacattcagggcatcaccaagcctgctattcgtcgtttggctcgtagaggcggtgtgaagaggattagtggcttgatctatgaggagactcgtggagtcctcaagatcttcttggagaacgtgattcgcgatgctgtgacttatactgagcacgccaggagaaagactgttaccgcgatggacgtggtttatgccctcaagaggcagggaaggactctgtatggttttgggggttaggttttatatgtttattttgaggtaggactcttaggaattaggntggtagtttatgggattgtagatcttttctttagatctgggacttctttctgaatatggcttctaatattagtgtaattgccaccttttctcaagtaatagaatttttattttctggtgaaaaaaaaacttaaaaatcg

SEQ ID NO: 2306 - DNA, 636 bp, Manihot esculenta
aatctctcaattcttcctgcttctaaaatttattaaaatcagatccttctcgtgaagaacaatgtctggacgtggcaaaggaggcaaagggctaggaaagggaggagccaaacgacatcgcaaggtccttcgagataatatccaaggaatcaccaagccagcaattcggcgtttggctcgcaggggtggagtgaagcgtatcagtggtctgatctatgaagaaacccgtggagtactcaagattttccttgaaaatgtgattagagacgcagtgacctacacagaacacgctcgccggaagactgttacagccatggatgtggtgtatgcattgaagaggcagggcagaaccctttatgggtttggtggttaagagggttttgattgtgattgcaagtcttgctgtcaagaaattgtgtactttttgggtagatgtttagatgggaagatagtggtttttgggttggggattattgtaagtaatctgatgggttaatggccaatgggtatgcttttggttttgttgttttgggttctgctgtgaccacggtgaatttggactgaaatgaaaatggtggtgtaaaccaatttaatcttgttttcttcttcttattatttctgattttgttgttgaat

SEQ ID NO: 2307 - DNA, 504 bp, Manihot esculenta
aatctctcaattcttcctgcttctaaaatttattaaaatcagatccttctcgtgaagaacaatgtctggacgtggcaaaggaggcaaagggctaggaaagggaggagccaaacgacatcgcaaggtccttcgagataatatccaaggaatcaccaagccagcaattcggcgtttggctcgcaggggtggagtgaagcgtatcagtggtctgatctatgaagaaacccgtggagtactcaagattttccttgaaaatgtgattagagacgcagtgacctacacagaacacgctcgccggaagactgttacagccatggatgtggtgtatgcattgaagaggcagggcagaaccctttatgggtttggtggttaagagggttttgattgtgattgcaagtcttgctgtcaagaaattgtgtactttttgggtagatgtttagatgggaagatagtggtttttgggttggggattattgtaagtaatctgatgggttaatggccaat

SEQ ID NO: 2308 - DNA, 637 bp, Manihot esculenta
agacgttcttctacttgagattgaaatcagaggaaacgaaggaaagggaagagattaaagatgtctggcagaggaaagggcgggaagggtttgggaaagggaggagctaagaggcacagaaaagtgctccgggataatatccagggcatcaccaagcctgctattcgaaggttggccaggcgtggcggtgtaaaacgtatcagcggtctcatctacgaggagactagaggcgtcctcaagatcttcctcgagaacgtcattcgtgatgccgttacatacaccgagcacgctcgccgtaagactgttactgctatggatgtcgtctatgctttgaagaggcagggcaggacactttacgggttcggtggttagagatttggggtttcctttagggttagggttgatgtttgcttgtactaatggagaatggtgtttgtttaattgaagtttctcattatttgtctatttttacattgaattctgttttttaattttattgttacctttttccttttatctattctgtttggatggtgagaaaacggtaggacttcactggataaagtaagctaatccaaactatgtgttttgggatcgaacaactttaatttaatgaacatttaattgaaaaaaaaaa

SEQ ID NO: 2309 - DNA, 641 bp, Manihot esculenta
  misc_feature (5)..(5): n is a, c, g, or t
gagangttcttctacttgagattgaaatcagaggaaacgagggaaagggaagagattaaagatgtctggcagaggaaagggcgggaagggtttgggaaaagggaggagctaagaggcacagaaaagtgctccgggataatatccagggcatcaccaagcctgctattcgacggttggccaggcgtggcggtgtaaaacgtatcagcggtctcatctacgaggagactagaggcgtcctcaagatcttcctcgagaacgtcattcgtgatgccgttacatacaccgagcacgctcgccgtaagactgttactgctatggatgtcgtctatgctttgaagaggcagggcaggacactttacgggttcggtggttagagatttggggtttcctttagggttagggttgatgtttgcttgtactaatggagaatggtgtttgtttaattgaagtttctcattatttgtctatttttacattgaattctgttttttaattttattgttacgtttttccttttatctgttctgtttggatggtgagaaaacggtaggacttcactggataaagtaagctaatccacactatgtgtttggggatcgaacaactttaatttaataaacatttaatttaaaaaaaaaaaa

SEQ ID NO: 2310 - DNA, 595 bp, Manihot esculenta
ggagccagcagtctctttccctcagcttcgctctacaaagtccgacacgtaagatccttcctgtgaacaaaaatgtctggccgtggcaagggaggcaagggactaggaaagggaggggccaaacgtcaccgcaaagtccttcgcgataacatccaaggcatcacaaagccagcaattcggcgattggctcgcagaggtggtgtaaagcgtatcagtggattgatctatgaagagacccgtggagtgctcaagatcttccttgagaatgtgattagagatgctgtgacctacacagaacacgctcgccggaagactgttacggccatggatgtggtgtatgcattgaagagacaaggcagaaccctttatgggtttggtggttagggctttggattgggattttaagtcttgctgtcaagaaattgtgtagtttttgggctatgtatgtgttgagaagggtaggttggtaattttggattagtgtaagcaattcaatagattaggcctttggttttggttttgaccatgcttctgggttttgttgtaactatgctgaagttggaatgcaacgaaatgaaatgggggtgtttgattc

SEQ ID NO: 2311 - DNA, 974 bp, Ricinus communis
aattcgagcaagtgaattgagaaagcaagacaaaaaaaaaaaaaaaaaaagagcaaagaaaatgtcaggaagaggaaagggagggaaaggattaggaaagggaggagcaaagaggcacaggaaggtattaagagataacattcaaggtattacaaagccagcaattagacgtcttgctcgcagaggaggcgtcaagcgtatcagtggtctaatttacgaagagacaagaggcgttttaaagatctttttggagaatgtgattcgtgatgctgttacttacactgagcatgctcgtagaaaaactgttactgccatggatgtcgtttatgctcttaaacgtcaaggccgtaccctctacggctttggtggttgatttttctatttttttaggatatcttttagtagatctctgtttgtatttctgtttatttgtaaacagatctggatctgtggatctaattgaatctgatttccattatttgccttgtcgtaatttcaaaaacactgatctgaacctctgatgagatgttcgttacgaaattcgggtccgcttcaacataccgtagggcatactgtgccctttctcaagccattcattctttattacacgctagtcgaggatttaaggagaccttttatcatgaagtagagagtagaattcagtgctttgtgagcccattaagaacaatactgctgatggtacggctcccataggatcagatgaaagctcatatagtatttcaaagtgtttgtttcttgattttatttttttaattacgcagtttctgttttttttaaagcatttatattttgataactggagcgtctttttgaagcattttaattatattttttttagttttcaatcacatgaaatattctttttgttggacatgaatttaactgagctcgtgatttcatgtttttattttgggagtatgtagcacacgttggtcatcttacttaattacatc

SEQ ID NO: 2312 - DNA, 756 bp, Ricinus communis
atgtcaggaagaggaaagggagggaaaggattaggaaagggaggagcaaagaggcacaggaaggtattaagagataacattcaaggtattacaaagccagcaattagacgtcttgctcgcagaggaggcgtcaagcgtatcagtggtctaatttacgaagagacaagaggcgttttaaagatctttttggagaatgtgattcgtgatgctgttacttacactgagcatgctcgtagaaaaactgttactgccatggatgtcgtttatgctcttaaacgtcaaggccgtaccctctacggctttggtggttgatttttctatttttttaggatatcttttagtagatctctgtttgtatttctgtttatttgtaaacagatctggatctgtggatctaattgaatctgatttccattatttgccttgtcgtaatttcaaaaacactgatctgaacctctgatgagatgttcgttacgaaattcgggtccgcttcaacataccgtagggcatactgtgccctttctcaagccattcattctttattacacgctagtcgaggatttaaggagaccttttatcatgaagtagagagtagaattcagtgctttgtgagcccattaagaacaatactgctgatggtacggctcccataggatcagatgaaagctcatatagtatttcaaagtgtttgtttcttgattttatttttttaattacgcagtttctgttttttttaaagcatttatattttgataa

SEQ ID NO: 2313 - DNA, 479 bp, Ricinus communis
atcaaaagacaaagcaaatcagaaaggaaaacacagatacaggaacaaatacaggaatagaaaatgtcaggaagaggaaagggaggcaaaggattagggaagggaggagcaaagcggcatcgtaaggtgctaagggataacattcagggaatcacgaagccagcaatacgacgattggccaggcgtggaggagttaagcgaattagcgggttgatctacgaagagacgagaggcgtactcaagatttttctagagaatgtgattcgtgatgcggttacctacactgagcatgctcgtagaaagaccgttactgccatggatgttgtttatgctttgaagaggcagggcaggactctttatggctttggcggttaagcaattttagggtttttttgttttgtttcagggagtttgattggttttgatgtaatgatgagattagtattatagttaattgaatcaatcaatggatgaatttt

SEQ ID NO: 2314 - DNA, 312 bp, Ricinus communis
atgtcaggaagaggaaagggaggcaaaggattagggaagggaggagcaaagcggcatcgtaaggtgctaagggataacattcagggaatcacgaagccagcaatacgacgattggccaggcgtggaggagttaagcgaattagcgggttgatctacgaagagacgagaggcgtactcaagatttttctagagaatgtgattcgtgatgcggttacctacactgagcatgctcgtagaaagaccgttactgccatggatgttgtttatgctttgaagaggcagggcaggactctttatggctttggcggttaa

SEQ ID NO: 2315 - DNA, 457 bp, Ricinus communis
aaaagacaaagcaaatcagaagggaaaacacaaattcaggaaagaaaatgtcaggaagaggaaagggaggcaaaggattaggaaagggaggagcaaaacggcatcgtaaggtgctaagggataacattcagggaatcacgaagccagcaatacgacggttggccaggcgtggaggagttaagcgaattagcgggttgatctacgaagagacgagaggcgtacttaagatttttctagagaatgtgattcgtgatgcggttacttacactgagcacgctcgtaggaagactgttactgccatggatgttgtttatgctttgaagaggcagggcaggactctttatggctttggcggttaagcaacttagcgattggggggtttgattgattttgatgtaatgatgagattagtattgtaattaattgaatcaatcaacggatgaattttcagattttt

SEQ ID NO: 2316 - DNA, 312 bp, Ricinus communis
atgtcaggaagaggaaagggaggcaaaggattaggaaagggaggagcaaaacggcatcgtaaggtgctaagggataacattcagggaatcacgaagccagcaatacgacggttggccaggcgtggaggagttaagcgaattagcgggttgatctacgaagagacgagaggcgtacttaagatttttctagagaatgtgattcgtgatgcggttacttacactgagcacgctcgtaggaagactgttactgccatggatgttgtttatgctttgaagaggcagggcaggactctttatggctttggcggttaa

SEQ ID NO: 2317 - DNA, 604 bp, Ricinus communis
atatctcaaattgtgaattcaaaaatccagagaaacatttcggagaaaaaatgtcagggcgtggaaagggaggcaagggattgggaaagggaggagccaagaggcacaggaaggtgttgagagataatattcaaggcattacaaagcctgctatacgtcgtttggctcgtagaggcggtgtcaagagaatcagtgggctgatctacgaggagactcgtggggttcttaagatcttccttgagaatgtgattagagatgctgtcacctacactgagcatgctaggagaaagactgttactgccatggatgttgtttatgctttgaaaaggcaaggcagaactctttatggttttggaggttaaggaagaacttgctttatggttctggaagtcttgctgtcaagaaatttagatggggttagtggtctcggccatggcggcgcttttgcgttttcagggttagggttaggagggttagggttcttttgaaagaaaacaaaaagtgaaatgctgtgtaattagtgggtgtcttagggttgtttttgtgtaattcatgctttgaatttcaggtctaatgaaatattgtattgactatttctgtgcca

SEQ ID NO: 2318 - DNA, 312 bp, Ricinus communis
atgtcagggcgtggaaagggaggcaagggattgggaaagggaggagccaagaggcacaggaaggtgttgagagataatattcaaggcattacaaagcctgctatacgtcgtttggctcgtagaggcggtgtcaagagaatcagtgggctgatctacgaggagactcgtggggttcttaagatcttccttgagaatgtgattagagatgctgtcacctacactgagcatgctaggagaaagactgttactgccatggatgttgtttatgctttgaaaaggcaaggcagaactctttatggttttggaggttaa

SEQ ID NO: 2319 - DNA, 499 bp, Ricinus communis
atccatccgaacatcgaagttgacactgatagcaaacaaaatagaaaaaaatgtcagggagaggaaagggagggaaagggctgggaaaggggggagcgaagaggcacaggaaggtgctgagagataatattcaagggatcacaaaaccagccatccgcaggctggcccgtaggggtggagtcaagcgtattagtggcctcatttatgaggagaccagaggcgtcctcaagatctttcttgaaaatgttatccgcgatgctgttacatacactgaacatgctcgtagaaaaactgttactgctatggacgttgtttacgctcttaagagacagggccgcactctttatggttttggtggttgatttgtttctttcttcttttttgttttccccaagtttgaagggtagggtcatttgtactaaattttttggttgattccatttttgaaatcttccacatgtttattaagttaatatatgaattagaccttttagttttc

SEQ ID NO: 2320 - DNA, 312 bp, Ricinus communis
atgtcagggagaggaaagggagggaaagggctgggaaaggggggagcgaagaggcacaggaaggtgctgagagataatattcaagggatcacaaaaccagccatccgcaggctggcccgtaggggtggagtcaagcgtattagtggcctcatttatgaggagaccagaggcgtcctcaagatctttcttgaaaatgttatccgcgatgctgttacatacactgaacatgctcgtagaaaaactgttactgctatggacgttgtttacgctcttaagagacagggccgcactctttatggttttggtggttga

SEQ ID NO: 2321 - DNA, 624 bp, Ricinus communis
atctcaccgaaacaagcaatctctttgttctttcttcgattccctcccttgagaatttccatttcaagctttttctagatcttctatttgaaccgaaagaatgtctggacgtggcaaaggaggaaaaggactaggaaagggaggcgcaaagcgacaccgtaaggtacttcgtgataacatccaaggaataacgaagccagcaattcggcgtttggctcgtagaggtggtgtgaagcgtatcagtgggttgatctacgaagagacacgaggtgtcctcaagatcttcctcgagaatgttatcagagatgctgtcacatacactgagcacgctcgccggaagactgtgactgccatggatgttgtctatgcactcaagaggcaaggcaggactctttatgggtttggtggttagggcttttgattttgttttcaattagttgaaagtcttgctgtcaagaaatttaggattactgctccgtttttttaggtttttattagatgggctgggctatttgtaaatgataatgtaatggggttgggctagtgaatgggtctttctagtatggctttttagtgtaacttctttggattttggaatgaaatggtgatggtgtttgatgcagt

SEQ ID NO: 2322 - DNA, 1070 bp, Ricinus communis
gcaatctctttgttctttcttcgattccctcccttgagaatttccatttcaagctttttctaggtattttatcttttcttttctctgttttttatttcctgatttgccgttttttcttttttatcaattctcgtttcctattgctgtgttcttcgagtgatttatgctttgaacagtttaaaaaaaaaaaaaaacaaaattaaagttttgttattttagggtttacagcttttgattgtggttcaaaacttgctcattttctctaagtttcctgaaattctttacgtgatcttgttaatatctaattgaaattctcactgttaagatttttctgttctggctgtttgttttctgggaaaatgtgagaaaatgagttccaataggttaatcaccgtctcagtcacgcatatactggattttagttttatttatttattcgttttacagaattgcatttgttaatcttcgcccctgcctgttttgtttctataaaaaactaaatgtattaattctgtttgtacagatcttctatttgaaccgaaagaatgtctggacgtggcaaaggaggaaaaggactaggaaagggaggcgcaaagcgacaccgtaaggtacttcgtgataacatccaaggaataacgaagccagcaattcggcgtttggctcgtagaggtggtgtgaagcgtatcagtgggttgatctacgaagagacacgaggtgtcctcaagatcttcctcgagaatgttatcagagatgctgtcacatacactgagcacgctcgccggaagactgtgactgccatggatgttgtctatgcactcaagaggcaaggcaggactctttatgggtttggtggttagggcttttgattttgttttcaattagttgaaagtcttgctgtcaagaaatttaggattactgctccgtttttttaggtttttattagatgggctgggctatttgtaaatgataatgtaatggggttgggctagtgaatgggtctttctagtatggctttttagtgtaacttctttggattttggaatgaaatggtgatggtgtttgatgcagtg

SEQ ID NO: 2323 - DNA, 496 bp, Catharanthus roseus
gaattcggcacgaggtagaaatctctcatcttccctattcgaaaaatgtctggccgtggtaagggtggtaagggtttgggaaaaggtggagccaagaggcacaggaaggtcttgagggataatattcagggtatcactaagcctgctatccgaaggcttgccagaagaggcggagttaagagaatttctgggttgatttatgaagagactcgtggggtgttgaagattttcttggaaaatgtcatccgtgatgctgttacctataccgagcatgctcgccgcaagaccgtgactgccatggatgttgtttacgcattgaagagacagggaaggactctttatggatttgggggttaggtttctagttagggttaagtactgcaatttgtacgggtgtttttagttaggtgtatctgtgatactttgatgttaagactgggtctattttgtaattgcttgttgcattttgagactaatggatctacaaatttctaag

SEQ ID NO: 2324 - DNA, 1050 bp, Catharanthus roseus
tagtggatccaaagaattcggcacgaggctctaccgagctctgctgcattctagagtcaaaatgccttcccacaagacatttatgatcaagaaaaaattggcaaagaagcagaggcagaaccgacccatcccttattggatccgaatgcgaactgacaacacaatcaggtataatgcgaagaggagacattggcgccgtactaaattagggttttaagttcttagcttttggaagcaatgtctttaacatcagagtttggctggaatgtttttgggattttatatgtgaatcttctagtgagatgaaccctatagtaatttttggagttacttttgaaggatcttaaagtaatgggtttgatattatatgcaaatccttttcatttcttcaaaaaaactagtggatccaaagaattcggcacgaggctctctctcttccaaatactcatctaatttagaaacaactctccttcttccccattcgaaaatgtctggccgtggaaagggtggcaagggcttgggcaaaggtggagccaagaggcacaggaaggttctcagggataatattcagggtatcactaagcctgctatccgtaggcttgccagaagaggtggagttaagagaatttctgggttgatttatgaagagactcgtggggtgttgaagattttcttggaaaatgtcatccgtgatgctgttacctatactgagcacgctcgccgcaagacggtcactgcaatggatgttgtttacgcattgaagagacagggaaggactctttatggatttgggggttaggtttctaggtagggttaagtactgcaatttgtatggtgttattagtcaggtgtatgggtgatacttgttaaggctgggtttattttgtaattgcttgttgcattttgagactaatggatctacaaatttctaagaatttttttggctttgagttcattttgttcatgaactttttataattatttgatgtatttataattttctgttttaaaagttagggatggccatttatgcattgatatattttgtgg

SEQ ID NO: 2325 - DNA, 573 bp, Cenchrus ciliaris
  misc_feature (469)..(469): n is a, c, g, or t
  misc_feature (492)..(492): n is a, c, g, or t
  misc_feature (536)..(536): n is a, c, g, or t
  misc_feature (565)..(565): n is a, c, g, or t
ctcttcctccagattccaattccctccgagcggttgctgcgagcgaagcttccctgtttccggcgatgtcggggcgcggcaagggcggcaaggggctgggcaagggcggcgccaagcgccaccgcaaggtgctccgcgacaacatccagggcatcaccaagccggcgatccggaggctggccaggaggggcggcgtcaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggtggctagatctgttcctcttctggtggcggactacatgtggtggtggtgtgctctgggcatagtgtagtagtcagtgctctctgtatcgatgctgtgtnctgtgctggttgtgcccaactcntcaaggtgttcagagtctctagtctgtctgctgtaatgtctagntgatgtttttaatggaaaaccctcggttntagcctca

SEQ ID NO: 2326 - DNA, 540 bp, Cenchrus ciliaris
cttgactcccacctctactccaatccactcctccgaagaatccacctccgtcggcaagcatgtctgggcgcggcaagggcggcaaggggctcggcaagggcggcgcgaagcgccaccggaaggtgctccgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctgatgcgcccgtccccttcgctgtctccctcctgcagctccggcgttgtctggtcgtgctcacaagtcttgcggtcaagaaggtttcagactcgcttgtttagctcatctctggctgtagtaggtttatctcatgagacagtaatgaaatgatctgattggaaatca

SEQ ID NO: 2327 - DNA, 656 bp, Cenchrus ciliaris
  misc_feature (332)..(332): n is a, c, g, or t
  misc_feature (598)..(598): n is a, c, g, or t
gtagtctcctcttcacacgagagccacaaccaccaccaacaacccaccacttcagaagcgcggcggagatgtcgggcaggggcaagggcggcaaggggctcggcaagggcggcgcgaagcgtcaccggaaggtgctccgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtntacgcgctcaagcgccagggccgcaccctctacggcttcggcggctaggttaggtgtctgtctgtgtgtggttcggatcgatgggtagctttgtgtcgccttcatgtgttcttgtggtagttgctgtagcggagatgtagctggttgattggtcctttcggtgtcggatttgtggatgtaagaaccgctggttcgaagcaatttgtctggattggatgctgatgtaggaaatcaatttcatcttaactttttgtgctgcccctagntgcttggatgtaaaattttcacaattaacactcaattttctgcgaatctttctaatca

SEQ ID NO: 2328 - DNA, 616 bp, Cenchrus ciliaris
caaaaaaaaaaaaaaaaaactcgaggcacctccaaaaatttccccaattcaggccagcgcgcgagagggcggaagcagcggccagggccggcgatgtcggggcgcggcaagggcggcaagggtctgggcaagggcggcgccaagcgccaccggaaggtgctccgcgacaacatccaggggatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtggtctacgcgctcaagcgacagggccgcaccctctacgggttcggcggctaggtctgagcgctcgagtcctgccgggggccgccgcgtcccgcgggcgttcgtgggtgggcgtcttctgtgattagggatgcttcgttcttgaggtatttgaattgtgacgttgtggtagttgtttggtgttgcagttaggcgttgctgcccctctggattgtaatctgaatctacgcagttaagaaatgctagtgctatcaccttgtcgaga

SEQ ID NO: 2329 - DNA, 572 bp, Centaurea maculosa
taggcggggatacaggctccacttcatttctgcaatccacaagatccatcagatttccaagctatttgaagaaaattcgataatgtctggccgtggaaagggaggaaagggattggggaaaggaggtgcgaagcgtcaccggaaagttctccgagataacatccagggaatcacgaagccggcgatccgtcgattggcgagaagaggcggtgtgaagcgtatcagcggcttgatctacgaagaaactcgcggagttcttaagatctttctagaaaacgtgatcagagacgccgtcacctacaccgagcacgcacggcggaagacggtgaccgccatggacgtggtgtatgcgctcaagagacagggccgtacgctttacggattcggtggttagggttttggaaaatttggggggaaagtcttgctgtcaagaaagatttgggtcgggttaggatccgagtttggtgttttgtgggtattggtgtagttagtggtttgtgtcttttgttactataaagaaagtaatggaaatgattttattgggttatctaagaaaagaaaagaaaaaaaag

SEQ ID NO: 2330 - DNA, 574 bp, Centaurea maculosa
cggggatctcaacgctcatctccatttcttcaatccacaagatccatcagcagatttcgtagcaatttgaagaaaattcgataatgtcgggccgtggaaagggaggcaaaggactgggaaaaggaggtgcgaagcgtcaccggaaagttctccgagacaacatccagggaatcacgaagccggcgatccgtcgattggcgagaagaggcggtgtgaagcgtatcagcggcttaatctacgaagaaactcgcggagttcttaagatctttctagaaaacgtgatcagagacgccgtgacctacacggagcacgcacgccggaagacggtgaccgccatggatgtggtgtatgcgttgaagaggcagggccgtacgctgtacggattcggtggttagggttttgggaaattgggtgggaaagtcttgctgtcaagaaagattcgggtcgggttaggatccgagtttggtgttttgtgggtatgggttgtagttagtgtttgttactataaagaaagtaatggaatgattttattggctttgacatatgttatcaaatgattggtttttgattttac

SEQ ID NO: 2331 - DNA, 698 bp, Castanea mollissima
tttaactttagttttctttttctcaaaaacaaaagaatcagtgagaaaaaatgtcaggaagaggaaaaggaggcaagggtttgggaaagggaggagcaaaacggcaccgtaaggttctgagggataacatccagggaattaccaagcctgccattcggcgtttggccaggcgtggcggagtcaagcgtatcagcgggctcatctacgaggagacacgtggcgtcctcaagatcttcttggagaacgtgattcgcgatgctgtgacctacaccgagcacgctcgccgcaagactgttaccgccatggatgttgtttacgctttgaagaggcagggcaggactctttatggttttgggggttaagaagggaggttagagttagttagggttagggtttagtatttggattgtgtttcgaaattaggggttctgttgtaattggaaattaattgttattcgactgattttcttcctattctcttccatccaattattttgctatttgctttgttttgagtttatactatgtatgaaattatgaatagaatcttggtagttggtggctgaagaattaaggagcatatggaaattctctgcttactgagatttcggttcaattgtatgttaaaacacatcccaacgaggttcaccgaaccatacatttgatgttgggtttgaatttctgagtatagtcataca

SEQ ID NO: 2332 - DNA, 604 bp, Castanea mollissima
atttaactcaccaaattcccaattcagattttttagaattcaagtcttggaaaatgtctgggcgtggaaagggaggcaagggtttgggaaaaggaggagcgaaacggcatcgtaaggtgcttcgcgataacatccagggaatcaccaagcccgcgattcgccgattggctcgcaggggtggagtgaagcgtatcagcggtctgatctacgaggagacacgtggcgtcctcaagatcttcttggagaacgtgattcgcgacgccgtgacctacactgagcacgctaggaggaagaccgtgacggccatggacgtcgtctatgccttgaagaggcaaggaaggactctctacgggtttgggggttaggggttttgtgttttgtgtttggtatgggactttgggaaacaagtcttgctgtcaagaaagtccgatggtggttggtgtttttttgttttgtaattagggggtggttctacttcaaatatgtgggtttttagggtttggttttaggtttagttttagttctacttgtttgtgaatcaaactctgaattgcaagctatgaagatttaatgcaaactagtttttgttaaattgaagtatgaa

SEQ ID NO: 2333 - DNA, 571 bp, Castanea mollissima
ctctctcagtctctctcgcccttttcgtttggatcagagtgtgcgatacagatcttgaatttgacctaacaaaatgtctggaagaggaaagggaggcaaggggctaggaaaaggaggagcgaaacgacatcgtaaggttctccgtgataacatccagggaatcacaaagcctgccattcgtcgtttggctcgtagaggaggagtgaagcgtatcagcggtctcatctacgaggagacacgtggagtgctcaagatctttctcgagaatgtgatcagggacgctgtgacttacactgagcacgcgcgtcgcaagactgtgactgccatggatgtcgtgtatgctctcaagaggcagggcaggaccttgtatgggtttgggggttagggtttttggcaagaatagtcggtgttttggaatcgaaggtagatttggcaaatttaggatttggtttgttttgttagcttgtattaaaatgttatgggtttgtaagtactgggttgagttttattttgtattggggaatggttgaactttggaattaaaattgaaagttggtggtgtttgatccct

SEQ ID NO: 2334 - DNA, 500 bp, Castanea mollissima
atcaatctctcaaaaacaaagagttaagagagaaaaaaaatgtcaggaagaggaaagggaggcaagggtttgggaaagggaggagcgaaacggcaccgtaaggttctgagggataacatccagggaattacgaagcctgccattcggcgtctggcgaggcgtggcggagtcaagcgtatcagcggcctcatctacgaggagacacgtggcgtcctcaagatcttcctggagaacgtgattcgcgacgctgtgacctacaccgagcacgctcgccgcaagactgttaccgccatggatgttgtttatgctctgaagaggcagggcaggactctctatggttttggaggctaagaaggaggttggagttagggttagggtttagtatttgggttatgttacaaattagggggggtttttgttgtaattggacttaattgatgctgattttaagtgaatcatgaatagattgatatgaattttaaactttcaaaaaaaaaaaa

SEQ ID NO: 2335 - DNA, 479 bp, Castanea mollissima
ccgccattcacttccacatcaaaaccctaaccctaaatccccaaatcacagtacaccaaatccaatctcaaagaacttcaagagcaacaaaaatgtcaggccgtggaaagggaggcaagggattgggcaaaggaggagccaagaggcacaggaaggttctgagagataacattcagggaatcacaaagccagccattcggagattggcgaggagaggaggagtcaagaggatcagcggcctcatctacgaagaaaccagaggagtcctcaagatcttcttggagaacgtgattcgtgatgccgtgacttacactgagcacgctaggaggaaaactgtgaccgccatggatgtggtctacgcgctcaagaggcagggaaggaccctgtatggttttgggggttgattaagttgaaatttgcacctggttttcttggtatatgttgttaggccataatttttagttttcgaaaatgaatga

SEQ ID NO: 2336 - DNA, 515 bp, Cichorium intybus
ggcggggatcatcatcacttaaatcgtttcacagaaaaaaaccagagagataaaaatgtcaggaagaggaaagggaggcaaaggattgggaaagggcggagcaaaacgtcaccggaaagttctcagagacaacatccaaggtatcacaaagccggcgattcgccgtttggcaaggcgaggtggagtcaagcgtatcagtggcctgatctacgaggaaacacgtggtgtcctcaagatctttctagagaacgtcatccgcgatgccgttacctacaccgagcacgctcgccggaaaactgttaccgccatggatgttgtctatgctttgaaacgacaggggcgtactctttacggatttggaggttaagagaagttattgtttcgtagaattaggggtttgcattactatcactgtttccagatctagattgtctgattacttgttgatagtaggttgtgtatcattgacttatctctcgtaatgcaatgatgatttatctaaatttacttgctgt

SEQ ID NO: 2337 - DNA, 504 bp, Cichorium intybus
gacaaacaaattcaattccagagagaaaagagtagagagagaaaatgtctggaagaggaaagggaggcaagggtttgggaaagggaggagccaagcgtcatcgtaaggttctccgggacaacatccagggtatcaccaagccggcgatccggcgtctggctaggcgaggcggtgttaagcgcatcagtggcctaatctacgaggaaacgcgtggagttttgaagatctttcttgaaaacgtcatccgtgacgccgtcacctacaccgaacatgctcgccggaaaactgttacggccatggatgttgtatatgctttgaagcgccagggccgtactctatacggatttggtggttagaaatgtacggtttttagggttcttgtttggcgattattttttatagtttctagggttcttgtttatttagccagcttctctaatttgcagtgattatacgtgtagctcttaatacaatgtcacattgttgtcatcaattttgtggtgc

SEQ ID NO: 2338 - DNA, 528 bp, Cichorium intybus
gctcatctgcatttctcagtctacaagttttcagatttcgaagtaatttgaagaagttcgagaatgtcgggtcgtggaaagggaggaaaggggttgggaaagggaggcgcgaagcgtcatcgtaaggttctgcgcgacaacatccagggaatcacgaagccggcgatccgacgtctggcgagaagaggaggcgtgaagcgtatcagcggattgatttacgaagaaactcgcggagttctgaagatctttctagagaatgtcatcagagatgccgttacctacaccgagcacgcacgccggaagacagttaccgcaatggatgtggtgtacgcactcaagagacaaggccgaactctctatggattcggcggttagggttttcgaggtccatggaaaagtatttgtgggtattgagtttaggttagtgatttctacagcttgttgaaatcacatgttgttagtgtaggtgttgtgtttttcaccaaaaccgaagtaaatcgacttattttctaaattgacttcgcgaaa

SEQ ID NO: 2339 - DNA, 494 bp, Cichorium intybus
gcggggatacaaataaatttaattcaatccatttctacgagagagagaaagcgacatgtctggaagaggcaaaggaggaaagggtctaggaaagggaggagcaaagcgtcatcggaaagttctccgggataacatccagggaatcaccaaaccggcgattcgtcgtttggccaggcgtggcggcgtcaagcgtatcagcggtctaatctacgaggagacacgtggcgttctcaagatctttctagaaaatgtcatccgcgatgctgttacctacaccgagcatgctcgccggaaaaccgtcaccgccatggatgtcgtctatgctttgaaacgtcagggacgtactctgtacggtttcggtggttagggtatttttctagctgttcctattcgcctagttagatctgtaatgcttagctttcattctgcttgttgatttgaagtcatgtatgatattcactacaatcgaaacctgaacgatttacttcacaaaa

SEQ ID NO: 2340 - DNA, 469 bp, Cichorium intybus
attggcgggggaaaccagaaagccaaagaaaatgtcaggaagaggaaaaggaggcaaaggattgggaaagggaggagcgaaacgtcaccggaaagttctccgtgacaacatccagggaatcacgaagccggcgattcgccgtcttgcgagacgtggtggcgtgaagcgtatcagtggtcttatctatgaggaaacacgaggcgtgttgaagatcttcctcgagaacgttattcgtgacgctgttacctacactgaacatgcccgtcggaaaaccgttactgccatggacgttgtctatgccttgaagcgccagggtcgtactttgtacggatttggtggttaaggtaacttagggtttgtagggttagtttgcgatttgtagttagatctgttaacatttccgattcggttcgtttccctgtagaaatgtatgatatatcagcttaattgaagctcgattgcggccaaa

SEQ ID NO: 2341 - DNA, 703 bp, Citrus sinensis
ccacgcgtccgcacaaagcaagcaactaatcaaggcacattcaaatttctctatccaaattctctttcaaggaacagcggaaagtcttttaagttcctcgctaaaatgtctgggcgcggtaagggaggcaagggattgggaaagggaggcgccaagcgtcaccgtaaggtgcttcgcgataacattcagggtatcacaaagccagcaatccggcgtttggctcgtagaggtggagtcaagcgtatcagtggcttgatctacgaggagacacgtggcgtcctgaagatattcttggagaacgtcatccgtgacgccgtgacctacactgagcacgccaggagaaagaccgtgaccgcgatggacgtcgtttacgctctcaagaggcagggcaggactctttatggatttgggggttaattgtcttagggttctggaattaaatgttaatagatcttgactctagatcttgatctggtagatggggctcttagtagtttgttattaggttgctgctttgtaattctatcaagttaaatcttatctttatatttgaggcaatatagaactgttttctttgaaggattgttccgtggttctggattttatttattaaactatttgatgtgctgtttggatacatagaaagttgtaggccaatgacactgattatgcttggaattcatcaatattttatcccaataaa

SEQ ID NO: 2342 - DNA, 503 bp, Citrus sinensis
ggggaacgaatgaacaaataaaagaagcataaaattaaagaactgaaaagagagaaaaggaaagcagaagagaaatgtcaggaagaggaaagggaggcaaaggattgggaaagggaggagcgaagaggcaccgcaaggtgctgagggataacattcaggggatcacaaagccggctatccggcggctggcgaggcgtggcggagtcaagcgtatcagcggtctgatttacgaggagactcgcggggttttgaagatctttttggagaacgtgattcgtgatgctgtgacttacactgagcacgctcgtcgtaagactgtcaccgccatggatgttgtttatgctttgaagaggcagggcaggaccctttacggtttcggtggttaaatttagggtttcttaatttttatgtttttgaatgctattgagtatctgatgactttgtaatttgtattgatatttggtctatcaatgaaattttatgttaattgttgctaaaaaaaa

SEQ ID NO: 2343 - DNA, 611 bp, Citrus sinensis
actacaaaaaaaacgagcaaaggttgagagtgggggaaaaaagaaagaaaaattcccaattagtttgaaaaccgtaattagcattttaatttcgtagcagaatgtctggacgcggcaagggaggcaagggattggggaagggaggagccaagaggcatcgcaaggtgttgcgtgataacattcagggcatcaccaagccggctattcgccgtttggccagaagaggaggcgttaagagaatcagcggtctcatctacgaggagacacgcggcgtcctcaagatctttttggagaacgtcattcgcgatgctgtgacctacactgagcacgctcgccgaaagacggtgaccgccatggatgtcgtttatgcgctcaagaggcagggcaggactctctatgggtttggtggttgatgtggcgtcgttttgtattttgtgttttagggttttccttttttcctgtaaatcagtgaacgtggttgtgtctagcgagtgggtttaaattggaggcaacttgtatttgccgtttcctaggggtttttttatttttttggttcattggtgttttcatcttttgcaatgagaatctagttgtttacttcattgaatttt

SEQ ID NO: 2344 - DNA, 728 bp, Citrus sinensis
ggagcgcagtacggtccggattccgggtcgaccccgcgtccgagaaacaaaaaagtaatattgtcactatatcaccctgatttattcatcaaacacgcaatatcagagtagaaaattatgtcggggcgtggcaagggaggcaaggggttgggaaagggaggagcaaagcgtcaccgtaaggttcttcgcgataacattcagggaatcacaaagcccgcaatccggcgtctggctcgtaggggtggggtgaagcgtatcagtgggttgatctacgaggagacacgtggcgttctgaagatctttttggagaacgtcatccgcgacgccgtgacttacactgagcacgctcggaggaagactgtgacggcgatggacgtcgtgtacgcgctcaagaggcagggcaggactctctatgggtttggtggttaaagaagttggtatcgcttgtttgtgatggttgtaaagagagaagtcttgctgtcaagaagcttttgtggttctgtttctagggttaggacttgtgcgttttctttctggttaaatgggaatcttggtttaatttgttaatggtgttttcattttgtaacgttaattacccctatgattttgagtagaattaacgatagatcgttgtgaagcttcttggtataaacactgctggttcatttgatgtcttgctgctttcgcactttcctcgtcattaatggaaccatagcccaaattttcac

SEQ ID NO: 2345 - DNA, 595 bp, Trifolium pratense
cttcttctaatcttcaaagttcataattataagaaaaatccattttcttcactgcaacaaaaatgtcaggtcgtggaaagggaggtaagggtttgggaaagggaggtgcaaagagacacaggaaggttcttcgtgataacatccaaggcataactaagcctgcaattcgtcgtttagctagaagaggtggtgtcaagagaatcagtggtctgatctatgaagaaactcgtggtgttctcaagatctttctcgagaacgtgattcgtgatgctgttacctacactgagcacgctaggaggaaaaccgttaccgctatggatgttgtttatgctttgaagaggcagggaaggactctttacggtttcggtggttgattttagggttcaatttagcgtttctgattgacctagcttgatttagttgtaaatgtttgttgattttgttgtatttctattatgctcttgattcggttcttttgaatctttgattagattagtcttagatctggttgaattgaaatgaatcgattagttgtgtttctagtatttggaattggatcttattgatgaatgaatattgaatactcttttgctac

SEQ ID NO: 2346 - DNA, 717 bp, Coffea canephora
ttaacacccccacccaccgccttttcacaaccctatcactcccactgctttccctctcttcgatccagaaaagcaagagatccatctccagttttcgtacctagcaattgaaaatgtcgggccgtggaaaggggggcaaaggattgggaaagggcggagcaaaacgtcatcgtaaggttctccgcgacaacatccagggcatcacaaagccagcaatccgccgtctggctcgtaggggaggagtgaagcgtatcagcggtctgatctacgaggagactcgtggggtgcttaagattttcttggagaacgtcatccgtgatgccgtgacctacacagagcacgccaggaggaagacggtgacggccatggatgttgtgtacgcgctcaagaggcagggcaggacactgtatggcttcggtggatagagagactggggggaaagggtagaattgacttttgttggttttgcagaagtcttgctgtcaagaaagaggaaaaagattgaaacaaaaaaaaaaagaagaaaaaggaatgtgctcgtagtttaattgtgtttctttctgttgtcctgggattagggtaatggtagtgtaattagggggattagtagtgattaggtggtgtatttttgtgtcgtggttcatgctttgtaagctatgcccttgggaatggtattttggtgattaatgaaatgattactttgttggtttctaaaaa

SEQ ID NO: 2347 - DNA, 702 bp, Coffea canephora
gggctgcatgaattctgcacgaggcgcactgctttccctctcttcgatccagaaaagcaagagatccatctccagttttcgtacctagcaattgaaaatgtcgggccgtggaaaggggggcaaaggattgggaaagggcggagcaaaacgtcatcgtaaggttctccgcgacaacatccagggcatcacaaagccagcaatccgccgtctggctcgtaggggaggagtgaagcgtatcagcggtctgatctacgaggagactcgtggggtgcttaagattttcttggagaacgtcatccgtgatgccgtgacctacacagagcacgccaggaggaagacggtgacggccatggatgttgtgtacgcgctcaagaggcagggcaggacactgtatggcttcggtggatagagagactggggggaaagggtagaattgacttttgttggttttgcagaagtcttgctgtcaagaaagaggaaaaagattgaaacaaaaaaaaaaagaagaagaaaggaatgtgctcgtagtttaattgtgtttctttctgttgtcctgggattagggtaatggtagtgtaattagggggattagtagtgattaggtggtgtatttttgtgtcggggttcatgctttgtaagctatgcccttgggaatggtattttggtgattaatgaaatgattactttgttggtttctaaaaa

SEQ ID NO: 2348 - DNA, 692 bp, Coffea canephora
gaagtctctcaatttcatttgtcttcatctagttcgccgcttttctctttcagctgtgattgaagatgtcgggacgtggcaagggaggcaagggcttgggaaagggaggagcaaaacgtcatcgtaaggtgcttcgcgacaacattcagggaatcacgaagccggcgattcgccgtctggctcgcagaggaggcgtgaagcgtattagcggcctgatctacgaggagacacgcggcgtcctcaagatcttcctggagaacgtgatcagagatgccgtcacctacaccgagcacgctcgccggaagactgtcaccgccatggatgtcgtgtatgctctcaaaaggcaaggccgtaccctctatgggttcggcggttaggatagttctgtgaagtaattagggattctgatttggtcccctttgtaattacaagtagtagtaattttcttttcggggaatatgtcatggtctggtacattctctctttcggttacgtcatggttaatggatgcgtcgttgtttgctgttggaaacgaaaatcgcgtctgctcgagattctgtgcaatggacttcgattcgtctgtgattcgtgcatttatcacgtgattgaatttactggatgacagcagctgagatatgtaacagtaagtattttcagtagctaaacagttctaaatccaagagttttgctgc

SEQ ID NO: 2349 - DNA, 480 bp, Coffea canephora
  misc_feature (439)..(439): n is a, c, g, or t
tgtgattgaagatgtcgggacgtggcaagggaggcaagggcttgggaaagggaggagcaaaacgtcatcgtaaggtgcttcgcgacaacattcagggaatcacgaagccggcgattcgccgtctggctcgcagaggaggcgtgaagcgtattagcggcctgatctacgaggagacacgcggcgtcctcaagatcttcctggagaacgtgatcagagatgccgtcacctacaccgagcacgctcgccggaagactgtcaccgccatggatgtcgtgtatgctctcaaaaggcaaggccgtaccctctatgggttcggcggttaggatagttctgtgaagtaattagggtttctgatttggtcccctttgtaattacaagtagtagtaattttcttttcggggaatatgtcatggtctggtacattctctctttcggttangtcatggttaatggatgcgtcgttgtttgctgttggaaacg

SEQ ID NO: 2350 - DNA, 559 bp, Coffea canephora
tccaattgttctctcagagaattcagaaaaccctagaattcaaaatctcctcccaccttctctgcaaaaatgtctggccgtggaaagggtggcaagggtctgggcaagggcggagccaagaggcacaggaaggttctaagggataacatccagggcatcaccaagccagccattcgtcgtttggccagaagaggcggcgtcaagagaatttctgggctgatctatgaagaaacccgtggagtcctgaagattttcctggagaatgtcatccgtgatgctgtgacctacacggagcatgctcgccgcaagactgttactgctatggacgtggtttatgctttgaagaggcagggtaggactctttatggatttgggggttaggtttctcgttagtgctcgaattgggttgggggaagggggattggtaggttatcttttgttattgagattgagcttacattgtaattaacattacatttgcagatcaatggatgttaggatttccactagttggacaattatgatgactattgaggaactgagcattcattttcctgaa

SEQ ID NO: 2351 - DNA, 515 bp, Coffea canephora
ctcagagaattcagaaaaccctagaattcaaaatctcctcccagcttctctgcaaaaatgtctggccgtggaaagggtggcaagggtctgggcaagggcggagccaagaggcacaggaaggttctaagggataacatccagggcatcaccaagccagccattcgtcgtttggccagaagaggcggcgtcaagagaatttctgggctgatctatgaagaaacccgtggagtcctgaagattttcctggagaatgtcatccgtgatgctgtgacctacacggagcatgctcgccgcaagactgttactgctatggatgtggtttatgctttgaagaggcagggtaggactctttatggatttgggggttaggtttctcgttagtgctcgaattgggttgggggaagggggattggtaggttatcttttgttattgagattgagcttacattgtaattaacattacatttgcagatcaatggatgttaggatttccactagttggacaaaaagaaaaa

SEQ ID NO: 2352 - DNA, 575 bp, Coffea canephora
tttggcttattccttattaatcgactagattagtggtggtatctgcatccgtttcgatttcaaatgtcgggaagaggaaagggaggcaagggattgggcaagggaggtgcgaaacggcaccgtaaggtcctgagggataacatccagggcatcacgaagccggcgatacggcgtttggctcggaggggtggagtcaagcgtatcagtggtctcatctacgaggagactcgcggagtcctcaagatcttcttggagaacgtgattcgtgacgccgtcacttacacagagcatgcccgtcgcaagactgtcaccgccatggacgtcgtctacgccttgaagaggcagggacgtaccctctacggctttggcggctgaagaaagagagggggttagggaatgattgtagttggtttggttttagcacgctgttgcgaaaattgatcatgtggtagtggtatatcttttcgaaataggcgggttgggtcactgggtaagacttttagggttagggttgggaattacggatgttaaaaaatgtgttaattttttcaaaactgttttaagacggattcctg

SEQ ID NO: 2353 - DNA, 427 bp, Coffea canephora
tttggcttattccttattaatcgactagattagtggtggtatctgcatccgtttcgatttcaaatgtcgggaagaggaaagggaggcaagggattgggcaagggaggtgcgaaacggcaccgtaaggtcctgagggataacatccagggcatcacgaagccggcgatacggcgtttggctcggaggggtggagtcaagcgtatcagtggtctcatctacgaggagactcgcggagtcctcaagatcttcttggagaacgtgattcgtgacgccgtcacttacacagagcatgcccgtcgcaagactgtcaccgccatggacgtcgtctacgccttgaagaggcagggacgtaccctctacggctttggcggctgaagaaagagagggggttagggaatgattgtagttggtttggttttagcgcgct

SEQ ID NO: 2354 - DNA, 795 bp, Gossypium hirsutum
gtgtagtgtgcgtgtgatgttggcttgtggttcttggtgtctcggtgtgtgacttgtgtgtattgtcgtgttttattctcgttattgttgttcgctttggggtgtattctggcatcctgttgccattagcctgtggaattgcgcgcttgttgtgtccgggtgcggccctttgtggtacccggaatccgccatatgtccggggtgtaccagtcatacttcttattcagcgtaggctacaatccaagttcaagattcgaagatgtcgggaagaggaaagggaggcaagggactgggcaagggaggagcaaagcgccatcgtaaggttctccgtgataatatccagggtatcacaaaaccggcaattcggcgtttggctcgtagaggaggcgtcaaacgtatcagcggtttaatctacgaggaaacccgtggggttttgaagatcttcttggagaacgtgattcgtgatgcagtaacctacaccgaacatgcgaggaggaagactgtgactgctatggatgtggtttatgcactgaagaggcagggcaggactttgtatgggtttggtggttaaatgatttagggaatagatcttttagcgatgttggcggatctggacttgttgtcatgctagcaagaatgtttgagtttaggattagggatagggcttgtaattaaggggtgctattgggattactggaaattataatttggtcgtgtagttttctttggtgatttgtaattcgtgccatgaattgcagattttaatgaaatttggaatttaatttcgctaaaaaa

SEQ ID NO: 2355 - DNA, 599 bp, Gossypium hirsutum
  misc_feature (593)..(593): n is a, c, g, or t
gacactagtggatccaaagagattcggcacgagctcacacttcaccttgaaaaagtcaaatttcccagaaaataaaaaactttccagcaaaatgtcaggaagaggaaaaggaggtaaaggtctcggaaaaggaggagccaagaggcatcgtaaggtcctaagggataacatccaaggtatcactaagccggccatccgtcgtttggctcgtcgtggaggagttaagagaatcagtggcttgatctatgaagaaaccagaggagtgttgaagattttcttggagaacgtcattcgcgatgcagtgacttacactgagcacgctagaaggaagaccgtgacggccatggatgttgtttatgctttgaaaaggcaaggccgtactctctatggatttggtggttaagttttcggtttcttgttcgtgttatattgtactatgtaatctttgattatcatcaatggatttcgttaagaaaaatctattctcgcttattttgagcttttttatttactgttttcgacgaattgtttttttacttcgaagtgaaaccatgattcaataggaagctagttgtaaaatcacttttatggtnccaaaa

SEQ ID NO: 2356 - DNA, 583 bp, Gossypium hirsutum
gggtaacaaatcaaatctcaataagtagcgtaggttataatctaagttcaagattcgaagatgtcgggaagaggaaagggaggcaagggactgggcaagggaggagcaaagcgccatcgtaaggttctccgtgataatatccagggtatcacaaagccggcaattcggcgtttggctcgtagaggaggcgtcaagcgtatcagcggtctaatctacgaggaaacccgtggggttttgaagatcttcttggagaacgtgattcgtgatgcagtaacctacaccgaacatgcgaggaggaagactgtgactgctatggatgtggtttatgcactgaagaggcagggcaggacattgtatgggtttggtggttagatgatttagggattagatctttctgcgatgttggcggatctggactagttctcatgatatcaagaatgttttaggattaggaatagggcttgtaattaaagggtgctattgggattattggaaattataatttggtcgtgtggttttctttggtgatttgtaattcgtgccatgaattgcagattttaatgaaatttggaatttaatttcg

SEQ ID NO: 2357 - DNA, 599 bp, Gossypium hirsutum
  misc_feature (7)..(7): n is a, c, g, or t
  misc_feature (11)..(11): n is a, c, g, or t
ctttggntggnggttcgtgcgcctgcggtcgacactagtggatccaagaattcggcacgaaagaaaaaatctcaattccctctaaaaaaaaagcttcgatttttcaaaaatgtcaggccgtggaaaaggaggcaagggattaggaaaaggaggagctaagaggcatcggaaagttctccgagataacattcaaggcatcactaagccggcgattcgtaggttagctcgtagaggcggtgtgaagaggatcagtggcctgatctacgaggaaactcgtggagttctcaagatctttctggaaaacgttatacgcgatgctgttacctatacggaacacgctaggcgtaaaactgttaccgctatggatgttgtttatgctctcaagagacaaggaaggactctttatggtttcggtggttgattttgggttttagggtcttttttgttgtaaatctttcgttgcaactgcttgttgtaggtttttctttgtttggattaatgtattttcgtttcgatgaaaatttcgctccgaaagctaattgggtttataaatatttgacatttgaaattttgaaattttagtgttcgtccgaaaaaaa

SEQ ID NO: 2358 - DNA, 525 bp, Gossypium hirsutum
aaaaaaatttctgattttatcaaccaaatctttcgtctcttaattttggttggatatcgaagatgtcaggaagaggaaagggaggcaagggtcttggcaagggaggagctaagcgccaccgtaaggttctccgcgacaacattcagggcatcacaaagccggcaattcgacgccttgcccgtaggggaggagtgaagcgtatcagcggcttaatctatgaggaaacccgtggagttctcaagatcttcttggagaacgtcattcgcgatgcggtcacatacaccgaacacgccaggagaaagacggtgactgccatggatgtggtttatgcgctgaagaggcagggtaggactttgtatggatttggcggttagttgatttagggtctaggttttaaaataggggaagaattgtaagactcagttaaagttacaagctgggttttgttgttctctgttataatttgtaattcgcatcatcaattgcgtatttttcttgaaaattgaaggtcattttgtcaatctt

SEQ ID NO: 2359 - DNA, 493 bp, Gossypium hirsutum
  misc_feature (16)..(16): n is a, c, g, or t
  misc_feature (122)..(122): n is a, c, g, or t
ccacgcgtccgaggancttcactttacaggcattttaatcccttaaatctctctcaaccaaaaaaatgtcgggacgtggaaagggaggcaagggtttgggaaaaggtggagcgaagaggcancggaaagttctccgggataacattcaaggcattacgaagccggcaatccggaggttggctcgtagaggtggcgtgaagagaatcagtggtttgatctacgaggagacgcgaggtgtgctcaaaatctttctggaaaatgtgattcgtgatgccgttacctatacggagcacgctaggcgcaagactgttacggccatggatgttgtttatgctctcaaaaggcagggcaggacactatatggtttcggtggttaaagaggatttttaggaatttattatttagattttgcaagtctcttgcaacagcttgttgttttcattttgtttgggcttcaatcttttaataaaatttgctcttatttgatatcttc

SEQ ID NO: 2360 - DNA, 636 bp, Gossypium hirsutum
cggaaatttaaatcggaaatttttcaaaatattaaataatctttctctttgatcgatacttgaataatatgtcaggaagaggaaagggaggcaaggggttgggcaagggcggagcaaagcgccaccgcaaggtcctccgtgataacatccagggaatcacgaaaccggcgatccggcgtctagctcgtaggggaggtgttaagcgtatcagtggcttgatctacgaggaaacccgtggagtgttgaagatcttcttggagaacgtgatccgcgacgccgtgacctacactgagcacgccaggagaaagacggtgaccgccatggatgtcgtttatgccctcaagaggcagggtaggactttgtacggtttcggtggttagattggtgtttactgttcaggattgctgaagttggctgcgatggcggcggcggcgatggtggtggggggatttgaagtcttgcggtcaagaatgtttgagcgtagtatcagcgttagggctttgtaattagtgactattagaaattagacattgggtactgtatgctttcgtttacgatttgtgattcttgtactggattacagattttaatgaagttttgagttcatttctaagattagaagtgtacttgtttgtt

SEQ ID NO: 2361 - DNA, 572 bp, Gossypium hirsutum
gcggggattcgcaactgttttccctttgctcgtaattcatttcatcgtaaatttgtttccgtagtaatcatcaaatctttcgaagatgtcaggcagaggcaagggaggcaaggggctcggcaaaggaggtgccaagaggcataggaaggttttaagagacaacattcagggcattactaagcctgccattcgccgtttggctcgtcgaggaggtgtcaagaggatcagtggcttgatctatgaagaaaccaggggagtattgaagattttcttggagaatgtgattcgtgatgctgtgacttataccgagcacgccaggaggaagaccgttaccgctatggatgttgtttatgccttgaaaaggcagggcaggactctctatggttttggaggttaagtttaggatcattcttaagttcgtaactgtaatgcctttagatcttgactctagatctatatcgttatgtacttgtttgtgtactctgagtgatgttataatgatttgtaaccttaagattgatcgtataattttcatttgcaaagctttctttgggtattcctttgtttcttgc

SEQ ID NO: 2362 - DNA, 610 bp, Gossypium hirsutum
  misc_feature (13)..(13): n is a, c, g, or t
  misc_feature (29)..(29): n is a, c, g, or t
  misc_feature (45)..(45): n is a, c, g, or t
  misc_feature (51)..(52): n is a, c, g, or t
cttttagactggngcttcgcgcgcttgcnggtcgacactagtggntccaannattcggcacgagtattattcttcgtcttctgaaaaattttctttgaaattccagcttttgactacaatgtcaggaaggggaaagggaggtaaggggctcggaaagggaggagccaagaggcataggaaggtcttaagggacaacattcagggcattaccaagcctgcgattcgccgtctggctcgtaggggaggtgtgaaaagaatcagcggtttgatctacgaagaaacccgaggcgtattgaagatcttcttggagaacgtgattcgtgatgccgtgacatacactgaacacgccagaaggaagaccgttaccgccatggatgttgtttatgccttgaaaaggcaaggcaggactctctatggttttggaggttaagcttagtacactattgtattttaggcattgcagtattatgcttattatggtagaatcatggatcttggctatagatccactgcgttaatgtaattgcttcagttcgttgctgatgttactgtgattcttaatatttgaaatgctctcaaaggatttgtatcaactatgcttctgcgtgca

SEQ ID NO: 2363 - DNA, 611 bp, Vigna unguiculata
ggattccaaatctaaaaaagcaaaacaaaaccctacattttcaaatcctcttgcaaattttctcttcagtctagttctagttccaatttgagaatgtctggtcgtggcaagggaggaaagggattgggcaagggaggtgcgaagaggcaccggaaagtgcttcgcgacaacattcaaggcataacgaaacctgcaattcggcgattggcgagaagaggtggtgtgaagaggattagtggattgatatacgaggagaccaggggagtgctcaagatatttttggagaatgtgattcgtgatgcagtgacttatactgagcatgctagaaggaagacagttacggccatggatgtggtgtatgctctgaagagacagggaaggaccctttatggttttggaggttaatccaaatgttttggtgaatccttttctctgaaattgtcctgtgagataagagttgcttgttccttttgaattcttgtgattttcaaagaactgtttggttctttgtggggtgaaaaaaggaaattggaacttcaattgattttttgagaaatgaaaagtaaggtgcagaacacattggaatgtagtaacacttttgcttggttcag

SEQ ID NO: 2364 - DNA, 679 bp, Vigna unguiculata
ggatcaattgaaatccctaatttctcaactcctcacaaaatcccaattcaaatcttaatcacacaatgtctggtcgtggaaagggtggaaagggtttgggaaagggaggcgccaagaggcatcgcaaggtgctccgtgacaacatccagggtatcacgaagcccgccattcgcaggttggcgagaagaggtggcgtgaagagaatcagtgggttgatctacgaagaaactcgcggagttctcaagattttcttggagaatgtgattcgtgatgcggtgacgtatactgagcacgcaaggaggaagacggtgacggccatggatgttgtttacgcgctcaagagacagggaaggaccctctatggattcggaggttgatgggttctggtattgggcctactgggttgggttttgtcttgtgggcttttgttctgtaaatgtatggactttgtgttttgtgtaatggttttattacttgattgttctttgcttggtagagcatgatggaatcaagtttgttctaattctcctcttaattgcaagttaatcagtagaattttgagtaaatttattggattataaactttttgctgcttttgttttatgcttttttgattactggctctttagactctcgtaagtgagatagagttaaatgagtttgcaagttgattcttata

SEQ ID NO: 2365 - DNA, 651 bp, Vigna unguiculata
agattcattcaaaaactgaagcccaaacaaatcctaaattttcaaattcgtttgcaatctttctctgcagtctcgtcttagctttaattcaaagttccaattcgaaaatgtctggtcgtggcaagggaggaaagggattgggcaagggaggtgcgaagaggcacaggaaagtgcttcgcgataacattcagggcataacgaaaccagcaattcggcgattggcgagaagaggcggtgtcaagagaatcagtggattgatctatgaggagaccagaggagttctcaagatattcttggagaacgtgattcgcgacgctgtgacctacaccgagcacgctaggaggaagacggttacggccatggacgtggtgtatgccctgaagagacagggaagaaccctttatggttttggaggctgattcaatgctttgatgatttcttttactttgaaataatcttatgatataagatttgcttgtttttaggaatccttgtgattttcttaatgtatacaactatttccccttttgtgaaatgaaaaatatcatgaagaatgtcagttgaatgtaatgcagtaaggttttggtgtagttcattattttaatggtttgtatctatgttttatccaatccgaattacgctatgatagta

SEQ ID NO: 2366 - DNA, 561 bp, Vigna unguiculata
  misc_feature (11)..(11): n is a, c, g, or t
cggacgcgtgngcagctacctctgattgttgtttgcgaattttgcgagtaagaagatgtctggacgtggaaagggaggcaagggtttgggaaagggaggagcgaaacggcatcgtaaggtgttgcgtgacaacatccagggaataacgaagcctgccattcggcgtttggctcgtaggggtggtgtgaagcgtataagcggtctcatctacgaagagactcgcggtgttctgaagatctttcttgagaacgtgattcgtgacgcggttacgtacaccgagcacgccagaagaaagacggttacggcaatggatgtggtttatgctcttaagagacagggaagaaccctctatggatttgggggttaggtttaggtttctttattcagtttagagaagctactaggcaagttcagtctgttaagaagttgtgttttaggaatagtgcctacaatgatatgaattgtggtgttgctcttgatgtctactttgtaatttaatccttatatcttgaatatgaaaatgttattctgttcatccctatatattgcgattgtggtgga

SEQ ID NO: 2367 - DNA, 627 bp, Vigna unguiculata
  misc_feature (424)..(424): n is a, c, g, or t
ggagcatttcaaatctgaaacctcaaatccctaaattgtagtcggtagcaaagttttccccagaaaatgtcaggtcgtggaaaaggtggcaagggattggggaaaggaggcgccaagaggcacagaaaggtgctacgagataacattcagggcattaccaaacctgcaattcgtagattggccagaagaggtggcgtgaagagaattagcggtttgatatatgaagaaaccagaggggtgctcaagatatttttggagaacgtgatccgtgatgctgtgacttacaccgagcatgctagaagaaagactgttacagcaatggatgttgtttatgctcttaagagacagggaaggactctctatggtttcggaggctgaacaattgcttagtttgttttcttattatgtacttcttttgaaagcntttacttccatggaaacttgtttagtttaatctttaagatacatgtgatacttttgagattttatagattaggttttacctggattgggaattactgtgttgcaacaatattttgttgtgtatttaactggtatgggaatcccacaatgcttaacttgatactgtgacttttgttagatgaaaagtggtctgatttgattgct

SEQ ID NO: 2368 - DNA, 549 bp, Vigna unguiculata
gggatcgcaattgaattcgaaacaataatttccaaatctgagtttggcaagtttggattgagaagatgtcaggtcgtggaaaaggtggcaaaggtttgggaaagggaggtgcgaagaggcacagaaaagtgcttcgtgataacattcaaggcataaccaagcctgccattcgtagattggcgagaagaggtggcgttaagaggatcagcggtttgatctatgaggaaacaagaggtgttctcaaaattttcttggagaatgtgattcgtgatgctgttacttacaccgagcatgctaggaggaaaactgttactgctatggatgttgtttatgccctcaaaagacagggaagaactctctacggttttggaggctgaagattgttgacttctgttcaattgtactttagagttcatcttactcttcttttgatttgattccatgtttagttttatggatatctgttgtaaagtatgctggcatattttatgcaacttcaattgagattaatctatggatatgattttctggtttaaaaaaagaaaaaaa

SEQ ID NO: 2369 - DNA, 649 bp, Vigna unguiculata
ggattacaacaactcgcacagcttctccttcaactctccaacgcagaatttgattcgactcagtcgaggttgtattcaccaagatgtctggcagaggaaaggggggcaagggtttgggaaagggaggagcgaaacgacaccgtaaggtgcttcgcgataacattcagggaataacgaagccggcgattcggcgattggctcgcagaggtggcgtgaagcgtatcagtggtttgatttacgaggagactcgtggtgttctcaagatcttcttggagaacgtgattcgtgacgctgttacttacacggagcacgcaaggaggaagactgttactgctatggatgttgtttatgctttgaagaggcagggaaggaccctctatggatttgggggttagggttttggttctgtacggtcgcttgattttcctctccggggagaagtcttgctgtcaagaaaagaaaatggcaggaattgaagttaggttttgcttttctttgttgtctttgtagttgaaagggtaatggtaggtgtgattatcagatatatgttttggtgataggtgttttacttggttttgttggttctgtgatgtgctgtaactacttttgatggaattgagaattatatcatatttcagttcccagttca

SEQ ID NO: 2370 - DNA, 609 bp, Vigna unguiculata
gccaaaacaaatcctaaattttcaaattcgttcgcaatctttctctgcagtctcgtctaagctttagttcaaagttccaattcgaaaatgtctggtcgtggcaagggaggaaagggattgggcaagggaggtgcgaagaggcacaggaaagttcttcgcgacaacatccagggcataacgaaaccggcaattcggcgattggcgagaagaggtggcgtgaagaggatcagtggattgatctatgaggagaccaggggagtgttgaagatattcttggagaacgtgattcgcgatgctgtgacctataccgagcacgctaggagaaagacggttacggctatggatgtggtgtatgctctgaagagacagggaaggacactctatggttttggagggtgatccaaatgcttattcttaatctttatccccttagttttctcttttaaaatgagaggtgtttttaatttggataaatacaagtacatgaacacttgtttaggttcatccttgcaattgtcatttgtgcatattttcatttttgtggacttcttttctaaatatgaaagtgtcctaaagtgaatgaatgagttgtccaaattgtaggactta

SEQ ID NO: 2371 - DNA, 778 bp, Cryptomeria japonica
gattgacggaggtccgttttgagggtttgaatacagcagttctgtgtgatttgaattttgctctgagaagatgtctggaagaggaaagggcggcaagggtttgggaaagggaggcgccaagaggcacaggaaagtcctccgtgataacattcagggtatcaccaagcctgctatcaggcgtctggctaggagaggaggtgttaagcgtatcagtggcctgatctatgaagaaaccaggggggtcttgaagatctttttggagaatgtcataagagacgctgttacctacactgaacatgcacggcgcaagacagtgactgccatggatgtggtttatgctctcaagaggcagggtagaactctctacggattcggtggttagacctgcttctaacggtgaagggtctgtgaatggctttctctccaacaatctgtcatatttttaggtgtttttaaacaccacctttgctgcggaatcatttgttcgtccctttatttgacagtaattcaaatgtaagtaagataacaagggctgttttcgcttaaaattgtccattgagctgttcatagaatgatatgagtggctattgatgtgtttgttttgttaagtttagctgttaatattagcagtctcctcaatcggattatctttagatggttagtctgcgattaggagaatttctaccaaaaaactgttagcagtttgtaaatatttatatttctgtacacagtttagacaatttaatccgagcaattaaaattggtgttttaatttgtg

SEQ ID NO: 2372 - DNA, 540 bp, Cryptomeria japonica
  misc_feature (23)..(23): n is a, c, g, or t
  misc_feature (44)..(44): n is a, c, g, or t
caaagcggggcatttgagagcantttttggttgaagggtttcanagttgagcagtcgatcgaagaaagatgtctggaagaggcaagggcggtaaggggctcggcaagggaggagcgaagaggcacaggaaggtccttcgagataacattcagggtatcaccaagcctgccatcaggcgtctggccagaagaggaggcgtcaagcgtatcagtggtcttatctatgaggagaccagaggtgtgctgaagatcttcttggagaatgtcataagagatgctgttacatacactgagcacgctcgtcgcaagactgttacagccatggatgttgtgtatgccctaaaaagacagggcagaaccctctatggcttcggcggttagatatgctgcttttactttttatttatttttggtgtttttcaacaccacttccttgatggaactgtctgttcgatgcctttactctgagcagggctggtttaccaaaaaactggtaattttgttatatatttgaaataaaagtggggtataattttgagtt

SEQ ID NO: 2373 - DNA, 572 bp, Cryptomeria japonica
gcttttgaagaggattttctttgtgattgaatagagataaaagatgtcgggacgcggaaagggtggaaaggggctgggcaaaggaggtgcaaagaggcacaggaaggtcctgcgagataacattcagggtattaccaaacctgccattcgcagacttgcaaggagaggaggcgtcaagcgtattagtggcctcatttatgaagaaaccaggggagttctcaagatatttcttgagaatgttatcagagacgccgtcacatacactgagcatgctcgcaggaagactgtcacagctatggatgtcgtttatgctttgaaaaggcagggcaggactctctatggcttcggtggctagagttcttgatccccttgttctaattctatggtgtcttttgacaccaccgtttattggaagtttttaggctctgctgtagccagtagctttgtgtttttgtagcttttatttccagcctattagggtttgtggttggggattttaatgttggggccatgtgttttgtaatttgttaatactgcaatttggaaagtcttctctggtaaagactttatct

SEQ ID NO: 2374 - DNA, 625 bp, Cycas rumphii
ggtttgtttgaccattagttctgctgcagtcttttaaggttgatctttcggagcgctcggggatttgaggcctctgtttttttaaaagtaattcaagatgtccggccgcggcaagggtggaaagggtttgggcaagggtggagccaagcgccacaggaaggtgttgcgtgacaatattcagggtatcacgaagcctgctatcaggcgtttggcgaggagaggcggcgtgaagcgtatcagcggattgatttatgaagaaactagaggcgtgctgaagatctttttggagaatgtgatcagagatgccgtgacctatacagagcatgccaggcggaagactgtcactgcgatggatgtggtttatgccctcaagagacagggaaggaccctctacggcttcggtggttgattctgatttcaagtcttgctgtcaagaaatggtgtctttcgacaccgccactagtattctgggattgtatgatcattttggcagtgtgttttggacaaaaaaaattgaagtagtttctgggaaggtttgggacttttaaattgtaaatggaggactggatgatggttaaacaggttggactgtctttctgtgccagtgtagttactgcaaacaaat

SEQ ID NO: 2375 - DNA, 906 bp, Cycas rumphii
gatctaaccggaggagcttcttgatttgggattaacattaaggaacgaagatgtcaggtcgtggaaagggaggaaagggattggggaaaggaggagcaaagaggcacaggaaggttttgagggataacatccagggtatcaccaagcctgctatccgacgccttgcccgacgtggtggtgtcaagcgcatcagtggtttgatctatgaagaaacccgtggtgtattgaagatattcctcgaaaatgtcatcagggatgctgtcacgtacacagagcatgctcgccgtaagacggttactgccatggatgtcgtctatgctctcaagaggcagggcaggactctatatggctttggcggttgattcttttctgttctactttgatatttttcaacaccacctatgtatctcggaactgttttgtttgatttttccaacaattttgtaaaacctccaaagggattatggactcacgaggtttgttgtattgagtgaaccttgaggtgtttctgcttttttgttctgtattagctgaggttatttgggggttggattattgctggaatgtaatattgtactgctggattggtggcccagtcaatgtggatatcttttgttatctgtgtgaatagatttgtgtaggtttctgatttgtaaagaggcttggtcaagtatagtttctttattaggaacagcgaggggctttgaattaaggttttgccaggagtaggttcttgtaagaatcagaagggggattagatatggtagtgttggtgttcagagaaagatgcaattttttgccgggaaaactgtgttcgtagttcgtttgccggattgaaaaagcaagttggctcgtggcgaggtcgggaataattattaattttgcacgttattgtgcagttagcta

SEQ ID NO: 2376 - DNA, 798 bp, Cycas rumphii
  misc_feature (356)..(356): n is a, c, g, or t
gctctgatataataatctctacaggcgggttgagggatctaaccgaaggaggttcttgatttgggattgagcatcaagcaaagatgtcaggtcgtggaaagggaggcaagggtttgggcaaaggaggggcgaagaggcacaggaaggttttgagggataacattcagggtattacgaagcctgctatccggcgtcttgcccgacgtggtggtgtcaagcgtatcagtggtttgatctatgaagaaacccgtggtgttttgaagatattcctggaaaatgtcatcagggatgctgtcacgtacaccgagcatgctcgccgtaagactgtgactgccatggatgtcgtctacgctctnaagagacagggcaggactctatatggctttggcggttgattaatttctgagagggcaggagtctatatggctttggcggttgattaatttctgttttactttggtgttttttaacaccacctgtggatctcggtcttttttatttgttttcctcaacaattttgtaaaaccccaaaacagtttacgggctcataaggctggttggatcgagcgaactttgaagtgattctgcctttctattctgtattggtgcaggttgtttgtgggttggatgatttggatttctgttgttatctgaatgaatgaatctatgtaggcttctgacttgtagggtcttattggagcatagtttctttgttagaaatatcgaatagcctttaattagggttttgacaggagtaggttattgtaaacattgaatgggagtagttctagttatcgc

SEQ ID NO: 2377 - DNA, 662 bp, Cycas rumphii
  misc_feature (454)..(454): n is a, c, g, or t
  misc_feature (507)..(507): n is a, c, g, or t
  misc_feature (511)..(511): n is a, c, g, or t
  misc_feature (513)..(514): n is a, c, g, or t
  misc_feature (527)..(527): n is a, c, g, or t
  misc_feature (531)..(531): n is a, c, g, or t
  misc_feature (533)..(533): n is a, c, g, or t
  misc_feature (537)..(537): n is a, c, g, or t
  misc_feature (560)..(560): n is a, c, g, or t
  misc_feature (563)..(563): n is a, c, g, or t
  misc_feature (566)..(566): n is a, c, g, or t
gctcaagtctgaacaaggatctaaccggaggagcctcttgatttgatttgggattaagattcagcaataaagatgtcaggtcgtggaaagggaggaaaggggttgggcaaaggaggggcgaagaggcacaggaaggttttgagggataacattcagggtatcaccaagcctgctatccggcgccttgctcggcgtggtggtgtcaagcgcatcagtggtttgatctacgaagaaacccgtggtgtattgaagatattcctggaaaatgtcataagggatgctgttacgtacaccgagcatgctcgccgtaagacggtgactgccatggatgtcgtttatgccctcaagagacagggcaggactctatacggttttggcggttgattgtattcggttctattctggtgttttttaagcaccacctatgtatttcggaaccgtttttcccaatggntattgtaaaaccccaaaagaggttatgggttcaggatgttggttgcattcatngagntnngaggtgattctgnttancncagnttatttgcgggctggatgattancgnaangcaatgttgtttgtgttacggactggttaaataattctatgtaggtttcttgcttatgaatttatcagtcatatgaatttaattagccatatttta

SEQ ID NO: 2378 - DNA, 497 bp, Cycas rumphii
ggcacgaggctgattttactgctcaagtctgaacaacgatctaaccgtaggagtttcgggatttgggattaaacatcaaggaaagatgtcaggtcgtggaaagggaggaaagggtttgggcaaaggaggggcgaagaggcacaggaaggttttgagggataacatccagggtatcaccaagcctgctatccgccgccttgctcgacgtggtggcgttaagcgtatcagtggtttgatttatgaagaaacccgtggcgttttgaagatattcctggaaaatgtcatcagggatgctgttacgtatacagagcatgctcgccgtaaaacggtgactgccatggatgtcgtctatgccctcaagagacagggcaggactctatacggttttggcggttgattctatgcggttctattctggtgttttttagcaccacctatgtatttcggaaccgtttttcgcaatggatattgtaaagccccaaaagaggttattggtt

SEQ ID NO: 2379 - DNA, 561 bp, Cynara scolymus
  misc_feature (21)..(21): n is a, c, g, or t
  misc_feature (496)..(496): n is a, c, g, or t
gcggggatacctcatatctgnatcacttcgattaaacaaaccctaaaatctgaattcagatctgatcaacaatgtctggccgtggaaagggaggcaagggattgggaaagggaggagcaaagcgacacaggaaggttcttcgcgataacatccaaggaatcaccaaacccgccatcagaagattggctcgtagaggaggtgttaagcgtatcagtggcttgatctatgaggagactcgtggagttcttaagatatttcttgagaatgtcatcagagacgccgtcacctataccgaacacgctcgccggaaaactgttactgccatggatgtggtttatgctttgaaacggcagggccgtactctgtacggatttggtggttagatttagtgtatagattgggattagtgtagatcagatctgatacctccgttgtattctattttgatttcgttgtcagtcctcatctcgaggttatgaatttatgttatgaacanttgaacaccttttttcattcgaccttcatttgaacctataatcgtttgagtttcgtcatcgaatc

SEQ ID NO: 2380 - DNA, 550 bp, Cynara scolymus
cgggactctccgacttcatttcttcaatttccgagacttcatcagattacgaggtgatttgaagaaatttgataatgtcgggacgtggaaagggaggaaagggtttggggaaaggaggtgcgaagcgtcatcgaaaggttctccgtgacaacatccagggaatcacgaagcctgcgatccgtcgtctggcgagaagaggtggtgtgaaacgtatcagcggtttgatctacgaagaaactcgcggagttctcaagatctttctggagaatgtgataagagatgctgtcacctacacggagcacgctcgacggaagactgttaccgctatggatgttgtgtatgcattgaagagacaaggtcgaactctctatggattcggtggttagggtttttgagtttgggaaaagtcttgctgtgtcaagaaagaattgggtcgggttaagatccgaataggtgttttatgaactgtagttactggtgggtgttccatcttttcttactataaagaaggtaatgaaatgatttctactactattttccttgtatttcc

SEQ ID NO: 2381 - DNA, 731 bp, Cynara scolymus
gcggggaccattaatccttttcagagagagaagcatagagagagagagagagagagagagagagatataatgtcaggaagaggaaaaggaggcaagggattggggaagggcggagcaaagcgtcaccggaaggttctacgtgacaacattcaaggtatcacgaagccggcaattcgacgattggctagaagaggtggtgttaagcgtataagcggtctaatctatgaggaaactcgaggtgtgctcaagatctttctagagaatgtcattcgtgatgcggttacctataccgagcacgctcgccggaaaactgtcaccgcgatggatgtggtttatgctttgaaacgtcaaggccgaactctctacggtttcggaggttaagagaaactcgaggttcgtaggattagacgttttttatatatggaaattgtgcttgctacttagttgttaatactagtgctatgtatcgtccagttgaatctcgtaatgcaaatgctagttttactcaaattctacacgtctagtttctcagatctaccggcgacgtctttctgaaatttgattttcgattggtgaacttgattttagaattagggaagtttttgatcatgtggctgtggctgtggctgtataactgtagatgatagatttggtcgtcggctgacagtgatggaggattttggagaaatctgctgattcctgtcaatagatcatcaattatgttctacacc

SEQ ID NO: 2382 - DNA, 513 bp, Taraxacum officinale
gcattcatcttgcatttcttcagatctgcaaagtttcaggctttggagcatattgaagaactttgagaatgtctggacgtggaaagggaggaaagggtttggggaaaggaggcgccaagcgtcatcgtaaggttctacgagacaacatccagggaataacgaaaccggcgattcgtcgtctggcgagaagaggaggtgtgaagcgtatcagcggtttgatctacgaggaaactcgcggagttttgaagatctttctagagaatgtcatcagagacgccgttacctacaccgagcacgcacgccggaaaactgtcaccgccatggatgtggtgtatgcgctcaagagacaaggccgaactctgtacggattcggtggttagggtttcgaagtcgtaaatcaatgttgttaagtatttgtcttagttttagggatttctacttcttgttgaaatcaaatgttgttagtatctgctttggacatttttatcaaatgaaaagcaattgatttctttc

SEQ ID NO: 2383 - DNA, 528 bp, Taraxacum officinale
gcgggggatctcattcattccaaatctcattcttaaactcaattcagctaaaaaatgtcaggccgtggtaagggaggcaaaggattgggaaagggaggagcaaagcgtcatcgcaaggttcttcgcgataacatccagggaatcacaaagcccgccattagaaggttggctcgtagaggaggtgtgaagcgtatcagtggtttgatctacgaggaaactcgtggagttctcaagatctttctagagaacgtcatcagagacgccgtcacctacacagagcatgcccgcaggaaaaccgtcaccgccatggatgtggtttatgctttgaagagacaaggccgtaccctttacgggttcggtggctagatttagtctgatagagtttgtagttgaattggttgtttctagatgatgtaaggttagttatttgtgttgaatttcaatcaaggccgacgaactccatctcggagtttatggaatctgtttgttaaaatccaattttacatcttaatcctgttatttagtcag

SEQ ID NO: 2384 - DNA, 519 bp, Taraxacum officinale
  misc_feature (207)..(207): n is a, c, g, or t
ggatgcattcatcttgcatttcttcagatctgcgaagtttctggctttggagtacattgaagagctttgaaaatgtctggacgtggaaagggaggaaaaggtttggggaaaggaggcgccaagcgtcatcgtaaggttctccgagacaacatccaaggaatcacgaaaccggcgatccgtcgtttggcgagaagaggaggtgtgaancgtatcagcggtttgatctacgaggaaactcgcggagttttgaagatctttctagagaatgtcattagagacgccgttacctacacagagcacgcacgccggaaaactgttaccgccatggatgtggtgtatgcgctcaagagacaaggccgaactctctacggattcggtggttagggtttcgaagtctgaaatcaaatgttgttaagtatttgtcttagtttagggatatctacctcttgttgaaatcaaatgttgttagtatctgctatggatctttttatcaaatgaaaagtaattgattgatttcgg

SEQ ID NO: 2385 - DNA, 505 bp, Taraxacum officinale
  misc_feature (99)..(99): n is a, c, g, or t
  misc_feature (360)..(360): n is a, c, g, or t
  misc_feature (480)..(480): n is a, c, g, or t
  misc_feature (487)..(487): n is a, c, g, or t
gcggggaacaaactcaattcatttctaaacagagaaagttagagagaaaacatgtcaggaagaggaaagggaggcaagggattaggaaagggaggagcnaagcgtcatcgtaaggttctccgggacaacatccaaggtatcaccaagccggcgatccgtcgtctcgccagacgaggaggtgttaagcgtattagtggccttatctacgaggagacccgtggagttttgaagatctttcttgaaaatgtcatccgtgacgccgtcacatacaccgagcatgctcgccggaaaactgttacagcgatggacgtcgtttatgctttgaagcgccagggccgtactctctacggatttggtggntaagagaaatttacagtttctagggttcttgtttggcagagaggtcttaaacctttcctgctgattttttttagcttctgcaatccgaagtgatacttcctgtaattgatgctcttaatncaaaatnacttatccattttcttta

SEQ ID NO: 2386 - DNA, 526 bp, Taraxacum officinale
atcaaagaagccatcgctattcattcttgtcagaaattaactttcatccactagaaaccgaaatttgaaaatgtctggccgtggaaagggtggaaagggtttgggaaagggaggagcaaagcgtcatcggaaagttctcagggataacatccagggaatcacaaagccagcgatcaggaggttggccaggagaggcggagtgaagagaatcagcggtctgatatacgaagagactcgtggtgttttgaagatctttttggagaatgtgattcgtgatgctgttacctacactgaacacgctcgtaggaagaccgtgacagccatggatgttgtgtatgctttgaagaggcaaggaagaactttatatggattcggaggttaattgatctgtgttgttggtactgcatattttgcttatattgttgtaatgaatcatgattttggaacatttggttccagatcttggatgtgtaattgtatgaaaatttagattaagattatatctttaaaagctcaattattgcac

SEQ ID NO: 2387 - DNA, 510 bp, Taraxacum officinale
gcgggatacatcttctctacatcgtcttcaattgcaaaaccctaatttcacattcgatcttatcctgttattgaaatgtcgggccgtggtaagggaggtaaaggattgggaaaaggaggagccaagcgacaccgtaaggttcttcgtgataatattcaaggcatcacaaagcccgccattcgaaggttagctcgcagaggtggtgtcaagcgtatcagtggtttgatatatgaggaaactcgtggagttctcaagatattcctagagaatgttattagagacgccgttacgtacaccgagcatgctcgccggaaaactgttaccgccatggacgtggtttatgctttgaaacgacaggggcgtactctctatggattcggtggttaaacttaggcaattgttagaagttactgaagtaattgtagatctaatttgtagttgtcattttgcttccgtattaatccccattttagggttgttcaatctattgaaaattactgattatttatg

SEQ ID NO: 2388 - DNA, 541 bp, Taraxacum officinale
acatatataaatctcatcgccggatccaccaaccctcacctccaatttcaagaacatccaaaatcaaatccatttctagcgagaaaatatgtcaggacgaggaaaaggaggcaagggtttgggaaagggaggagcaaaacgtcatcgtaaggttctccgggacaacatccaaggcatcacgaagccggcgatccgccgtctggccagacgaggaggtgttaagcgtatcagtggcctaatctacgaggagactcgtggagttctgaagatctttcttgagaacgtcatccgtgacgccgtcacatacaccgagcatgctcgccggaaaactgttacagccatggacgtcgtttatgctttaaagcgccagggccgtaccctctacggatttggtggttagatgaaattaacctcactagggatgtttgttttggcagcgagtctttcatcttagcctgtaagatttgtaatagttagtttctttaatcgaaggacagtaagtgtaactgaatcgcttaatgcaacatcactttgttatacc

SEQ ID NO: 2389 - DNA, 642 bp, Eucalyptus gunnii
  misc_feature (5)..(5): n is a, c, g, or t
  misc_feature (12)..(12): n is a, c, g, or t
  misc_feature (354)..(354): n is a, c, g, or t
  misc_feature (426)..(426): n is a, c, g, or t
aaaanaaacagnaaggaaaggaggagatgtcgggccgcgggaagggaggcaaggggctgggcaagggcggcgcgaagcggcacaggaaggtgctgcgcgacaacatccagggcatcacgaagccggcgatccggcgcctggcccgccggggcggcgtgaagcgcatcagcgggctgatctacgaggagacccgcggggtgctcaagatcttcctggagaacgtgatccgcgacgccgtgacctacaccgagcacgcccgccggaagaccgtcaccgccatggacgtcgtgtacgccctcaagaggcagggcaggaccctgtacggcttcggcggctgagccattgtcttctcgntggattttctcatcgtcttagatgaggggtgggttgcttttgtaaatctgtgccggtggggaattaggctgntgttgttgtagggcagttggggcatacagagcaatgcttgtttatgtgctgggattcccaaaaaccattttgggtttaatctaaatgtcttattgtgttttcgtttctgggtttgaatatgtttgtttcgaaatttgaaaagaatttacccgaagaggccgagtgatcaatgtcaatgctgatcttaattagattggaatcaagtctttgacagag

SEQ ID NO: 2390 - DNA, 487 bp, Eucalyptus gunnii
atgtcgggccgcggcaagggaggcaaggggcttggcaagggcggcgcgaagcggcacagaaaggtcctgcgcgacaacatccagggcatcacgaagccggcgatccggcggctggcccgccgtggcggggtgaagcggatcagcgggctgatctacgaggagacccgcggcgtgctgaagatcttcctggagaacgtgatccgcgacgccgtgacctacacggagcacgcgcgccggaagacggtgaccgccatggacgtcgtgtacgcgctcaagaggcagggcaggaccctgtatggcttcggcggctgaagagcgctgtcgtgatttcgctgttcgagggttcttagatatagtttgtgatgtagttgtagtgggtttttgtgtttcagatgaaatgaacttgtgggtttagtttctggttctatgtatgaattggatctatatttgagtgaatagaatttcagctttaaaaagatattttgcc

SEQ ID NO: 2391 - DNA, 641 bp, Eucalyptus gunnii
  misc_feature (63)..(63): n is a, c, g, or t
  misc_feature (68)..(68): n is a, c, g, or t
  misc_feature (71)..(71): n is a, c, g, or t
  misc_feature (74)..(74): n is a, c, g, or t
  misc_feature (78)..(78): n is a, c, g, or t
  misc_feature (523)..(523): n is a, c, g, or t
cggccgggggaaacgtaaattttctttcttgctttcctttgaattttccctcgctttcttganaaaanaanaanaagnagaagaagatgtcgggccgcggtaagggaggcaaggggctgggcaagggtggggcgaagcgccatcgcaaggtcctccgcgacaacatccagggcatcaccaagccggccatccgccgcctcgcccgccgtggcggcgtgaagcgcatcagcggcctgatctacgaggagacccgcggtgtcctcaagatcttcctcgagaacgtcatccgcgacgccgtcacctacaccgagcacgcccgccgcaagaccgtcaccgccatggacgtcgtctacgccctcaagaggcagggcaggaccctgtacggtttcggcggctagggttccggttccgattccgcagctagggtttcgctaggcgagcgtgttgggatttcttggggctgtatatggaagcgtagggttttcttgccttgttgtctttaggtgatttttagcttgttggntccgtcattgtgaagcgagattgggcgaatcaagtagatttgatgctcctcctcgtctagattgtttttctttcgattttcagtggaattaatgaaattagtttcccaaaaaaaaaaa

SEQ ID NO: 2392 - DNA, 574 bp, Adiantum capillus-veneris
tgcctcgtcagttcagaagcagcgcaagaagacgccatgtctggacgcggcaagggtggcaaggggctcggcaaaggaggggctaagcgccatcgcaaggtcctgcgtgacaatatccaaggtatcaccaagcctgccatccggcgcctcgctcgcaggggtggcgtgaagcgcatcagtggcctcatttacgaagagacccgtggcgtgctcaagatcttcctcgagaacgtcatcagagatgctgtcacctacacagaacatgcccgccgtaagactgttactgccatggatgtggtgtatgccttgaagcgccaaggcagaactctctatgggtttgggggctaggctttgtgtccaccttcttgtgttgtcgcctgctcatggagatggtcctcttagaatgaggctttccttattctcattattagggtttcatgactgaggttcattcttctgtgatttaggggtcaatgacgccatagcacaatcaggatccttgagtgattgacaggcattgtatatatctttgttgaatggaatacaatatcttgtggctgtctctagttccttt

SEQ ID NO: 2393 - DNA, 727 bp, Adiantum capillus-veneris
aacgtgattctcgagagcaggcctcagcagaaactcagatatgtctggccggggcaagggaggaaagggcttgggcaagggaggcgccaagcgccatcgcaaggttctgcgcgataatatccaggggattacaaagcctgccattcgtcgccttgcccgcaggggcggtgtcaagcgcatcagtggcctcatctatgaggagacccgtggcgttctcaaaatcttccttgagaacgttatccgtgacgctgtgacatacacagagcatgcccgccgcaaaactgtcactgccatggatgttgtttacgctttgaagcgccaaggtagaactctctatggctttggaggctgagtcctgggcgcttgttgagtttcttgcaaaaacggtgttccttcaacaccacctactctgtagatttgcttctctgctctgccagcgtgtccctcaaggtgaggccaggttctcatacataggcatgctgatctgatctggattgatggtcttctggttttcctgaagcttggattgagtagtgtttgtaatacttgtattttttggtccttcaatggaagcatgacctgcaatcacttcagaagtatggcttaaaagcctatttgttgtattgggcttggctttcattctggtgacaaattaacccaggtacatggcctttatgttcttgggcaagtccgctcaccctaaagttaacggcaggatccgcctttc

SEQ ID NO: 2394 - DNA, 486 bp, Festuca arundinacea
ggcacgaggcaaaaatccccaattccttcttcgtctcctgagaaagagagcgagctgcggagatgtctgggcgcggcaagggcggcaaggggctgggcaagggcggcgccaagcgccaccggaaggtgctccgcgacaacatccagggcatcaccaagccggcgatccggcgcctggcgaggaggggcggcgtgaagcgcatctccggcctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggtggctaggctttccttgtgttgtttagggagaatacctgactatcgtgttggtgtcaaatgctgtgcctgatgtaatggaaaccctgttgcagtgaagtaaaaatcccgttatctcgtt

SEQ ID NO: 2395 - DNA, 579 bp, Zingiber officinale
taacaaacccatacattttttctccaacttgtcgatcattgattattcctcgtgccgaattcggcacgagggagccattcagattttgccatctgagattcgtcggaggcgaggcgaggcgatgtcggggcgtggaaagggcggcaagggtttgggtaagggtggggctaagcgccatcgcaaggtgctccgcgacaatatccagggcatcaccaagcctgcgattcgccgactggcaaggaggggcggcgtaaagcgtatcagcggcctcatctacgaggagacccgtggcgtcctcaagatcttcctagagaacgttatccgcgatgcggtgacctacactgagcacgcgcgccggaagactgtcaccgccatggacgtagtatatgctctaaagaggcaaggtaggactctgtatggtttcggtggttagggttttgtctttgacaaaagtcttgctgtcaagaaattggaaaacttgtggtttcatattagaattgcaggattagggttttttttggtccagccatgcttctagaacttgtgtccatgtgtaactgcttgtttttcttaccttca

SEQ ID NO: 2396 - DNA, 556 bp, Zingiber officinale
cttgcagccttcagtcgatcgagagctcgattaggccgagatgtctggaagaggaaagggcggcaagggattgggcaagggcggcgcgaagcgccaccgcaaagtgcttcgcgacaacatccagggcatcaccaagccggcgatccggcgcttggcaaggaggggcggcgtgaagcgcatcagcggcctgatctacgaggagacgcgcggcgtcctaaagatcttccttgagaatgtgatccgtgacgctgtgacctacacggagcacgctcggaggaagaccgtcaccgccatggacgtcgtctacgcgctaaagaggcagggaaggactctgtatggcttcggtggttaattagacatgcctatttactggaaatagttccaaagtataatgtcgtagttagattgttcctagaattggtttgtaatgtgtttggaatttgatcgtgttgtcttgtattactaatctgagttcttagatttccagaattagttttaaatataatttaagtgactttgtaatgtatttttaatcatcaagaaagtcccctcgtgc

SEQ ID NO: 2397 - DNA, 547 bp, Zingiber officinale
  misc_feature (239)..(239): n is a, c, g, or t
  misc_feature (290)..(290): n is a, c, g, or t
  misc_feature (355)..(356): n is a, c, g, or t
  misc_feature (410)..(410): n is a, c, g, or t
  misc_feature (433)..(433): n is a, c, g, or t
ccaaatcgagagcttgattgagatcgataatgtcgggccgcggtaagggaggaaaggggctgggcaagggcggcgccaagcgacatcggaaggtcctccgagacaacatccaggggatcaccaagcccgcgatccgccgactggctaggaggggcggcgtcaagcgtatatccggccttatctacgaggagacccgcggcgtgctcaagatcttcctcgagaacgtcatccgcgacgcngtgacctacaccgagcacgcccgtcgcaagaccgtcacggccatggacgtngtctacgccctcaagcgccagggccgcaccctctacggcttcggcggctaaacttcatcgatgtnngatgctgcaagggattaaaggaagcatcttgtcagatcgtctattgtatcctangaaaatgaacctcgagtgtgctnttagttttgttccgtcgaatgttgatagatgtggttttcaacttttccttagaagctaatggaactttggtttggcgtagcaatctaaaaactcgccttttttttacctcttgc

SEQ ID NO: 2398 - DNA, 720 bp, Vitis vinifera
ctaacgtccacgtcatcgatccgagtagcttccaatcctttatctgaaccgtccaaatgaaaccatggacgaccgtaaacgctcccacaaaccaccacaaggatcaaccccaaatctaatcaaccaaagcgtcccgctataaattcacaactacctgctgccgattgccatcgaacccttgtactccaccaaatctcttagattcaaattttctcaatttgagcttaaacaatgtcggggcgtgggaagggaggcaaaggattgggaaagggaggggcaaagcgacatcgtaaggtgctccgtgataacatccagggtatcacgaagccagccatacgtaggctggctaggagaggaggtgtgaagcgtatcagcggtctgatctatgaggagacccgtggtgtgctgaagatcttcttggagaacgtcattcgggacgccgtcacctacacggagcacgctcgccggaagaccgtgactgccatggacgtcgtctatgctctcaagaggcagggcaggactctgtatgggtttggtggttaaggtttcacctgcaaaagtcttgctgtcaagaaaatttagaaattatgtcggtttctcgtttgggaatctagggtttcatattggggcttctgtaattacagatgtttagattttcttattgtagctgttttgtaatccgaagcatgaattacaatttcactagtattattgtatatt

SEQ ID NO: 2399 - DNA, 552 bp, Vitis vinifera
attgctatcacagttctctctttcaattggttcagagctcttgattcagctccaagatcatccattccttgatctacaatgtctggccgtggcaagggaggcaagggcttgggaaagggtggagccaagcgtcatcgcaaggtcctccgtgataacatccagggcatcaccaagcctgccatcaggcgtctggccagaagaggaggcgtgaagcgtatcagcggtctgatctacgaagaaaccagaggggtgctcaagatcttccttgagaacgttatcagagacgctgtgacctacactgagcacgctcgtcgcaagaccgtgacggctatggacgtggtgtacgcgctcaagaggcagggcaggactctctacgggtttggtggttagggtttgtgaatggaaagtctcgcagcctagaagcgaaggcgttgtgtagaggctaattttagggtttattttcttggatttaatgggatgtactgctccatatctttgggcatcattttgtgatatattctgaaatgaaaacggacggtattttgagcatta

SEQ ID NO: 2400 - DNA, 735 bp, Vitis vinifera
gccaaatcaaaaccctaaccctgactctcaaattattagcagtgtacaatgtcaggtcgtggaaaaggaggcaaggggctcggtaagggaggagcgaagcgtcatcggaaagttctccgtgataacattcagggaatcactaagccggctatccggcgtcttgcgagaagaggtggagtgaagagaatcagcgggttgatctacgaggagaccagaggcgttttgaagatcttcttggagaacgttattcgcgatgctgtgacgtacactgagcacgccaggcggaagacggtgaccgccatggatgttgtttacgcccttaagaggcagggaaggactctgtacgggttcggtggttaagattcatgtaattgaatttacgccgtctttggccatagtattgccgtttttgtcgaaattcaccatctgaatttcgtcaattttttttttcttcttcttagttttgtttagggtttgtgatgtgtagatgatgtcttcaaatggctaagaactgcagttcttttaacaggaaaagacttgctacgtcctcctatctgacttgcagctaaattgtcagagcccttgtgtggcaatggaacgggaggatctgaatcgatgtcgattaatcgactgttagcatgaatgtgaaatatttgttttcattttattgacaaaatgaaagtatatgatctcttattgaatgtcaatttggccgaattgaccaaactctttaaa

SEQ ID NO: 2401 - DNA, 640 bp, Vitis vinifera
aaatcaaatccgaaaccctagaattctagctgaaaatgtctggccgtggaaagggtggaaagggcttgggtaagggaggtgccaagcgccaccggaaggttctcagagataacattcagggtatcaccaagcctgccattcgccggcttgcgagaagaggtggtgtgaagaggatcagtgggctgatctatgaggaaaccagaggggttcttaagatcttccttgagaatgtgattcgcgatgctgtgacctacactgaacatgcgagaaggaagacggtcaccgccatggatgtggtttatgctctcaagaggcagggaaggactctttatggatttggcggttaattgtaatttcttaaaagctttggatccagcgctagtggatgtagattgtgtttttagattgtttttaaggactcttgtttcactgttatctgcaactctcattttccacaagtaatggaaatttgaactttgcccaatttgttttggattcttttcgtttccctttcatcaatgttcatctttggttgaaagattccagtgtggaaaaaagggggagtctgtcaacagcttagattggaaagctaattgcatgattcgattgtcttttgtttaaatcaatttggtgttttaga

SEQ ID NO: 2402 - DNA, 566 bp, Vitis vinifera
atcttcctcaccaaatcaaaatccttaccctaagagtactagctgtgaacgatgtcgggtcgtggtaaaggaggcaaggggctcggcaagggaggagcaaagcgtcatcggaaagttctccgtgataacattcagggcatcacgaagccggcgatccggcgtctggctagaagaggtggggtgaagagaatcagtgggttgatctacgaggagaccagaggcgttctgaagatcttcttggagaacgtcatccgtgatgctgtgacttacactgagcacgctaggcggaagacggtgaccgccatggatgtggtttacgccctcaagaggcagggaaggactctatacgggtttggtggttgagattcgtgtaataggattgacgccacttttggcctctgtattggcctttattgcgaaatccattctctgaaatttcgctatttatttcttagatcttttagggttcctgctgtgtagatgatgtcttgaaatggttaagaaccgcggttctttgaacaagaaaagacttgctttcgttttaatggaaatagatatgttctcca

SEQ ID NO: 2403 - DNA, 776 bp, Mesembryanthemum crystallinum
  misc_feature (51)..(51): n is a, c, g, or t
actagggtcctagtagtcagttcgcggggccgcgtcgacacaggaatccanataacacattctctctctctaatttctcctctcatcaaaaagtcacccctattgttcagaaatgtcaggccgtggaaagggaggcaagggtttgggaaagggaggcgcaaagcgtcacaggaaggtgctgagggacaacatccagggcatcactaagccggcgattcgccgccttgctcgtcgtggcggtgtcaagcgtatcagcggtctgatctacgaggagactcgcggtgtcctcaagatcttccttgagaatgtcatccgtgatgctgtcacctacaccgagcacgctaggaggaagacggtgactgccatggatgtcgtctatgctctcaaaaggcaagggaggaccctctatggtttcggcggttagggatttttcgatttctagggtttctggaggtatcgtagatgttgttggtcggatattagggtttcgtagaatttgtagatctggtgttttgttggtttttgtttagttttagtggtggtttaatggtttgatgatgtaattgaagctgcttctatcaagtaatgaaaatctctttcttacttaccacacataccattctttccttcctctcctccctcatttcctccacccctttctcccccaccccaccgtctctcttcatccaccctttccctcttctttccttccctccccctctccttcattgccttcaccttcctcctctcttcctttcccttccttcccttcctca

SEQ ID NO: 2404 - DNA, 512 bp, Mesembryanthemum crystallinum
gcacgagatctaaaccttcaaatctctccgagtgaaaatgtcgggccgtggaaagggcggaaaggggctgggcaaaggcggcgcaaagcgtcacaggaaggtcctgagagacaacatccagggcatcaccaagcccgccattagaaggctggctcgtcgtggtggtgtcaagcgaatcagcggtctcatctatgaggagaccagaggtgtgttgaagatctttcttgagaatgtcattcgtgatgctgtcacctacaccgagcacgctaggaggaagacggtgactgccatggatgtggtttatgctcttaagaggcaaggaaggaccctttatggatttggcggttaatttctgtgctttggtttctagattgtggtgtagggtcatagggtagctgtctctctcctaattggcttttgggtctttgctatggtgtaaattttggggggggattttagatctgggtttcggatcttttggccgttatgtaatgggagatgaaattgatgaa

SEQ ID NO: 2405 - DNA, 616 bp, Ipomoea nil
catcacgcccttccaaatcaaaatctacttgtccaatttacctctcactccaccaattcaaaaccctagatttcttctttctctctgcaaaaatgtccggccgtggaaagggaggcaagggattgggcaagggaggagccaagcgtcacaggaaggtgcttcgcgacaacatccaggggatcacgaagccggccattcgccgtctggctcgtagaggaggcgtgaagcgtatctccggcctcatctacgaggagaccaggggagtcctcaagatcttcctcgagaatgtgatcagagacgccgtgacatacactgagcacgctcggaggaagaccgtgacggcgatggacgtcgtctacgccctcaagaggcagggcaggactctgtacggtttcggaggctaggatgttgggatgcgctattggatgttcgtctgtgtaattgcagatctgttggactatttccgtttagtttttagttatgtttttaggttgtaggtagcgattgtctgcttgtttcgtgaatgtaatatcctgttgcagttaaagcatcactaataccttctgttctgattttgtgaatcaatacaacgttatctgctctatgaaaaaaaaaa

SEQ ID NO: 2406 - DNA, 521 bp, Ipomoea nil
gacagcgtgatcaaaagacaggtcagatttccttagcgaagaagagaagaatttgctgaaaatgtctgggcgtggaaagggcggtaagggtttgggaaagggaggagcgaaacgacaccgtaaggtcctccgggacaacatccaaggcatcacgaagccggccattcgccgtcttgctcgccgtggtggagtgaagcgtatctccggcctcatctacgaggagactcgcggcgtcctcaagatcttcctcgagaacgtcatccgcgacgctgttacctacactgagcacgctcgccggaagacggtcaccgcaatggacgtcgtctatgctctcaagagacagggccgcactctgtacggattcggcggttaggttttgatatcggcggtgtatatttcggtggtgtttagatctagggttgatgattagggttaaattgggcgttctgttctgaatcaatctcagattgattgttacaatgtgactctgatattaatcatagaatttcagttcttatgaa

SEQ ID NO: 2407 - DNA, 528 bp, Ipomoea nil
  misc_feature (516)..(516): n is a, c, g, or t
agcgcaataaaaaatctttgaaaggtaagcgaagaacagaagagttttctgaagatgtctggtcgtggaaagggaggtaagggtttgggaaagggaggagcgaaacgacaccgtaaggttctccgggacaatatccaaggcatcacgaagccggccattcgccgtctcgctcgccgtggtggagtgaagcgtatctccggtctaatctacgaggagactcgcggcgtccttaagattttcctcgagaacgtgatccgcgatgctgttacctacacagagcacgctcgccggaagacggtcaccgcaatggacgttgtgtatgctctcaagagacagggccgcactctgtacggcttcggcggttagggtttggcattggcggtgtatattttggtggcgtttaggtctaggattggggaggattagggttagattcggtgtgctattttgaatcaatccacaattgattgcttgttgcaatgttactcttatttcaatccaatcaatttcagttcnaaaaaaaaaaaa

SEQ ID NO: 2408 - DNA, 534 bp, Ipomoea nil
  misc_feature (6)..(6): n is a, c, g, or t
  misc_feature (523)..(523): n is a, c, g, or t
gcgcantcaaaaatctttgaaaggtcagtgaagaagagaagagttgtctgaagatgtctgggcgtggaaagggcggtaagggtttgggaaagggaggagcgaaacgacaccgtaaggttctccgggacaacatccaaggcatcacgaagccggccattcgccgtctggctcgccgtggtggagtgaagcgtatctccggtctgatctacgaggagactcgcggcgtcctcaagatctttctcgagaacgtgatccgcgatgctgttacctacactgagcacgctcgccggaagacggttaccgcaatggatgttgtgtatgctctcaagaggcagggccgcactctgtacggcttcggcggttagggtttggcgtcgctggtgtatattttggtggtgtttaggtctagaattgaggaggattagggttagattgggtgtgctattttgaatcaatccacagattgattgattgattgttgcaatgttactctgatttcaatccaatcaatttcagttctaancaaaaaaaaaa

SEQ ID NO: 2409 - DNA, 624 bp, Ipomoea nil
gatacactctccattgtcgttgcattgtgagctcgaggtcattcttcgtcttctatacatttctcagatttaggaatttgtagagtgtcggttcagaatgtcgggtcggggaaaaggaggcaagggattgggaaagggaggagcgaagcgtcacaggaaggtcctccgcgataacatccagggtataactaagccggccattcgtaggctggcccgtagaggcggcgtgaagcgtatcagcggcctcatatacgaggagactcgcggcgttttgaagatctttctggagaatgtgattagggatgccgttacctacaccgagcacgcccgccgcaagacggttactgccatggatgtggtgtatgcgctgaaaaggcagggtcggactctttacgggttcggcggttgagcgttttgggctgaaccgtttgtactggtttttgttatgagtcttgctgtcaagaaaattagaactgtcaacaatggctctctgctttctgacttttttgtaaatactcttcagtgttgggtattgtcttcttaggtaggtagtagtttgttcactttactggtgatgttgaatgcttcatgttttgtttctggaatgggaattttgttgttgaa

SEQ ID NO: 2410 - DNA, 633 bp, Ipomoea nil
gacccgaatacactcttcattgtcgttccaatttgagcttcaggccattctgcaacaacttttatacacttctcagttttaggaatttgtagttgggtgtctgttcagaatgtcgggtcggggaaaaggaggcaagggattgggaaagggaggagccaagcgtcacaggaaggtcctccgcgataacatccagggtataaccaagccggccatccgtaggctggcccgtagaggcggcgtgaagcgtatcagcggtctcatatacgaggagactcgcggcgtgttgaagatctttctggagaatgtgattagggatgccgttacctacacggagcacgcccgccgcaagacggttactgccatggatgtggtgtatgccttgaaaaggcaggggaggactctgtacggattcggtgggtgaatcgtttgtactggttttttgttatgagtcttgctgtcaagaaaattagaactgtcaacaatggctgggctcttttcttactcacttttttgtaaatactcattgttgggtattgtgttcttaggttggttgtagtttagtcactttagtgttggtgttgaacgctttatgttttgtttcagtaatgggaaatttgttgtggaaaaaaaaaa

SEQ ID NO: 2411 - DNA, 514 bp, Ipomoea nil
gaccaattcttcaatcttccaatcgaaaccctagaaagcttttctcatcaaatttctcagtgcgaaaatgtcaggccgtggaaagggaggcaagggcttgggtaagggaggagccaagcgtcacaggaaggtcctccgcgacaacatccagggcatcaccaagcccgccatccgccgtctggctcgcagaggcggcgtgaagcgtatctccggcctcatctacgaggagaccagaggcgtcctcaagatcttcctcgaaaacgtgattagagatgcggtgacctacacggagcacgcccggagaaagaccgttacggcgatggacgtggtttacgcgctcaagaggcagggaaggactttgtacggatttggtggttaggagcttcataaactagggtttatgcttcttttctgaaatcagtggattatttgtgcttctgcattagttctatttactactgtgtaattctcaattgcgctgaaatatatcgattaattgaagataaaaaaaaaa

SEQ ID NO: 2412 - DNA, 609 bp, Ipomoea nil
  misc_feature (52)..(52): n is a, c, g, or t
  misc_feature (471)..(471): n is a, c, g, or t
tacggccggggactttcaaatcaaaatctacttgtccattttacctcagtcngcgaattcaaaaccctagatttcttccttcactctgcaaaaatgtccggccgtggaaagggaggcaagggattgggcaagggaggagccaagcgtcacaggaaggtgcttcgcgacaacatccaggggatcaccaagccggccattcgccgtctggctcgtagaggaggcgtgaagcgtatctccggcctcatctacgaggagaccaggggagtcctcaaaatcttcctcgagaatgtgatcagagacgccgtgacctacactgagcacgctcggaggaagaccgtgacggcgatggacgtcgtctacgccctcaagaggcagggcaggactctgtacggtttcggaggctaggctgttgtgcgctattggatgttcgtctgtgtagttgcagatctgttcgactatttccgtttaggntctaggtagctattgcctgttttgtgattgataatttagaagtaaatgtaatatcctgttgcagttatgcagttacctgatctgattttgtgaatcaatacatcgttatctgctctatgaaaaccgaatttcgttcat

SEQ ID NO: 2413 - DNA, 539 bp, Actinidia deliciosa
ccgttttccactgaaaaccccagaattgattcctccaatttcttcgaaaatgtctggtcgtggcaagggaggcaagggcttgggaaagggaggagcgaagaggcacaggaaggttctgagagacaacattcagggcatcaccaagccggcgattcggaggctcgcgagaagaggtggtgtgaagagaatttctgggctcatctatgaggagactcgcggtgttctgaagattttcttggaaaatgtgattcgtgatgctgtgacctacacggagcacgcgaggaggaagacggtgaccgccatggacgtggtctacgcgctcaagaggcagggaaggactctttacggcttcggtggttagattgtcgattaggcatttcgatctatcagttgtgtttgcagattctctctctctctctctctctctctgagtctgttctgttgtagtattgttttgctggtgcttccaggtttttgtaattctctttcaaaaccaagtaattagacaactttcgttcgtagttttctattaaaaaaaa

SEQ ID NO: 2414 - DNA, 530 bp, Actinidia deliciosa
ctgaaaaccctagattcgatttctccaatttattcgaaaatgtctggtcgtggcaagggcggcaagggcctgggaaagggaggagcgaagaggcacagaaaggttctgagggacaacattcagggcatcactaagcctgcgattcggaggctcgcgagaagaggtggtgtgaagaggatttctggtctcatctatgaggagactcgcggcgttctgaagatttttctggaaaatgtgattcgtgatgctgtgacctacacggagcacgccaggaggaagacggtgaccgccatggatgtggtctacgccctcaagaggcaaggaaggactctttacggcttcggtggttagattgccaattaggcatttcgatctatcagttgtgtttgcagattctctctctctctctctctctctctctatgagtatgttggtagtattgttttgcagttgcttctaggtttttgtaattctctttcataaccagaagtaattgaacaagtttcgtttgtagttttaaaaaaaaaaaa

SEQ ID NO: 2415 - DNA, 541 bp, Actinidia deliciosa
  misc_feature (21)..(21): n is a, c, g, or t
  misc_feature (24)..(24): n is a, c, g, or t
  misc_feature (26)..(28): n is a, c, g, or t
  misc_feature (30)..(30): n is a, c, g, or t
  misc_feature (46)..(46): n is a, c, g, or t
  misc_feature (211)..(211): n is a, c, g, or t
  misc_feature (536)..(536): n is a, c, g, or t
ctcctccaaaccctaacaagnatncnnncntccctctctctctctngatatgtctggtcgcggcaagggcggcaagggcctgggcaagggcggagcgaagcggcacaggaaggtgctccgggacaacatccagggcatcaccaagccggcgatccgccgcctggctcgccgtggcggagtcaagcgtatcagcggcctcatctacgagganactcgcggcgtcctcaagatcttcctcgagaacgtcattcgcgacgccgttacctacacagagcatgctcggaggaagacggtgaccgccatggacgtggtctatgctctcaagaggcaagggaggactctgtacgggttcggtggttgagctttgtttgtgtctgtctatttggtttctctagggtttactgaaactaggttgagttgtaaattagtctattgagcttttgtgttttgaagttgtcaagctggatgtattgaaatcctactttggattggaaatctgttaggttttggatggaaatgtggagcattttgatccncccac

SEQ ID NO: 2416 - DNA, 581 bp, Actinidia deliciosa
ctatataaatcacctctcactcatcactctctccaagttcaattcgacaaactctctctctctctagaaatcccaaatctcattgataatgtcaggtcgcggcaagggaggcaagggtttgggcaaaggcggagccaagcgccaccgcaaggtcctccgggacaacatccaggggatcacgaagcctgcgattcggaggctggcgaggagaggaggggttaagaggatcagcggcctgatctacgaagagaccagaggggttttgaagatcttcttggagaatgtgattcgcgatgctgtgacctacaccgagcacgctaggaggaagacagtgacggccatggatgttgtgtatgcgctgaagaggcagggaaggactctttatgggttcggtggttgagggattgggtaattgatgtaattgatcgattacaatttaatgcaatatggttttgttaatgaatctcgctctttgtttctctatttatatgctgtgtgtctccgtatgtggtgttgagagttgtggttttgtttcaatcaattggatatagggtttgttgaatgttgtgaaaaaaaaaaaa

SEQ ID NO: 2417 - DNA, 1322 bp, Actinidia deliciosa
catcactccccaaagaaagaggagagagagagagagcccaactatggcgtcctcttcaatgccttcaacactcggttcttcctcttcttcaattccacttcttcgccacactctcacccacactcacacgtcaccaccacgatccccaatctccttcaaccgtacttcaagaatttcccccaaaataatcccatccttacaccaccacaggccccacccatgcccatccatcagggcccaaaccctagatttctcgggcacatttttcgagggaggattcgaaggcgaagaagtgccgctaacccctctcgggtccgccatcacgccggttgaagacaaggaggagccgccgtgccctcccggcctccgcaagtacgaaaccatggccgttttgaggcccgacttgtccgaagacgagcggctgaatgttacccagaagtacgaagagttgcttgttgctgggggaggcatgtacgtggaggtgtttaatagaggagttattccgctcgcctacagcatcaagaagaaaaacagagaaggagagacgaacacttacttagatggtatctacctcctcttcacttatttcaccaaacccgagtctatggaagttcttgaagagacgcttaaaacagatgataatgtaattcgatcatccacttttaaaatcagaaagaggaagtactgagttagggtactttcgattcagtcacatattgtagaactctttcacttcctcctgttgttggaaatcaatttggttgtgtaacataatcagttttctggcagtaagagcacaaagctaccctctttcgcttccatgtatttgcagattatttacttgaagtttgaattgaacaagcatccctctctctttcgatatgtctggtcgcggcaagggcggcaagggcctgggcaagggcggagcgaagcggcacaggaaggtgctccgggacaacatccagggtatcaccaagccggcgatccgccgcctggctcgccgtggcggagtcaagcgtatcagcggcctcatctacgaggagactcgcggcgtcctcaagatcttcctcgagaacgtcattcgcgacgccgttacctacacagagcatgctcggaggaagacggtgaccgccatggacgtcgtctatgctctcaagaggcaagggaggactctgtacgggttcggtggttgagtttgtgtctgtctagtatctctagggtttgctgaaactaggttgagttgtaaattagtttattaagcttttgtgttttgaaaattgtcaagctggatgtattgaaatcctactttggattaaaaaaaa

SEQ ID NO: 2418 - DNA, 616 bp, Actinidia deliciosa
aatcgatcgaaagtttccgagtcaggatctacaagctctttgcgaggtgatcgaaaatgtcgggacgtggaaagggaggcaaggggctgggaaagggaggagcgaagcggcaccgcaaggtcctccgtgacaacatccaggggatcacgaagccggcgatccggaggctggctcgcaggggcggagtgaagcgtatcagcggcctcatctatgaggagacgcgtggcgtgctcaagatcttcctcgagaacgtcattcgcgatgccgtgacctacactgagcacgctcgccggaagaccgtgacggccatggacgtggtgtatgcgctcaagaggcaggggaggaccctctacgggtttgggggttagggtttttgtgacaaagtcttgctgtcaagaaaggggtgaaaaaaaagtgttttgggaatttatttggatgtgggttagggataggattatagagtgtttccgtgggttagggataggagtatggagtatggttcctttggagttctctcgtgtaattacactagtttctagttcgatggcctttttcttctactagaaggttctttgtatgacaatgccatgaattgcgaattcagaagttattcctt

SEQ ID NO: 2419 - DNA, 407 bp, Actinidia deliciosa
atctcatcaacaatgtcaggtcgcggtaagggaggcaaggggttgggaaagggcggtgccaagcgccaccgcaaggtcctccgggacaacatccaggggatcacgaagccggcgatccggaggctggcgaggagaggaggggtcaagaggataagtggcctgatctacgaagagaccagaggggttttgaagatcttcttggagaatgtgattcgcgatgctgtgacctacactgagcacgctaggaggaagacggtgacggccatggatgttgtgtatgcgttgaagaggcagggaaggactctttatgggtttggtggttaagggttttggttaacgatgtaattgaccgattacaatttaatgcaatatgggtttgttactgaatctctctacgtttctctatt

SEQ ID NO: 2420 - DNA, 738 bp, Actinidia deliciosa
ccaaacccaaacaaatctcattcctccaaagcgacttctctctctctctctctctctctctctctctctctctctctcgaaatgtctgggcgtggcaagggcggcaaaggcctaggcaagggcggtgcgaagcggcacaggaaggtgctccgggacaacatccagggaatcaccaagccggcgatacgtcgcttggctcgccgtggcggtgtcaagcgtatcagcggtctcatctacgaggaaactcgcggtgtcctcaagatcttcctcgagaacgtcattcgcgacgccgtgacctacaccgagcatgctcggaggaagacggtgaccgccatggacgtggtctatgctctcaagaggcaggggaggacactgtacgggttcggtggttgagctttgtttgtgtctgtctgtctgtttattttagggtttactgaaattaggttgagctgtaaattagtttcgtaagcttttgtgtcttgaaattgtcaagatggatgtattgagatccaactttggatttggaaatctgttagctttgggatggaattgttgaacatgttgatccaattatgaccattatctctgtcttccccatttgcttatatacagatatacatgaatagcacttcaggatcaatctcgtgttaagaaccggagagtttgatctaatttagggatgttggtcttttaggtgctcgggcttgttcaaacctggaactccatttcgaagtgagc

SEQ ID NO: 2421 - DNA, 561 bp, Actinidia deliciosa
  misc_feature (38)..(38): n is a, c, g, or t
aatcaattgccatagcaaaaccctaacaactctctctntctctctctctctcgaaaatgtctggtagaggcaagggcggcaaggggctgggcaagggcggagcgaagcggcaccggaaggtgttgcgcgacaacatccagggcatcacgaagccggcgatccggcgcctggctcggaggggtggggttaagaggatcagtggccttatctacgaggaaactcgcggcgtcctcaagatcttcctcgaaaacgtcattcgcgacgctgtgacctacaccgagcatgcccggaggaagactgtgactgccatggatgtggtctacgctctcaagaggcagggcaggactctctacgggtttggtggttgagtcggtggttggtgtggcttgttatattagggtttgctggaggtggattctggatgtaaattgtggttttagggttcgtgttttcgaatttagcttttcgattcaaatgctctagttgaatgtactgaaagtttcccttgtattgggtatttctttaatgatatggtttgattttggattcaaaaaaaaaaaa

SEQ ID NO: 2422 - DNA, 509 bp, Lactuca sativa
caaaacaccaaaccctaatttgaaatcagatctcctctgcttcaaaaatgtcaggccgtggaaagggaggcaaaggattgggaaagggaggagcaaagcgtcatcgcaaggttcttcgcgataacattcagggaatcaccaagcctgctatcagaaggctcgctcgtaggggaggtgtgaagcgtatcagtggtttgatctatgaagaaactcgtggtgttctcaagatctttctagagaatgtcatcagagatgctgtgacatacaccgagcacgctcgacggaaaactgttaccgccatggatgtggtttatgctttgaagagacaaggccgtaccctttacgggttcggtggttagatttagtgttagattagctaaattggtagattattattatgtaagatgtatcgtttctgttgaatttcaattaaagccgatgtactccatctcggagtttattgctatgaaagctatgtgttcatcaatatcctgtgcttttacttctga

SEQ ID NO: 2423 - DNA, 539 bp, Lactuca sativa
atctcattcattcacaaaacaccaaaccctaatttgaaatcagatctcctctgcttcaaaaatgtcaggccgtggaaagggaggcaaaggattgggaaagggaggagcaaagcgtcatcgcaaggttcttcgcgataacattcagggaatcaccaagcctgctatcagaaggctcgctcgtaggggaggtgtgaagcgtatcagtggtttgatctatgaagaaactcgtggtgttctcaagatctttctagagaatgtcatcagagatgctgtgacatacaccgagcacgctcgacggaaaactgttaccgccatggatgtggtttatgctttgaagagacaaggccgtaccctttacgggttcggtggttagatttagtgttagattagctaaattggtagattattattatgtaagatgtatcgtttctgttgaatttcaattaaagccgatgtactccatctcggagtttattgctatgaaagctatgtgttcatcaatatcctgtgcttttacttctgaaatgcattttatttgt

SEQ ID NO: 2424 - DNA, 563 bp, Lactuca sativa
ggaaactgtaatcaaagactttcgtgatggggatcagtacatctcaaattcaaaacttttcaatccattcctacagagagagttacagacatgtctggaagaggcaagggaggaaaggggctaggaaagggaggagcaaagcgtcatcggaaggttctccgtgacaacatccagggaattaccaaaccggcgatccggcgtttggccagacgtggcggcgttaagcgtatcagcggtctgatctacgaagaaacccgtggtgttctcaagatctttctagaaaatgtcatccgtgatgctgttacctacaccgagcatgctcgccgaaagactgtcaccgccatggatgtcgtctacgctttgaaacgtcagggacgtaccctttacggtttcggtggttagggtttttatttggtttaggtatttcttgcctttatgcaccgatttagatctctagtgtttagatttcagttcaccttgttgatgttcagttatgtatgatattcaatgcaattgaagccttatcgattcaatattaatcaagatcttagcttattttcgta

SEQ ID NO: 2425 - DNA, 522 bp, Lactuca sativa
aagcttcatctacttttcttcgattttcaaatttcagatttcggagcaatttgaagaagtctgaagatgtcaggacgtggaaagggaggaaagggattgggaaagggaggtgcgaagcgtcatcgtaaggttctgcgagacaacatccagggaatcacaaaaccggcgatccgccgtcttgcgagaagaggaggtgtgaaacgtatcagcgggttgatctacgaggaaactcgcggagttttgaagatctttcttgaaaatgtcatcagagatgctgttacatacacggaacacgcccgccggaaaactgtcaccgccatggatgtggtgtacgctctcaagagacaaggccgaactctctacggattcggtggttagggttttactagtgttgttgttatgttacggatttctactactcgttgaaatcgactgttagtttttgttatgctctatcttaaaccaaaccagaagcaatagactgtttccgtattttgacttcgccaaatcaaattcaaattg

SEQ ID NO: 2426 - DNA, 644 bp, Lactuca sativa
cttcggcgggggcagcaaaataaatcaagagaaaacttcagtagaggaaatgtcaggaagaggaaaaggaggcaagggactgggaaagggaggagcaaaacggcatcgtaaggttctccgagataatatccaaggcatcacgaagcccgcgatccggcgtctggccaggagaggaggtgttaagcgtatcagtggtttaatctacgaggagacgcgtggagttttgaagatctttcttgagaacgtcatccgtgacgccgtcacatacaccgaacatgctcgccggaaaactgttaccgccatggatgtcgtttatgctttgaagcgccagggtcgtactctctatgggtttggtggttaaatggaatttttgggtttagggttctgatatgaactgataatttatgtaactaaacctcttagtataatatcagttaatgagcacttcgttttctcgaatgatttatgtttatgcaatacaggacatttagtttgttttctttcattaagtttgacgttttaatagtgatgttatttagcgactgtgatacttttagagttgtaggtgttatatgcaaagcttgtttgaagctttacaagtaattaatcaacaaaaaccataaatattttgagattagtgattt

SEQ ID NO: 2427 - DNA, 548 bp, Lactuca sativa
cgcagagtggccattacggccgcggaacaaacaaaaatcagattcatttccaacgaaagaaaagtagagagaaaacatgtcaggaagaggaaaaggaggcaagggattgggaaagggaggagccaaacgtcatcgtaaggttctccgggataacatccaaggtatcaccaagccggcgatccgccgtctggccagacgaggaggtgtcaagcgtatcagtggcctaatctacgaggagacccgtggagttttgaagatctttcttgagaacgtcatccgtgacgccgtcacatacaccgaacacgctcgtcggaaaactgtcaccgccatggatgttgtttacgctttgaagcgccaaggccgtactctctacggatttggtggttaagagaattttacggtttctactttgtagggttcttgttgatttgttggcttatctgtaatccgaagtggtattacctgtaattgaagctattaatacaatatcacttatctaattaatcttttacgaagaaaaaaaggcgaaggccttttctgacttgtag

SEQ ID NO: 2428 - DNA, 510 bp, Lactuca sativa
atctcactcctcactcgatcagaacacaaattcagcatctcaccttgagctagtttcaacaatgtcgggacgtggaaagggaggcaagggactcggaaagggaggagcaaagcgacacaggaaggttcttcgtgataacatccagggaatcaccaaacccgccatccgaagattggctcgtcgaggaggtgtcaagcgtatcagcggcttgatctatgaagagactcgtggtgttctcaagatctttcttgagaacgtcatcagagatgctgtaacctacaccgaacacgctcgccgcaaaactgttactgcgatggatgtcgtctatgcgttgaaacgacagggccgtaccctatatgggtttggtggttaggtctagggttttggttgtgtgttagcgtgtattcactgtagatcgtatctaatttctccttcgttgtatcctgtttcaatatcgttgtcataccccatctcggggtttgaatttatgttaagaaaatcctcctattt

SEQ ID NO: 2429 - DNA, 576 bp, Lactuca sativa
tggtataacgcagagggcccattacggccgggacagaaaacaaaaacaaaatgtctggaagaggaaaaggaggcaagggtttgggaaagggaggagcaaaacgtcaccggaaagttctccgtgacaacatccagggaatcacaaagccggcgattcgccgtcttgcgaggcgtggtggcgttaagcgcataagcggtcttatctacgaagagacacgtggtgtgttgaagatcttcctcgagaacgttattcgtgacgctgttacttacacagaacatgctcgccggaaaaccgttactgcgatggacgttgtctatgcattgaagcgtcagggtcgtactctgtatggattcggtggttgaggtaacatagggtctgtattgttaggttattttgagatttccgatttccttcgttttgttgtggaaatgtatgatatatcagtttaattgaagctcgattgtgacttggataatttgtaatcagcatccataatcacaaacaaaagatcaatttataaattttgaagttctatctctctctctgtctgtctgttgttgatggaattgcttgttg

SEQ ID NO: 2430 - DNA, 519 bp, Lactuca sativa
cttctatttgcatttcttcgtatcaacgaagtttcagatttcggagtaatttgaagaagtttgaagatgtcaggacgtggaaagggaggaaaagggttgggtaagggaggtgcaaagcgtcatcgtaaggttctgcgagacaacatccagggaatcacaaaaccggcgatccgtcgtcttgcgagaagaggaggtgtgaaacgtatcagcgggttgatctacgaggaaactcgcggagttttgaagatctttctagaaaatgtcatcagagatgctgttacctacacagagcacgcacgccggaaaactgtcaccgccatggatgtggtgtacgctctcaagagacaaggtcgaactctttatggattcggtggttagggtttacaatgtccgaaaagagtctgtgggtattggtgttaggttagtgaattctactgcttgtccaaatcaaatgttgttagtacttagtgtaagcctcggatcattttaccaaaatagaagtactcgactgatttctta

SEQ ID NO: 2431 - DNA, 491 bp, Lactuca sativa
  misc_feature (482)..(482): n is a, c, g, or t
cggggaagcgaaatcaactcaattctagagagagaaagcgagagaaaaaatgtcaggaagaggaaaaggaggcaagggattgggaaagggaggagccaaacgacatcgtaaggttctccgggacaacatccaaggtatcaccaagccggcgatccgccgtctagccagacgaggaggtgtcaagcgtatcagtgggttaatctacgaggagacacgtggagttttgaagatctttctcgagaacgtcatccgtgacgccgtcacatataccgagcatgctcgccggaaaactgttactgccatggatgtcgtttatgctttgaagcgccaaggtcgtactctctacgggtttggtggttgatagaaatttgctatctttttgtttctgggtgtaggatttttttttagttagattatgtaatctgaattgatatgatgtgtaattgatgtcgcctaatacaaattcagttactttttaaaanaaaaaaaag

SEQ ID NO: 2432 - DNA, 579 bp, Lactuca sativa
gtctgttcttcgtttccctcctctacagaagcttttattaagactttcaatcaatttgaaaatgtcaggacgtggaaagggaggaaagggattgggaaagggaggagcgaaacgtcataggaaggttctccgtgacaacattcaggggatcacgaagccggcgatccgtcgtctggcgaggagaggcggtgtgaagcgtatcagtggtttgatatacgaagagactcgtggagtattgaagatctttttggagaatgtgatcagagacgccgttacatacacagaacatgctcgccggaaaactgttacagccatggatgtcgtgtatgcgttgaagaggcaaggccgtactctttacggatttggtggttaaggtttgtctgtttagaaaaagtcttgctatcaagaaagaaaagggttaaggttagggttagagttcttcctatttgggtcgggttgggatccacattgttgtttaaatttactcgatttaatgtaattagttggctatgcaatgaatgagttgatgcttattttaaccttactgttctaattgatttgacagttacttgtctaaaa

SEQ ID NO: 2433 - DNA, 497 bp, Lactuca sativa
  misc_feature (56)..(56): n is a, c, g, or t
acacaaacacaaacaaaaatcagattcatttccaacgaaagaaaagtagagagaanacatgtcaggaagaggaaaaggaggcaaaggattgggaaaaggaggagccaaacgtcatcgtaaggttctccgggacaacatccaaggtatcaccaagccggcgattcgccgtctggccagacgaggaggtgtcaagcgtatcagtgggttaatctacgaggagacccgtggagttttgaagatctttcttgagaacgtcatccgtgacgccgtcacatacaccgaacatgctcgccggaaaactgtcaccgccatggatgttgtttatgctttgaagcgccaaggccgtactctgtacggatttggtggttaagtgaattttgcggtttctactttatagggttcttgtttggcaccgaggttttcattgctttgttatctgtagtcggaagtggtattacctgtaattgaagctattaatacactatcacttatccggt

SEQ ID NO: 2434 - DNA, 491 bp, Lactuca sativa
cgcggggatcattctaaccaatctcttctcttttatcctctctccttgtgaaaatgtctggtcgtggaaagggtggaaaaggacttggaaagggcggagcaaaacgtcaccggaaagtactccgtgataacattcagggaatcacaaagccggcgattcggaggttggctagaagaggcggagtcaagagaatcagcggattgatttatgaagagactcgaggtgttctcaagatctttttggagaatgtgattcgtgatgcggtgacttacacggagcatgctcgccgcaaaacggtgactgccatggatgttgtatacgctctcaagagacaaggccgaactctttatggatttgggggctaagtttgtttctcctttccaattgatatatgtaattgaatcgatggatttaaatgtttacttggtgaatgaggtattgaatcttaatgaaatgctaatattcttcacaagaccgtttgttttcgaaaa

SEQ ID NO: 2435 - DNA, 495 bp, Lactuca sativa
ctccgatttcacaacaaagaaaatcaaatccatttccgaagagaaaaatatgtcaggaagaggaaaaggaggtaagggattaggaaagggaggagccaagcgtcatcggaaggttctccgggacaacattcaaggtatcaccaagccggcgatccgccgtctggccaggcgaggtggtgttaagcgtatcagtgggttaatctacgaggaaacacgtggggttttgaagatctttcttgagaacgtcatccgtgacgccgtcacgtacaccgaacatgctcgccggaaaactgttactgccatggacgtcgtttacgctttgaagcgccagggccgcactctctacggatttggtgggtagatgaaccatatgctttttagggttcttgtttgacagcgaggttttcattggatttttgtttagttagcttctctaaatctgaagtgatgttacgtgtaattgaatctattaatacaatatcgcttaatttgttt

SEQ ID NO: 2436 - DNA, 887 bp, Lactuca sativa
cttcattccaagccctaatttcacctttgaattcgatcttagcatctttcagaaatgtcgggccgtggtaagggaggcaaaggattgggaaagggaggagccaagagacaccggaaagttcttcgtgataacattcaaggcatcacaaagcccgccattagaaggttagctcggagaggaggtgtcaaacgtatcagtggtttgatatatgaagaaactcgtggagttctcaagatatttctagagaatgtcatcagagacgccgttacttacaccgagcatgctcgccggaaaactgttaccgccatggatgtggtttatgcattgaaacgacaggggcgtactctctatggattcggaggttaaatttttaggcaattgttagaagttaaatcaaggaattgtagaacttgttcgttgtttatttcccgttttagggttgttcaagctattgaaaatctctgatttttataatcataacgagtctaaatgaacaagatagaagaaagccatttaattgaaaactgtctttattacattattcatgatcatggtttgatcttacaaaacacaatcaaaatccgccattattgcaatctgtcgaggtactgttggtgatattggccgaatgcggtggagttgtggtggtcggaacatcatcattatcatcggaagtatcacaatacccacgcaagatatcaccttcttcattggtaaacccaagtgatccaagcgaagaaggccagcatttcttttcaatcttctcaatcgccttgcaacaacccattccaagataagtctctccatttagaagaacagtatgatttccccactgcatgattgaagctcgaaacatgactccccacacccagttggatcaatatcat

SEQ ID NO: 2437 - DNA, 902 bp, Lactuca sativa
cttggcggggatcgtcttcattccaaaccctaatttcacctttgaattcgatcttagcatctttctgaaatgtcgggccgtggtaagggaggcaaaggattgggaaagggaggagccaagagacaccggaaagttcttcgtgataacattcaaggcatcacaaagcccgccattagaaggttagctcggagaggaggtgtcaaacgtatcagtggtttgatatatgaagaaactcgtggagttctcaagatatttctagagaatgtcatcagagacgccgttacttacaccgagcatgctcgccggaaaactgttaccgccatggatgtggtttatgcattgaaacgacaggggcgtactctctatggattcggaggttaaatttttaggcaattgttagaagttaaatcaaggaattgtagatcttgttcgttgtttatttcccgttttagggttgttcaagctattgaaaatctctgatttttataatcataacgagtctaaatgaacaagatagaagaaagccatttaattgaaaactgtctttattacattattcatgatcatggtttgatcttacaaaacacaatcaaaatccgccattattgcaatctgtcgaggtactgttggtgatattggccgaatgcggtggagttgtggtggtcggaacatcatcattatcatcggaagtatcacaatacccacgcaagatatcaccttcttcattggtaaacccaagtgatccaagcgaagaaggccagcatttcttttcaatcttctcaatcgccttgcaacaacccattccaagataagtctctccatttagaagaacagtatgatttccccactgcatgattgaagctcgaaacatgactccccacacccagttggatcaatatcat

SEQ ID NO: 2438 - DNA, 474 bp, Lactuca sativa
  misc_feature (300)..(300): n is a, c, g, or t
  misc_feature (379)..(380): n is a, c, g, or t
  misc_feature (394)..(394): n is a, c, g, or t
  misc_feature (399)..(400): n is a, c, g, or t
  misc_feature (412)..(412): n is a, c, g, or t
  misc_feature (418)..(418): n is a, c, g, or t
  misc_feature (439)..(439): n is a, c, g, or t
atgtcaggccgtggaaagggcggaaaagggctaggaaagggaggagcaaagcgtcatcggaaagttctcagggataacatccagggaatcacaaagccggcgatcaggagactggcgaggagaggaggagtgaagaggatcagtggtttgatctacgaagagacgcgaggtgttctcaagatctttttggagaatgtcattcgtgatgctgttacctacactgaacacgctcgtaggaagactgtgacagccatggatgttgtgtatgctttgaagaggcaaggaagaactttgtatggnttcggaggttaatagatgtatgaggtggatagtgaatattatgcttcagttattgtaatgaatcatgtagaacttgganngaattggttctganatttnnaagtttgtaatntggatntgtaactgaatgaaattcttncctgtttcgagaaccaagtgaattgtttacatgaa

SEQ ID NO: 2439 - DNA, 488 bp, Lactuca sativa
gacatacattcaactaaattcgtagagataacaaaagcagaaaaagaaaaaatgtctggaagaggaaaaggaggcaagggattgggaaagggtggagcgaagcgtcaccggaaggttctccgtgacaacatccaggggatcacaaagccggcgatccgccgtctggcgaggcgtggcggcgtgaagcgtattagcggtcttatctatgaagagacccgaggcgtgttgaagatcttcctagagaacgttattcgtgacgccgttacttacaccgagcacgctcgtcgaaaaactgttactgctatggatgttgtctatgcgttgaagcgtcagggacgaactctgtatggtttcggtggttaaggttaattacgatttgtagattagtttgtgtcctgtttcatttacgtttccgatttggttagtttatttgtagagatgtttgttatatcggtgcaactgaagctagatttcgatttaagatgaat

SEQ ID NO: 2440 - DNA, 480 bp, Lactuca sativa
  misc_feature (41)..(41): n is a, c, g, or t
aaacaccaagccctaaattgaaatcagatattctctgcttngaaaatgtcaggccgtggaaagggaggcaaaggtttgggaaagggaggagcaaagcgtcatcgcaaggttcttcgcgataacatccagggaatcaccaagcctgctatcagaaggctcgctcgtaggggaggtgtgaagcgtatcagtggtttgatctatgaggaaactcgtggtgttctcaagatctttctagagaatgtcatcagagacgctgtgacatacaccgagcacgctcgccggaaaactgttaccgccatggatgtggtttatgctttgaagagacaaggccgtaccctttacgggttcggtggttagatttagtgttagatttagctattttcgtagatttttattatgtaagatggatcgtttgtgttgaatttcaattaaagccgatctactccatctcggagtttatggtattttattgctatgaaa

SEQ ID NO: 2441 - DNA, 488 bp, Lactuca sativa
  misc_feature (486)..(486): n is a, c, g, or t
caaaatcaaattcatttctaacgagagaaaagtagagagaaaacatgtcaggaagaggaaaaggaggcaagggattgggaaagggaggagccaaacgacatcgtaaggttctccgggacaacatccaaggtatcaccaagccggcgatccgtcgtctggccagacgaggaggagttaagcgtatcagtgggctaatctacgaggaaacccgtggagttttgaagatctttcttgagaacgtcatccgtgacgccgtcacatacaccgagcatgctcgccggaaaactgttaccgccatggatgtcgtttatgctttgaagcgccaaggccgtactctttacggatttggtggttaagagaattttacggtttctgctttctagggttcttgtttgtcaccgaggttttcattgctttgttggcttatctgtaatctgaagtggtattacctgtaattgaagctattaatacaatatcacttatccnat

SEQ ID NO: 2442 - DNA, 488 bp, Lactuca sativa
ggcggggaacaccagaaataaatccaattcctgagtatccattccatacgaagagatgtcaggaagaggaaagggaggcaagggactcggaaagggaggagcaaagcgccaccggaaagttctccgtgataacatccagggaatcactaagccggcgatccgtcgtttggccaggcgtggtggtgttaagcgtatcagcggtctcatctacgaggagacacgaggcgtcctcaagatctttctcgaaaacgttattcgtgatgcagtaacctacaccgagcatgctcgccggaaaactgtgactgctatggacgtggtttatgcattgaagcgacaaggtcgtactttgtatggttttggagggtaggaaatatttagggcttctcgaattaggtgttgtttcacagatctgtttgtgggcttgttaaaatttgttcatatatctgtgtaattgaaattcacaatcaatggcagtttgattttgttat

SEQ ID NO: 2443 - DNA, 521 bp, Lactuca sativa
ggcggggaacaccagaaatcaatccaattcctgagtatccattccatacgaagagatgtcaggaagaggaaagggaggcaagggactcggaaagggaggagcaaagcgccaccggaaagttctccgtgataacatccagggaatcactaagccggcgatccgtcgtttggccaggcgtggtggtgttaagcgtatcagcggtctcatctacgaggagacacgaggcgtcctcaagatctttctcgaaaacgttattcgtgatgcagtaacctacaccgagcatgctcgccggaaaactgtgactgctatggacgtggtttatgcattgaagcgacaaggtcgtactttgtatggttttggagggtaggaaatatttagggcttctcgaattaggtgttgtttcacagatctgtttgtgggcttgttaaaatttgttcatatatctgtgtaattgaaattcacaatcaatggcagtttgattttgttatgaaaaaaccaagtcaataaaaaaaaaattttgc

SEQ ID NO: 2444 - DNA, 514 bp, Lactuca sativa
tttcttcagatttgcaaagtttcagatttcggagcaatttgaaaaagtttgaagatgtcagggcgtggaaagggaggaaagggattgggaaagggaggtgcgaagcgtcatcgtaaggttctgcgagacaacatccagggaatcacaaaaccggcgatccgacgtcttgcgagaagaggaggtgtgaaacgtatcagcggtttgatctacgaggaaactcgtggagtattgaagatctttttagaaaatgtcatcagagatgcagttacatacactgagcacgcacgcagaaagactgttactgccatggatgtggtgtacgcgctcaagagacaaggccgaactctctacggattcggtggttagggttttacaaatgttggtgttatgttagggatttctactactcgttgaaatcaactgttgttagtttttgttatgctctttcttaaatcaaagcagaagtaatagactgattttgtatttcgacttcgccaaaatcaaaatcaaattg

SEQ ID NO: 2445 - DNA, 534 bp, Lactuca sativa
catttcttcagatttgcaaagtttcagatttcggagcaatttgaaaaagtttgaagatgtcagggcgtggaaagggaggaaagggattgggaaagggaggtgcgaagcgtcatcgtaaggttctgcgagacaacatccagggaatcacaaaaccggcgatccgacgtcttgcgagaagaggaggtgtgaaacgtatcagcggtttgatctacgaggaaactcgtggagtattgaagatctttttagaaaatgtcatcagagatgcagttacatacactgagcacgcacgcagaaagactgttactgccatggatgtggtgtacgcgctcaagagacaaggccgaactctctacggattcggtggttagggttttacaaatgttggtgttatgttagggatttctactactcgttgaaatcaactgttgttagtttttgttatgctctttcttaaatcaaagcagaagtaatagactgattttgtatttcgacttcgccaaaatcaaaatcaaattgctcactttataattgtgg

SEQ ID NO: 2446 - DNA, 420 bp, Lactuca sativa
gaaatgtctggaagaggaaaaggaggcaaaggattgggaaagggaggagcaaaacgtcaccggaaagttctccgtgacaacatccagggaatcacaaaaccggcgattcgccgtcttgcgaggcgtggtggtgttaagcgtataagcggtcttatctacgaggagacacgtggtgtgttgaagatcttccttgaaaacgttattcgtgacgctgttacttacaccgagcatgctcgccggaaaactgttactgcgatggatgttgtctatgcattgaagcgtcagggtcgtacactgtacggatttggtggttaagttagggtttgtattgctaggttctgttgagatttccgatttgcttcgttttgttgtggaaatgtatgatatatcagtttaaactgaagctcgattgtgacttcc

SEQ ID NO: 2447 - DNA, 417 bp, Lactuca sativa
aaatgtctggaagaggaaaaggaggcaaaggattgggaaagggaggagcaaaacgtcaccggaaagttctccgtgacaacatccagggaatcacaaaaccggcgattcgccgtcttgcgaggcgtggtggtgttaagcgtataagcggtcttatctacgaggagacacgtggtgtgttgaagatcttccttgaaaacgttattcgtgacgctgttacttacaccgagcatgctcgccggaaaactgttactgcgatggatgttgtctatgcattgaagcgtcagggtcgtacactgtacggatttggtggttaagttagggtttgtattgctaggttctgttgagatttccgatttgcttcgttttgttgtggaaatgtatgatatatcagtttaaactgaagctcgattgtgactt

SEQ ID NO: 2448 - DNA, 695 bp, Lactuca sativa
gaaaattggaaatcatattactaataaactaataaagtacagctaattagtgcatctgagatgcaacattcatttcttaaacataaattaattcaagaaaatacccccaaaaaaaaacatatttttattgcttcttgatcaataagggctttctccgatcacattcctcactcaatcacaactcaaattcagcatctctccttgagcttgttccaacaatgtcaggacgtggaaagggaggcaagggactcggaaagggaggagcaaagagacacaggaaggttcttcgtgataacatccagggaatcaccaagcccgccatccgaagattggctcgtcgaggaggtgtcaagcgtatcagtggcttgatctatgaagagactcgtggtgttctcaagatctttcttgagaatgtcatcagagatgccgtaacctacactgaacacgctcgccgcaagactgttactgcaatggatgtcgtctatgctttgaaacgacagggccgtaccctatatgggtttggtggttaggtctagggttttggttgtgtgttagtgtgtattcactgtagatcgtatctaatttcccctttcgttgtatcctgtttcaatatcgttgtcaaaccccatctcggggtttgaatttatgttatgaaaatcctcctattttatacaatcgtctgagtttcatcgtct

SEQ ID NO: 2449 - DNA, 559 bp, Lactuca sativa
cggggacacttccatttgcatttcttcgaatcacaaagtttcagatttcggagtaatttgaagatgtcaggacgtggaaagggaggaaagggtttgggaaagggaggtgcgaagcgtcatcgtaaggttctgcgagacaacatccagggaatcacaaaaccggcgatacgacgtctggcgagaagaggaggtgtgaaacgtatcagcggtttgatctacgaggaaactcgcggagttcttaagatctttctagaaaatgtcatcagagatgctgttacctacacagagcacgcacgccggaaaactgtcactgccatggatgtagtgtacgcgctcaagagacaaggccgaactctgtatggattcggtggttagggttttcaaggtctgaaaagagtctgtgggtattggtcttaggttagggatttctactgcttgttcaaatcaaatcaaatgttgttagtacttagtgtaagcctcgaatcattgtaccaaaatagaaatactcgactgatttcttatctcgatgtttccaaaatcaaaatgcttttgggcaaaa

SEQ ID NO: 2450 - DNA, 569 bp, Lactuca sativa
caccacaatcccccatctcattcattcacaaaacaccaaaccctaatttgaattcagatcttctcttcttcaaaaatgtcaggccgtggaaagggaggcaaaggattgggaaagggaggagcaaagcgtcatcgcaaggttcttcgcgataacattcagggaatcaccaagcctgctatcagaaggctcgctcgtaggggaggtgtgaagcgtatcagtggtttgatctatgaagaaactcgtggtgttctcaagatctttctagagaatgtcatcagagacgctgtgacatacaccgagcacgctcgccggaaaactgttaccgccatggatgtggtttatgctttgaagagacaaggccgtaccctttacgggttcggtggctagatttagtgttaggttagctattttcgtagattattatttgtaagatgtatcgtttgtgttcaatttcaattaaagccgatgtactccatctcggagtttatggtgttttcttgctatgaaatctctgtgttcatcaatatcctttgtttttatctctgaaatgcatttgatttgtcaaaaaa

SEQ ID NO: 2451 - DNA, 480 bp, Lactuca sativa
gaaaacataaacacaaacaaaatgtctggaagaggaaaaggaggcaaaggattgggaaagggaggagcaaaacgtcaccggaaagttctccgtgacaacatccagggtatcacaaagccggcgattcgccgtcttgcgaggcgtggcggtgttaagcgtataagcggtcttatctacgaggagacacgtggtgtgttgaagatcttcctcgagaacgttattcgtgacgctgttacttacaccgagcacgctcgccggaaaactgttactgcgatggacgttgtctatgcattgaagcgtcagggtcgtacactgtacggattcggtggttaagttaacttaggatatttattgttaggttctttagattttcgatttgcttcgttttttattgaaatgtatggtatatcagctgaatcgaaggtcgattgtgacttgtatactttctatccaaagatctactgttaatttttgaaaaac

SEQ ID NO: 2452 - DNA, 493 bp, Lactuca sativa
cagaaatcaaaccaattccagagtatccattccgtacaaagagatgtcaggaagaggaaagggaggcaagggacttggaaagggaggagccaagcgccaccggaaagttctccgtgacaacatccagggaatcacgaagccggcgatccgtcgtttggccaggcgaggtggtgttaagcgtatcagcggtctcatatacgaggagacgcgaggtgtcctcaagatctttctcgagaacgttattcgtgatgcagtaacctacaccgagcatgctcgccggaaaactgtgactgctatggacgtggtttatgccttgaagcgacaaggtcgtactctttatggttttggaggttaggtaagatttagggcttctggaattaggtgtaatttgaggttttgtttcacagatctgtttgttggtttgttaaaattgttcatatatctgtgtaattgagattcccaatcaatgttagtttgatcttgttagcagctc

SEQ ID NO: 2453 - DNA, 522 bp, Lactuca sativa
cggcggggagcgaaaatcaaattcatttctaacgagagaaaagtagagagaaaacatgtcaggaagaggaaaaggaggcaagggattgggaaagggtggagccaaacgtcatcgtaaggttctccgggacaacatccaaggtatcaccaagccggcgatccgccgtctagccagacgaggaggtgtcaagcgtatcagtgggttaatatacgaggagacccgtggtgttttgaagatctttcttgagaacgtcatccgtgacgccgtcacatacaccgaacacgctcgccggaaaactgtcaccgccatggatgttgtttacgctttgaagcgccaaggccgtactctctacggatttggtggttaagagaattttacggtttctactttctagggttcttgttgctttgttggcttatctgtaatccgaagtggtattacttgtaattgaagctattaatacaatatcacttatccaatattctccaaaaggaagcacaacccgagctttcaatgatgttg

SEQ ID NO: 2454 - DNA, 512 bp, Lactuca sativa
gcggggaactctcacttcaaatcgtttcagagtgaaaaagtaaaaaccagagaaaaaaatgtcaggaagaggaaagggaggaaagggattgggaaagggcggagcaaagcgtcaccggaaagttctccgagacaacatccaaggtatcacgaagccggcgattcgccgattggcgaggagaggtggagttaagcgtatcagtgggcttatctatgaagaaacacgtggtgtgcttaagatctttctagagaatgtcatccgtgacgctgtgacttacaccgagcacgctcgccggaaaactgtcaccgccatggatgtggtttatgctttgaaacggcagggacgtactctttatggatttggaggttaaggtcgtagtgatatgtgttttcattgctatttcagtttccagatctacattgtttgttaacgtggtaatagtgataggctatgtatcattgacttatttctcgtaatgcaatgatcggtttattagaaacccccccttaatt

SEQ ID NO: 2455 - DNA, 504 bp, Lactuca sativa
cggggaaacaaaaatcaagttcatttctaacgaaagaaaagtagagagaaaacatgtcaggaagaggaaaaggaggcaagggattgggaaagggtggagccaaacgtcatcgtaaggttctccgggacaacatccaaggcatcaccaagccggcgattcgccgtctggccagacgaggaggtgtcaagcgtatcagtgggttaatctacgaggagacccgtggagttttgaagatctttcttgagaacgtcatccgtgacgccgtcacatacaccgaacatgctcgccggaaaacagtcaccgccatggatgttgtttatgctttgaagcgccaaggccgtactctctacggatttggcggttaagagaattttacgtttctactttccagggttcttgtttggcatcgaggttttcattgatttgttatctgtaatcggatgtggtattacctgtaattgaagctattaatacaatatcatttatccaatattccaaaaaaat

SEQ ID NO: 2456 - DNA, 510 bp, Lactuca sativa
aaatcaattcatttctaacgagagaaaagtagagagaaaacatgtcaggaagaggaaaaggaggcaagggattgggaaagggtggagccaaacgtcatcgtaaggttctccgggacaacattcagggtatcaccaagccggcgatccgccgtctggccagacgaggaggtgtcaagcgtatcagtgggttaatctacgaggagacccgtggagttttgaagatttttcttgaaaatgtcatccgtgacgctgtcacatacacagaacatgctcgccggaaaactgttaccgctatggatgtcgtttatgctttgaagcgccaaggccgtactctttacggatttggtggttaatagaattttgcggtttctctcgtttggcaccgaggttttctttgttttgttatctgtaatcggaagtggtattacctgtaattgaagctattaatacaatatcacttatccaattcatcttttctgtatgattatatgcttatgcaatacatgatat

SEQ ID NO: 2457 - DNA, 529 bp, Lactuca sativa
gcggggaaacaaaatcaaattcatttctaacgagagaaaagtagagagaaaacatgtcaggaagaggaaaaggaggcaagggattgggaaagggtggagccaaacgtcatcgtaaggttctccgggacaacattcagggtatcaccaagccggcgatccgccgtctggccagacgaggaggtgtcaagcgtatcagtgggttaatctacgaggagacccgtggagttttgaagatttttcttgaaaatgtcatccgtgacgctgtcacatacacagaacatgctcgccggaaaactgttaccgctatggatgtcgtttatgctttgaagcgccaaggccgtactctttacggatttggtggttaatagaattttgcggtttctctcgtttggcaccgaggttttctttgttttgttatctgtaatcggaagtggtattacctgtaattgaagctattaatacaatatcacttatccaattcatcttttctgtatgattatatgcttatgcaatacatgatatttgtctt

SEQ ID NO: 2458 - DNA, 545 bp, Lactuca sativa
atcacgcagagtagccattacggccggggataagcttcatctacatttctttagatttgcaaagtgtcagatttcggagcaatttgaagatgtctggacgtgggaagggaggaaagggattgggaaagggaggtgcgaagcgtcatcgtaaggttctccgagacaacatccagggaatcacaaaaccggcgatcagacgtcttgcgagaagaggaggtgtgaaacgtatcagcgggttgatctacgaggaaactcgcggagttttgaagatctttctagagaatgtcatcagagatgctgttacctacaccgagcacgcacgccggaaaactgtcaccgccatggatgtggtgtacgcgctcaagagacaaggccgaactctctacggattcggtggttagggttttactagtgttggtgtttctttagtgatttctactacttgttgaaatcaactgttgtaagttttatgctatttcttaaaccaaaccagaagtaatagacggatttcctatttcggtttcgccaaaaacaaaatcaaattg

SEQ ID NO: 2459 - DNA, 571 bp, Lactuca sativa
gcggggattaaatctcttcgcaggatctacaaaccctcacctccgatttcacaacaaagaaaatcaaatccatttccgaagagaaaaatatgtcaggaagaggaaaaggaggtaagggattaggaaagggaggagccaagcgtcatcggaaggttctccgggacaacattcaaggtatcaccaagccggcgatccgccgtctggccaggcgaggtggtgttaagcgtatcagtgggttaatctacgaggaaacacgtggggttttgaagatctttcttgagaacgtcatccgtgacgccgtcacgtacaccgaacatgctcgccggaaaactgttactgccatggacgtcgtttacgctttgaagcgccagggccgcactctctacggatttggtgggtagatgaaccgtatgctttttagggttcttgtttgacagcgaggttttcattggatttttgtttagttagcttctctaaatctgaagtgatgttacgtgtaattgaatctattaatacaatatcgcttaatttctcaattcgagctatattaagcttcagcatgtataaaatc

SEQ ID NO: 2460 - DNA, 418 bp, Lactuca sativa
aaaaaaaatgtcaggaagaggaaagggaggcaagggattgggaaagggaggagccaagcgacatcgtaaggttctccgggacaacatccaaggcatcaccaagccggcgatccgccgtctggccagacggggaggtgttaagcgtatcagtgggttaatctacgaggaaacccgtggagttttgaagatctttcttgaaaacgtcatccgcgacgccgtcacgtacaccgaacatgctcgccggaaaactgttactgccatggatgtggtatatgctttgaagcgccaaggccgtactctatacggatttggtggttaatagaatttagggtttgtagggttcttgtttgacacaggattttaatctgaaatgattctacttgtaattgaagttcttaatacaatatcagatagttgt

SEQ ID NO: 2461 - DNA, 576 bp, Lactuca sativa
ctataaaaccgcccaccacaatccaccatctcattcattaacaaacaccaaaccctaatttgaaatcagatcttctctgcttcaaaaatgtcaggccgtggaaagggaggcaaaggactgggaaagggaggagcaaagcgtcatcgcaaggttcttcgcgataacattcagggaatcaccaagcctgctatcagaaggctcgctcgtaggggaggtgtgaagcgtatcagtggtttgatctatgaagaaactcgtggtgttctcaagatctttctagagaatgtcatcagagatgccgtgacatacaccgagcacgctcgccggaaaactgttaccgccatggatgtggtttatgctttgaagagacaaggccgtaccctttacgggttcggtggctagatttagtattagattagctattttcgtagattattattatgtaagatgtatcgtttgtgttgaattttcaattaaagccgatgtactccatctcggagtttatggtgttttcttgctatgaaatctctgtgttcatccatatcctgtatttttaactctgaaatgcatttgatttgt

SEQ ID NO: 2462 - DNA, 539 bp, Lactuca sativa
atattcgtctctttatagaaatccgaagctttttttttcagtttgcgtagtgatcattccaacaatgtcaggacgtggaaagggtggaaagggccttggcaagggaggagcaaagcgtcatcggaaagttctccgtgataacatccagggaataaccaagccggcgatcaggaggttagcgaggagaggaggtgtaaagagaatcagtggtctgatctatgaagaaaccagaggtgtacttaaaatctttttggaaaatgttattcgtgatgcagttacatacactgagcatgctcgaaggaagactgtaactgcaatggatgttgtctacgctctgaagaggcaaggaaggactctttacggatttggaggctgagatccataaatggttcttcgtaccattactgttctgttttcttttagttttggtagtgggcctatctaccaaatttccattttttagatctggtagcttgatgtaaatggattgcttcaatccttaagaaggacaatattaatttaatctactgattttgttt

SEQ ID NO: 2463 - DNA, 485 bp, Lactuca sativa
ttcagatttgcaaaatttcagatttcggagcaatttgaagaagtttgaagatgtcaggacgtggaaagggaggaaagggattgggaaagggaggtgcgaagcgtcatcgtaaggttctgcgagataacatccagggaatcacaaaaccggcgatccgccgtcttgcgagaagaggaggtgtgaaacgtatcagcgggttgatctacgaggaaactcgcggagttttgaagatctttctagaaaatgtcatcagagatgctgttacctacaccgagcacgcacgccggaaaactgtcaccgccatggatgtggtgtacgcgctcaagagacaaggccgaactctctacggattcggtggttaggattttactagtgttgttatgttagggatttctactactcgttgaaatcaactgttagttttgttatgctctatcttaaaccaaaccagaagtaatagactgttttcgtattttgacttcgcc

SEQ ID NO: 2464 - DNA, 563 bp, Lactuca sativa
tcgattcacttaattcacagaaatacagaaaacaaatagagaaaaatgtctggaagaggaaaaggaggcaagggattgggaaagggaggagcaaagcgtcaccggaaggttctccgtgacaacatccaggggatcacaaagcctgcgatccgccgtctggcgaggcgtggtggcgtgaagcgtattagcggtcttatttatgaagagacacgaggtgtgttgaagatcttcctcgagaacgttattcgtgacgctgttacttacaccgagcatgctcgtcggaaaactgttactgccatggatgttgtctatgccttgaagcgtcagggacgaaccctgtacggtttcggtggttagggttagttaaggtttttagattagtttctgtcctgtttcatttacgtttccgatttggttagtttttgtgtagagatgcttgttatatcggtataactgaagctagattccgatttaagatgaattttaaactcactttcatgttagattttacttcggttgtgttattattctgaaaattgaaactatttatggtttatttttag

SEQ ID NO: 2465 - DNA, 575 bp, Lactuca sativa
gcttggcggggatcgattcacttaattcacagaaatacagaaaacaaatagagaaaaatgtctggaagaggaaaaggaggcaagggattgggaaagggaggagcaaagcgtcaccggaaggttctccgtgacaacatccaggggatcacaaagcctgcgatccgccgtctggcgaggcgtggtggcgtgaagcgtattagcggtcttatttatgaagagacacgaggtgtgttgaagatcttcctcgagaacgttattcgtgacgctgttacttacaccgagcatgctcgtcggaaaactgttactgccatggatgttgtctatgccttgaagcgtcagggacgaaccctgtacggtttcggtggttagggttagttaaggtttttagattagtttctgtcctgtttcatttacgtttccgatttggttagtttttgtgtagagatgcttgttatatcggtataactgaagctagattccgatttaagatgaattttaaactcactttcatgttagattttacttcggttgtgttattattctgaaaattgaaactatttatggtttatttttag

SEQ ID NO: 2466 - DNA, 505 bp, Leymus cinereus x Leymus triticoides
atccacaccactcccctcttctctcccaaatccagcgacgatgtccgggcgcggcaagggcggcaaggggctgggaaagggcggcgcgaagcgccaccggaaggtcctccgcgacaacatccagggcatcaccaagccggcgatccgcaggctggcgaggaggggcggcgtgaagcgcatctccggcctcatctacgaggagacccgcggcgtcctcaagatcttcctcgagaacgtcatccgcgatgctgtcacctacaccgagcacgcccgccgcaagaccgtcaccgccatggatgttgtctacgcgctcaagcgccagggccgcaccctctacggcttcggaggctagatttgtagtggggcaacttcctcgtttcctctgtgtgatgtgtgctgtgctagatgggattcactgctttggagtgcgtcgttgtgttctgtcttgggttcagtaggctgtgtaatacctgttcaatgcaagcagttcgattctgaatcctga

SEQ ID NO: 2467 - DNA, 566 bp, Glycyrrhiza uralensis
gatcaaccatcaaaaccagaaaacaaaaatccaagttcagatttccatttcgaaaaatcaaaaatcaaatctcgagttcaaaaatgtcgggtcgaggaaaaggaggaaagggattgggaaagggaggagcgaagaggcaccgtaaggttcttcgcgataacatccagggaatcaccaagcctgcgattcgtagacttgcgaggagaggtggagttaagagaatcagtggcctcatctatgaggaaaccagaggtgttcttaagatctttctcgagaacgtgattcgtgacgccgttacttacacggagcacgctaggaggaagaccgttactgccatggacgtcgtttatgcactcaagaggcagggaagaaccctctacggtttcggaggctgaaattctccgttattaaattactggaactagaaatgataaatctggactacacttggggaactgggtaaatgaaaagtgaacaacgacgagatattggtaaagggatggatttgaagtgaaacgtaagaagacaggaagaacgtaaccaatgtaatggaaggagttattttc

SEQ ID NO: 2468 - DNA, 538 bp, Glycyrrhiza uralensis
gattcacctaaaacatcctgttatcatccccaattccaaagattatttgacttgaaagaagcagcacgcagcaaagagcaaccatgtccggaagaggaaagggagggaagggtcttggaaagggaggagccaagcgtcaccgtaaggttctgagggataacattcagggaatcaccaaacccgcgattcggcgtctcgcaaggcgtggtggtgtcaagcgtatcagtggtctcatctatgaggagactcgtggggttctcaagatcttcctcgagaacgttattcgcgatgctgtcacctacactgagcatgctcgccgcaagactgtcactgccatggatgttgtttacgccctcaagaggcaggggaggaccctttatggtttcggcggttagggaattagtaacaacaacagcagttcttccagtttttgtttttattttttgttgatataaagtcactgcttgtcgaatcttaacaatgtaacacttcttactttttgatttttggctcccaaatgttgcttagtttcgattcc

SEQ ID NO: 2469 - DNA, 571 bp, Glycyrrhiza uralensis
gataaagccatttgcgtgcataagaccctattcggtttgtttaatcgcagggagagaaacaccaaacattcaacaaccatgtctggaagaggaaagggagggaagggtttgggaaagggaggagcgaaacgacaccgtaaggttctgagggataacatccagggaatcaccaagcccgctattcgtcgtcttgcaaggcgtggtggtgttaagcgtatcagtggtctcatctacgaggagacccgtggtgtcctcaagatcttcctcgagaacgtgattcgtgacgctgttacctacactgagcacgctcgtcgcaagactgttactgctatggacgttgtttacgccctcaagaggcaggggaggaccctttacggtttcggcggttagagaattggggattggggatttctacattacaatgtcaattagggtttcttgtagtcttcgtttcactgttgatatattgtgcaattgctccttcagcttgagctttaacaatggtttttgcttggctacgaatcgttgttaccttgaatttgccatatgctaattaatttgttcgtttctg

SEQ ID NO: 2470 - DNA, 485 bp, Glycyrrhiza uralensis
gatctcagtcaattagcactgtaactaaaaccaaataccttatcttcttttctgttctgggtcatttttttctctactagttgagcaagatgtctgggcgtggaaaaggtggaaagggtttgggaaagggtggagcgaaacgacaccgtaaggtgttgcgcgacaacattcagggaatcactaagccagcgattcggcgtttggctcgtaggggaggggtgaagcgtatcagtggtctcatctacgaggagacacgtggcgtgctcaagatctttctggagaacgtgattcgcgacgcggttacttacactgagcacgcgaggaggaagaccgtcactgctatggatgtggtgtatgccctcaagagacagggaaggactctttacggttttgggggttagggttaggctttttcttttttttttgttgggtttgatttgttggttgtagttgttttattttgagtgaggaaaagtcttgcagtc

SEQ ID NO: 2471 - DNA, 492 bp, Liriodendron tulipifera
gagagaaaggaaagaaaatgtcaggaagagggaaaggagggaagggattgggaaagggcggagcaaagaggcacaggaaggtgctgagagacaacatccaaggaattacgaagcctgccattcgtcgattggcccgtcgtggtggggtcaagagaatcagcggtctgatctacgaggagacgagaggggtcctcaagatcttccttgagaacgtcatccgtgatgccgtcacctacactgagcacgctcgccggaagaccgtcaccgccatggatgtcgtctacgccctcaagcgccagggcaggaccctgtacggctttggtggttagggttagggctctggttcttcttctcttttagggattgtagacattctgtagcggtattttggtcttttttcctgttctttttctatttgggtttcagttggggttaggtatttgatgtaattggaaatgatgatacgtgaatggagaaaatttcattttcctg

SEQ ID NO: 2472 - DNA, 449 bp, Liriodendron tulipifera
  misc_feature (329)..(329): n is a, c, g, or t
  misc_feature (341)..(341): n is a, c, g, or t
  misc_feature (385)..(385): n is a, c, g, or t
  misc_feature (423)..(423): n is a, c, g, or t
ccagctagaatatgtcaggaagagggaaaggtggaaaggggcttggaaagggaggcgcaaagcgtcacaggaaggtgctgagagacaacattcaaggcatcacgaagccagcaatccgccgtttggctcgcagaggtggtgtgaagcgcatcagtggccttatctatgaagaaacgaggggagtgctgaagatcttccttgaaaatgtcatccgtgatgctgtaacctacactgagcatgctaggaggaagacagtcacggccatggatgttgtttatgcccttaagaggcagggtaggaccctctatggttttggtggttagagagtntttgtagatttntattacttgttgggtttgtttgtttttagattcaactccttttntaggttttttgtatgatgggtgtttgcaaagattaaangcatggtaggtgtttgttttttggct

SEQ ID NO: 2473 - DNA, 617 bp, Lotus japonicus
atccctcaaaatctcaaatcaccctctcatctcagttcatctccaatctccatcttctcaccgatttcagttcgattttctgagtgacagcatgtctgggcgtggaaaaggaggcaagggattgggaaagggaggagcgaaacgacaccgtaaggttctccgcgacaacattcagggaatcacgaagccagcgattcggcgattggctcgcaggggtggcgtgaagcgtatcagtggcttgatctatgaggagactcgtggtgttctcaagatctttctcgagaatgtgattcgtgatgctgttacctacactgagcatgctaggaggaagactgttactgccatggatgtggtgtatgctctcaagagacagggaaggaccctttacggatttgggggttagggttttggtattctagtttcatatgttactgtttgtctttgattgtatgttgaaaaaagctggcaaggattgtgtttatttggtttgatggattgttggtggtgtctttaggtaaagaaagaaattagcagcaatttgcaataggtagttgagttcttggttatctgcatgttacatctcggttgcaatgtataattacttatgttttgagttc

SEQ ID NO: 2474 - DNA, 587 bp, Lotus japonicus
atcaccgaaagcaaaaccaccatcatctgcaaaactcactgaagcacagagagtgagaaatcagctaccatgtcaggaagaggaaaaggaggcaagggtttgggtaaaggaggagcgaagcgtcaccggaaggttctgagggataacatccagggaatcaccaagcctgcgattcgccgtctcgcaaggcgtggcggtgtgaagcgtatcagcggtctcatctatgaggaaactcgcggtgttctcaagatcttcctcgagaacgtcattcgtgatgctgtgacctacactgagcacgctcgccgtaagactgtgacggcgatggatgttgtttacgctctcaagaggcagggcaggaccctctatggtttcggtggttagggatttagtgttcactggtcttctaggtcatgtaatttgatgttgaatttaaacaatgtaacacctagttactttccccaatgattaatagatgcttagttcctgttttcaattgatctatatttcatgtaaatcatggttcccgcaagtgttcactgttctgaatcaaagtttaattagcatcagtttatcaatttgctcaattc

SEQ ID NO: 2475 - DNA, 576 bp, Lotus japonicus
caaaaccaccatcatctgcaaaactcactgaagcacagagagtgagaaatcagctaccatgtcaggaagaggaaaaggaggcaagggtttgggtaaaggaggagcgaagcgtcaccggaaggttctgagggataacatccagggaatcaccaagcctgcgattcgccgtctcgcaaggcgtggcggtgtgaagcgtatcagcggtctcatctatgaagaaactcgcggtgttctcaagatcttcctcgagaacgttattcgcgatgctgtgacctacactgagcacgctcgccgtaagactgtgacggcgatggatgttgtttacgctctcaagaggcagggcaggaccctctatggtttcggtggttagggatttagtgttcactggtcttctaggtcatgtaatttgatgttgaatttaaacaatgtaacacctagttactttccccaatgattaatagatgcttagttcctgttttcaattgatctatatttcatgtaaatcatggttcccgcaagtgttcactgttctgaatcaaagtttaattagcatcagtttatcaatttgctcaattc

SEQ ID NO: 2476 - DNA, 535 bp, Lotus japonicus
caaaaccctaattttaactttctcggaaaatttcaattttctcgggaaaatgtctggtcgtggaaagggcggaaagggactcggcaagggcggcgccaagaggcacaggaaggtgctccgcgacaacatccagggcatcacgaagccggcgattcggaggctggcgaggagaggcggtgtcaagaggatcagcggtttgatctatgaggagactaggggagtgctgaagattttcttggagaacgtgattcgtgatgcggtgacttacacggagcatgctaggaggaagacggtgactgctatggatgtggtttatgctctcaagaggcagggaagaaccctctatggatttggaggttgaagactattggttttacttttttggagaagaatatgcatatgcatttctctatttgcttgttcatgggttgtgtgattttgtgaaatgtaaagctgaatgtgattgaagcataaccaattgtagggttaattggaaattagggttttctagtgaattataaatcaagtttctgtt

SEQ ID NO: 2477 - DNA, 635 bp, Lotus japonicus
aacagccaaagcatattcggtttcctcttaacgaaatcacagagagagagcatcacccaacaacaacaatgtcaggaagaggaaagggaggcaagggtttgggaaagggaggagcgaagcgtcacaggaaggttctgagggataacatccagggaatcaccaagcctgccattcgccgtctcgcaaggcgtggtggtgtgaagcgtatcagcggtctcatctatgaagaaactcgcggtgttctcaagatcttcctcgagaacgttattcgtgatgctgttacctacactgagcacgctcgccgcaagactgtgacggcgatggacgttgtttacgctctcaagaggcagggcaggaccctctatggttttggaggatagaggattggggatttatgtgttttagggtttcgtttagtttcaatttcgctgttgatattgtgtaattgctcttgagcttcaatttaacaatcaatgattattgtttggctatttcttgttgctgcgattaatttttgatttgcttttcaatttgttgaattcgaagctgcgatttccgattttaatttctcgctgtcgttaactggataattgattccaattagtgaattcgaggtttttgtgtttggatggttc

SEQ ID NO: 2478 - DNA, 1064 bp, Eragrostis curvula
  misc_feature (10)..(10): n is a, c, g, or t
  misc_feature (12)..(12): n is a, c, g, or t
  misc_feature (21)..(21): n is a, c, g, or t
  misc_feature (649)..(650): n is a, c, g, or t
  misc_feature (655)..(655): n is a, c, g, or t
  misc_feature (667)..(667): n is a, c, g, or t
  misc_feature (676)..(676): n is a, c, g, or t
  misc_feature (679)..(679): n is a, c, g, or t
  misc_feature (685)..(685): n is a, c, g, or t
  misc_feature (687)..(687): n is a, c, g, or t
  misc_feature (690)..(690): n is a, c, g, or t
  misc_feature (706)..(706): n is a, c, g, or t
  misc_feature (709)..(710): n is a, c, g, or t
  misc_feature (712)..(713): n is a, c, g, or t
  misc_feature (727)..(727): n is a, c, g, or t
  misc_feature (801)..(801): n is a, c, g, or t
gcgggggaantnattctcccnaaccactcgaaccagcagcagagtcttcttcctcctccggcgacgatgtctggtcgcggcaaaggcggcaaggggctgggcaagggcggcgccaagcgccaccgcaaggtgctccgcgacaacatccagggcatcaccaagccggcgatccggaggctggccaggaggggcggcgtgaagcgcatctccgggctcatctacgaagagacccgcggcgtgctcaagatcttcctcgagaacgtcatccgcgacgccgtcacctacaccgagcatgcccgccgcaagaccgtcaccgccatggacgtcgtctacgcgctcaagcgccagggccgcaccctctacgggttcggcggctaagcgctgtctcctccctcgttcgcttctgccggtgcggctgccgggtgctactgctgcttgttcttaggttcatgtgatgtgcttctgtgatggccgtgtagagatgtcagatccgtagttctcttctgtgttccatgtttaggtggtggatgtgatgtggtagtcacgacgagttcaattcctgattgtatctctgttgtttcttccacagtaatgaaatgttaaattcggtccaaaaaaaaaaaaaaaaaaaaaaaaaaaaaaaaattcnncgggntgaaaacccggnctaaacccnaanggaatncncgnccccctgggggccacnatnngnnaaaccccccaccgngtgtagcaaatctggaatattcaaaggggcccctaaatatgtggggcaaacagggcaaaattatttcaaaaacnagtatatactagaataaaaaacctaactaatctccccccccccccccccccccccacttttctagagttacattactacctttaacccgtcacgtaatcataaagtttcaacccacgtcattactatatatcaaatgcaaaagaaattctacaccaccccccccccccccccccccatttattatatttattagatttttaatgtgtagattttattaagagatgtatataagtaatagggagaatgaagtatatattagaaa

SEQ ID NO: 2479 - DNA, 632 bp, Eragrostis curvula
  misc_feature (632)..(632): n is a, c, g, or t
cagaaaaaacgagagaaaagacagaggagagaaaaaaagaaaaagaaagaaaaaagaaaaaggggcaaaacaatcatcaccaaatcagcctcaaaggtcccaaaatctccagccaagttcttctcgctccgagctcgcctccgagaaccatgtcgggccgcggcaagggaggcaaggggctcggcaagggcggcgccaagcgtcaccgcaaggtcctccgcgacaacatccagggcatcaccaagccggcgatccggaggctggctcgcaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatccctcccttcggcggcgcgttggtttcctgttctgtggtggtcgatggtgttaggggtagctctcctgttagggtttcgttcagtctgatgtctggagttgtgtctttgtgcaaagttatctgttctgcaatctgaaatggaattcctatcgtatcaatgaaatggatgn

SEQ ID NO: 2480 - DNA, 1222 bp, Eragrostis curvula
  misc_feature (789)..(789): n is a, c, g, or t
  misc_feature (1222)..(1222): n is a, c, g, or t
cccaacccccggcccccagcgccgcaccaatctcacctccaaatcccacaccacctccgaggaatctccaacaaggcagccatgtcgggccgcggcaagggaggcaaggggctcggcaagggcggcgcgaagcgtcaccggaaggtgctgcgcgacaacatccagggcatcaccaagccggcgatccggcgtctggcgaggaggggcggcgtgaagcgcatctctgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatgcgccctccatccacctcgcttcacccttctgcagctccgacgtcgtctggccgtgctcacaagtcttgcggtcaagaatgtctcaatctcgcttgtttaggtccgtcagttgctgtagtaggtttaacttaatcggaggcggtaaagcaagtttgtttgcatctgatgttcgaattcgagcttttgatctgtgtaactgtggttgatctatatataaataaagctctggttcctcgaaaaaaaaaaaaaaaaaaaaaaaaaaaaaatttcccggcgtgaaaaccacggcaaatcaaattcccccgcccccctggggggcgggaaaaatgcaactccgggcccaattcccccaataggggagccaattaaatttccggggcgcctttttaaaaanggcgcgcggggggacggggtgggttgagtcgggggttggtgtttgcccctgggccgcgtggcgcgagcggctgtgtgcgatctcgccggctccttagcgcccttgggaaaggttaaagagaacacaggggcgagggtttaaaaaaaaaaaatattagaaaagtttctataaaaaatgtaatcttatgaatgacgtaatagtgacattagggacgtaaggggctctgcaaccttgggaccaagccaggcttaagctttgcttttttgtgcgttctgagagtatataaagtaatacgagtctgtaattaaaatattattaatgaaaaatataaaaaggacaagaaacaaactactatatcagcggaaaacatgatgtaattattaattttccataaattatccgctaaatactagttgattgcttttccacctgn

SEQ ID NO: 2481 - DNA, 604 bp, Zea mays
ggcaccagagtcaccgcggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatgtgtcccagcagtgctgggaaatcaagatcaagatgtatctttctttgcagtaatgaaatgttaaaatcgagatcaagatgta

SEQ ID NO: 2482 - DNA, 554 bp, Zea mays
ccatccaactcacacacaggctcaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcgctcaagcgccagggccgcaccctctacggcttcggcggctaggctatgccggtcgcgctcgcgcctcgctgtcgtcgctgcggttcttgtttttgcaattcgcaaggtgtggcttgacggggaaaatgctggttaatgtagcactagatcaagcatgttgtgcgtgtctgaagaaatgccaattgtgacttgctgtttgttcaaac

SEQ ID NO: 2483 - DNA, 621 bp, Zea mays
tccatccaatccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttaggggacatgtctctgtgtgatgctttctgaggtagtattgctgcaatagctgtgtaatccatcgcttctgcaatgaagcgctttgaagcatgctacgtatgttgtgtctgtgggtgattgtatttctggtagtaacagtgattcttcctgaattttggataatacaagctcattcgcagtagtttctgatgta

SEQ ID NO: 2484 - DNA, 692 bp, Zea mays
cactcgtctcatctcttccatacgaccataccctacctccaaattcccaattctcaacctctcctccgagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggtggcgtgaagcgcatctcggggctcatctacgaggagacccgcggcgtgctcaagatcttcctcgagaacgtcattcgcgacgctgtcacctacacggagcacgcccgccgcaagaccgtcaccgccatggacgtcgtctacgcgctcaagcggcagggccgcaccctctacggatttggcggctgaggggtcaggggtgtcccccagctgctgctggtcgttgcagaagtcttgggtcgcggtcacgaaatggagtgaggcgagagtattcttgcccatgtgcttagtttcgtaggcttatcactctagactctagtgccttggtccagtagtagcatacgacttgtactgcatttccttgttctgaacctctaaatatgatgagatgtggattcacttgatctcacaaacaaccagttaattcggatcaaatttgtactgactttctcgatcatcccagtttttcatctaaaagagcatttgtc

SEQ ID NO: 2485 - DNA, 784 bp, Zea mays
attcaccaaagtccaagcaccttcccaaaaaatcccccattttcttcgaggcgaggagagcgtgaaagacagggcaccggcagcgacgatgtcggggcgcggcaagggcggcaaaggtctgggcaagggcggagcaaagcgccaccggaaggtgctccgtgacaacatccagggcatcaccaagcccgccatccggaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttacttcgtttagttccttgtctgtgacgtgttggactattgttagtagtattcttgaagttgtgtttcgaatgtaatccaatcttatcgttcgagaattgaaatgattcctgggcaacattttgcaggcaatctcgttcgagagttaggtccattatatctgttaagattttttttccatacagcattgactaagtatgaagcccattccatcctgaagatcgtgtatttcagagttgcaattcagttgtcaaagttctagcgtgtatgctaaaattttaagagggatacatcgtctccttgctgaatgaatttgtctcatgatctgaagcta

SEQ ID NO: 2486 - DNA, 806 bp, Zea mays
cacctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagtagttgtggtagctggttgctttgtcgtcctgtagtcgtgcttctttgggtctgtaagaaccgctggttcgatgggattggattggacggtgaagtaggaatgttggcatgttagacttttctccaacgtagcgttgcctctaatttgatctctcaatttattttcaattggggtgcactgtaattcttcctgtctaattcaaatcccctttctgaaattttgtgacctcccaagttttggacccctcgattgttcgaacgagtttttgaatttgtgtttcgagtcgaagtttcgattcacttcaggcgaaacaattcgttaatgc

SEQ ID NO: 2487 - DNA, 541 bp, Zea mays
aatccatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggattcggaggctaggcgcctcttcgtagctggggaatgcttagggggatacacgtctctgtcgctgtgggccatagtgttgctgcgttcctggatgtaatccatttatttttctgcaatgaagagatgctggcaagcatgctacctgcatat

SEQ ID NO: 2488 - DNA, 556 bp, Zea mays
gtctccatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagcgccagggccgcaccctctacggcttcggcggctaggcctgccgcgccgcgcctcgccgtcgctgcggttctggtgttgctgcagttcgcaagttgtttgtgtgggggaaaaatgctagatactgtagaactgcagtgcggtatgctgcacatggtgtgtttgtctgaagaaatgttgtcaatgctggcttgctctggactca

SEQ ID NO: 2489 - DNA, 743 bp, Zea mays
acggattgcactccctccctcctcgcgcccaagcgcacaccccctcccgcctggaggccgctacagcctacaagtagcactcagcccggctcccgtttaccgccgccgacttctgattctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtgggaatggatctctgttcgattgttcaattggcccatattccatctttggatcttagttttgcactaatggcgcaagccttttcgaaaaccaa

SEQ ID NO: 2490 - DNA, 750 bp, Zea mays
acactccaagcgccaccaatctcgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggctaggctgatgggctcctcgcgatgttctccccttctgcagatgcgacgttttctggccgtgcccacaagtcttgcggtcaagaaagtttcaggaactcttgttagttcatctctggctgtggtaggtttatctgaatcgtgagactagtaggtttatctgaatcgcgaggctagcaggtttacctgaatcatgaagcagtgatgaaattatgtgtgcatcggatgttggaaatcgagcttgtaatgcaatttgttactcttgatgcaaatgaatggtctggtcgttacttctgtagttacgattttaaactggtgattgttgcgtttctcatgcaactgaatcgtgtcagcaaaagttgctttgcatt

SEQ ID NO: 2491 - DNA, 618 bp, Zea mays
ctgaacaacaacaacaacccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcggcggctaggccgcctccccttctgatgctttgatatgacggccgtggtcggttgtgtgtctagttggccggtctactgtagtttgttctgtatcttcgtttcgaggtgttccagtttctagcccatttggtgtaatattttcacagctattatcaatggaaagccctcggttctatcctcattgttctggatcaagataatccgtttgatatggatacagtacccctcatgcttttactcttt

SEQ ID NO: 2492 - DNA, 753 bp, Zea mays
cgatttgacgtctccaacgcactcatcccccgaaattcctcgcctcgcgcccaaagcacgactcaaaaatttccccatctccccccgcgcactctcccaaatcctcccctttaaacccacctcaaatcctctcctacgccgcaccgaattcgagacctccaattccctcgtagcagcagcaccagtagagtctccttcctctccggcggcgatgtctgggcgcggcaagggcggcaaggggctgggcaagggcggcgccaagcggcaccgcaaggtgctccgcgacaacatccaagggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgcccgtcgaaaaaccgtcaccgccatggacgtcgtctacgccctcaagcgccagggccgcaccctctacgggttcggcggctaagcgcgccctctccatctgggggtgggcctagtactggtggcgtttctcctttgggttccctgttctgtgctttccattctgtgggaaggtaccagattcctagatctatgtttcgatctggtgtttggtggtccatgtgatgtcgtgtagtagtacaaagagttcaactcctagttgtatcttagttgtttcccttgcagaaatgaaatgataactacgattacctagca

SEQ ID NO: 2493 - DNA, 614 bp, Zea mays
ccaaaggtacacatcatctcttccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcaccgccatggacgtcgtctacgccctcaagcgccagggtcgcaccctctacggattcggcggctgagaggcgctaccgccgctggtggccgtggcaaaagtcttgggtcgcggtcaagaaatcgagagtattctggatgacgtgcttagtttcgtagtattattatcactagtgcttattgttagcggttgttgggttcgaccactctaagccactgtcaaacagtaatatatgagtaccgcatttccgtgtttcgaacttctaatatatcataatcttatggacatcgggttaattcgc

SEQ ID NO: 2494 - DNA, 575 bp, Zea mays
gtacccaatcttcccctacaccagaaaaatccccagttctttggtccgcgtcagagagtcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggagggtaggctaggcgcctcttcatagtcggggactggttaggggacatgtctctgtgtgatgctttctgaggtagtattgctgcaatagctgtgtaatccatcgcttctgcaatgaagcgtatgttgtgtctgtgggtgattgtatttctggtagtaacagtgattcttcctgaattttggataatacaagctcattcgcagt

SEQ ID NO: 2495 - DNA, 583 bp, Zea mays
accagagtcatcgcggcgtgttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctatacggattcggtggttgagcgcagctcttccctcgtttgcagcggctgctggtggcgcttcttccgtttcctctgccgtgcttggcttgatgtagagagttatcagattaaaatatctctagtgtgtttcgttattgggtggaatcatgtgtcccagcagtgctgagagctcgagatcaagctgtttctttctttgcagtaatgaaatgttaa

SEQ ID NO: 2496 - DNA, 611 bp, Zea mays
tccatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggattcggaggctaggcgcctcttcgtagctggggaatgcttagggggatacacgtctctgtcgctgtgggccatagtgttgctgcgttcctggatgtaatccattttttttttctgcaatgaagagatgctggcaagcatactacctgcatatgttgcgcctgggtgattgttctccttagaaatggtagtaacagtgaatcttgttcacgaaccaaaaaaaaa

SEQ ID NO: 2497 - DNA, 542 bp, Zea mays
aaacccaaacatcgaaccttctccaacactaatcttttctcaagataataaaaaacccaatttccttctgaaaaaatgtcgggtcgaggaaagggaggaaagggtttgggcaaaggaggagccaagcgtcacaggaaggttctgagagacaacatccaaggaatcaccaagccggcgattcggaggctggctcgtagaggtggagtcaagcgtatcagtggtttgatctacgaggagacacgtggcgtcctcaagatctttttggagaacgttattcgtgacgctgtgacatacactgagcacgctaggaggaagactgtgactgcgatggatgtggtctacgcgttgaagaggcaagggaggacgctttacgggtttggtggttaagggacttttaagattcgcgttttgcgtttctgcggttcttatggaagtttctaatcgaatcatgttttccttagcgtttgtgttttgaattccgtttgagttcggtcttttgtgtgttccgttagcgtttcgttatatgtaattacgaataaagc

SEQ ID NO: 2498 - DNA, 507 bp, Zea mays
catcgcactcttcaaaacctctctcttatttcaaaaagcaaagaaaaaaatgtctggacgaggaaagggaggaaagggactgggaaagggaggagccaagaggcacaggaaggttctccgcgacaacatccaagggatcacgaagccggcgattcgtcgtttagcgaggagaggcggtgtgaagcgtatcagcggtttgatctacgaggagactcgcggcgttctcaagatcttcctcgagaacgtgattcgtgacgctgtgacttacactgagcacgctaggaggaagactgtgacggcgatggatgttgtgtatgctttgaagaggcagggaaggactctgtacgggttcggcggctgaggggattgaattaggggtttgtaaatcgcgtttgttgtttttagggtttggttaatttggggagattaagatctctataagctgtctgaagggttttatttgaatgttttaagtggttttaaattgaatgagaaaagcttttattg

SEQ ID NO: 2499 - DNA, 627 bp, Zea mays
tcatcaatctctccgatcgatttacaggtatcgtctccttcttcttcttcctcgtgtttctgcaatcatccgactcgtttcgcagatttcatatttcgaattcgattgtcaattgattaggattttggttttggttcttcagatctttgaaaacttagcgaggagatatgtcgggaagaggaaaaggagggaaaggattgggaaagggaggagcgaagaggcacaggaaggtgcttagggataacatccaaggtatcaccaagcctgccatccgtcgtcttgctcgcagaggcggtgtcaagcgtattagcggtttgatctacgaggagacaagaggagtcctcaagatctttctcgagaatgtcatccgcgacgctgttacatacaccgagcacgctaggaggaagactgttacggctatggatgtggtttacgcgttgaagaggcaaggacgcactctctacggtttcggcggttaatcaaagattgggattaaatgttacggttatctgggaatcaatttgattagtgaaaagtaaaacaatgagttagcttttatgctatgtcttgtagccaatgtgatcttcatgtagctaaatcgattcttaaatgaaagagtgtttgatc

SEQ ID NO: 2500 - DNA, 606 bp, Zea mays
atcaccacatcacactagatcacccaacctctttccacatccatcttgcagcatccgccatggcgccgccgcccaagccagccgaatcttccaccaacaagacgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcgggtaggtcgcccctctcccggtggcgaattacgtggtggggggggggggcgggccccgtttttgtttccctgggccaaataaacgcgggggggtcccttttatcggggggcggtttttttgggggggggg

SEQ ID NO: 2501 - DNA, 473 bp, Zea mays
  misc_feature (425)..(425): n is a, c, g, or t
gagaacatctcaatctcaattgaaatcttaaaatccaaaattttcccgagaaaaattaaagtttcctgagaaaatgtcaggtcgtgggaagggaggcaaaggattgggcaaaggaggagctaaacgtcacaggaaggttctgagagacaacatccaaggaatcactaagccggcgattcggagattggctcgtagaggtggagtcaagcgtattagtggtttgatctacgaggagacacgtggcgttctcaagatctttttggagaatgttatccgtgacgccgttacttacactgagcacgctcggaggaagacggtgactgctatggatgttgtttatgctcttaagagacaaggaagaactctctacggattcggcggctagggtttttgattgttgttttttgtgtttctacgtttattangatgttaattttcagaatttggcgttaacttcgaaaaaattaaagaat

SEQ ID NO: 2502 - DNA, 755 bp, Zea mays
ctccccaccccaaatccgaactcagtcgcccacaaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggcttcggcggctaggtcgcttcctcatctggtggcgaactgcatctgtgtcggcggtggtcgtgttgtgtgcctaatctagtgtagtccgttctctatatcgtcgctgtgttctgtggtgtcttgtatcccatttcctgcaataccaacttgccattatcaatggaaaaccctcgttttcatcctcgacgtgtctagttctgattttgttttgttctcgtttattgttcgtatgagatgtacatagggctgctgttgctttggtgtttgattgcaatttttattttgcccagagagctgcagttctgtgtgttatgcaaaaaagttctgtgattgattggatctcttcgtttggaca

SEQ ID NO: 2503 - DNA, 710 bp, Zea mays
gataaatactcctccaaccccgaatcttaaccatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagcctcatgacatatcgctcttttgtaaacctgcaagaattccgtgcactacgcatctgtttcgttgtgcaagagctcagatctgcttttgagacaactaatgacattaggga

SEQ ID NO: 2504 - DNA, 542 bp, Medicago truncatula
acacattcaaaaatcaatcttctagtaatttcataatcttaagaaaaatccattttcttcattctctgcaaaaatgtcaggtcgtggaaaaggaggaaagggattgggaaagggaggagcaaagaggcacagaaaggttcttcgcgacaacatccaaggcataaccaagcctgcgattcgtcgtcttgcaaggcgtggtggtgtgaagagaatcagcggtctcatctacgaagagactcgcggtgttctcaagatctttcttgagaatgtgattcgtgatgctgttacttacactgagcatgctaggaggaaaactgttaccgccatggatgttgtgtatgctctcaagaggcagggaaggactctctacggtttcggtggttaaatttagggtttagtttgttctggtcgatttagttctaaatctggttaatataaatttagtagtcttagatctggttgaatgcttagtcctgtggttctagtatttggacttgtatcttaattcttaacgatgaatgaatgaattttgtctttgctga

SEQ ID NO: 2505 - DNA, 549 bp, Medicago truncatula
cggccggggacattcaaaaatcaatcttctagtaatttcataatcttaagaaaaatccattttcttcattctctgcaaaaatgtcaggtcgtggaaaaggaggaaagggattgggaaagggaggagcaaagaggcacagaaaggttcttcgcgacaacatccaaggcataaccaagcctgcgattcgtcgtcttgcaaggcgtggtggtgtgaagagaatcagcggtctcatctacgaagagactcgcggtgttctcaagatctttcttgagaatgtgattcgtgatgctgttacttacactgagcatgctaggaggaaaactgttaccgccatggatgttgtgtatgctctcaagaggcagggaaggactctctacggtttcggtggttaaatttagggtttagtttgttctggtcgatttagttctaaatctggttaatataaatttagtagtcttagatctggttgaatgcttagtcctgtggttctagtatttggacttgtatcttaattcttaacgatgaatgaatgaattttgtctttgctga

SEQ ID NO: 2506 - DNA, 577 bp, Medicago truncatula
actccgattcaaaaccaaaccctaatttcccaaatttctcaaatcttcttcgtttctccaattttcatctcttgaaaatgtcaggtcgtggtaagggaggtaaggggctaggaaagggaggtgcaaaaaggcacagaaaagttctccgcgacaacatccagggtatcactaagcctgccattcgtcgattggcgagaagaggtggtgtgaagaggatcagtggtttgatctatgaagaaactagaggtgtcttgaagatcttcttggagaatgtcatccgtgatgcggtcacatacactgagcacgctaggaggaagacagttaccgcgatggatgttgtctatgctttgaagaggcagggaagaaccctctatggattcggaggttgatgaagaagaagaagagaagaagaagtagcactcttttgtgtattattgtttagctaagtatttggaacatgttattgttccttataatataatgatttaatatgcttattttgatttttacttggttcggttgctttgtaagttttaacaagattgaaatctaatgaagtgactgtttatggtgaatt

SEQ ID NO: 2507 - DNA, 579 bp, Medicago truncatula
ggactccgattcaaaaccaaaccctaatttcccaaatttctcaaatcttcttcgtttctccaattttcatctcttgaaaatgtcaggtcgtggtaagggaggtaaggggctaggaaagggaggtgcaaaaaggcacagaaaagttctccgcgacaacatccagggtatcactaagcctgccattcgtcgattggcgagaagaggtggtgtgaagaggatcagtggtttgatctatgaagaaactagaggtgtcttgaagatcttcttggagaatgtcatccgtgatgcggtcacatacactgagcacgctaggaggaagacagttaccgcgatggatgttgtctatgctttgaagaggcagggaagaaccctctatggattcggaggttgatgaagaagaagaagagaagaagaagtagcactcttttgtgtattattgtttagctaagtatttggaacatgttattgttccttataatataatgatttaatatgcttattttgatttttacttggttcggttgctttgtaagttttaacaagattgaaatctaatgaagtgactgtttatggtgaatt

SEQ ID NO: 2508 - DNA, 547 bp, Medicago truncatula
cattatggccggggacacattcaaaatcaaatctcaaaccctaatttcccaaattcttcaatttctcaaattttcattcaaaaatgtctggtcgtggaaagggaggtaaaggattaggaaaggggggtgcaaagagacatcgcaaggttctccgtgacaacatccaaggaatcacaaagccagcgattcgtcgattggcgagaagaggaggtgtgaaaagaatcagtggattgatctatgaggaaacaagaggtgtgttgaagatcttcttggagaatgttataagagatgctgttacttacactgagcatgcgaggaggaaaactgtgactgctatggatgttgtttacgcgcttaagagacaaggaagaaccctctatggtttcggtggttgaagatgatgaagttttttgtgtaattgttatgggtttttctttgtaagttttaacaagattgaaattgaatgaaatgctctttcatgatgaattatgattttttttaatttgtgtttatgttctatcacgattgagtaatcatggcttaattt

SEQ ID NO: 2509 - DNA, 604 bp, Medicago truncatula
aagcagtggtatcaacgcagagtgcccattacggccgggacacacattcaatttcaaactcaaaccctaatttctcaaattttctcgcgaaaatgtctggccgtggaaagggaggtaagggattgggaaagggaggtgcaaagaggcataggaaagttcttcgtgataacatccagggtatcaccaagcctgcaattcgtcgattggcaagaagaggtggtgtgaagagaatcagcggtttgatctatgaagaaaccagaggtgtcttgaagatcttcttagagaatgtcattcgtgatgctgtgacatacactgagcacgctaggaggaagacagtgacagccatggatgtcgtctatgctttgaagaggcagggaagaaccctctatggattcggaggttgatgctgaagatgaagaagaagcacttttagtttattttttattttattttgccttagactttaatttgaatatgcaattgcaccttagaaagtttcaatgatgtttagggtaatatgttataagtgattctcgagtagatcgaaactttttcagtttcagaaatattgaaatctaatgaaaagtagtacttcgattaattt

SEQ ID NO: 2510 - DNA, 555 bp, Medicago truncatula
acacatcgaaacagaaccaaccaacaacaactacaacacactaaaatcgaaatttcgaagctcgaaacaagatcttgcaatcaacaatgtcaggaagaggaaaaggaggaaagggtttaggaaagggtggtgcaaagcgtcatcgcaaagttcttcgagataacattcagggaattaccaaacccgcgattcgtcgtcttgcaaggcgtggtggtgtaaaacgtatcagtggtctgatctatgaagaaactcgtggtgttctcaagatatttcttgagaatgttattcgtgatgctgtcacttacactgaacatgctcgtcgcaaaacagttactgctatggatgttgtttatgcgctcaagaggcaaggaaggaccctttatggttttgggggttaggttagggtattgttaattagtagtaagaaaagtgaattagtaattagtcgttatagcttgttgaatcttttagtactgtatcacttttctaactcttgccaatatataattgttcctttcgtctttgttaatttattgaattttaaatctctgattc

SEQ ID NO: 2511 - DNA, 529 bp, Medicago truncatula
acaactacaacacactaaaatcgaaatttcgaagctcgaaacaagatcttgcaatcaacaatgtcaggaagaggaaaaggaggaaagggtttaggaaagggtggtgcaaagcgtcatcgcaaagttcttcgagataacattcagggaattaccaaacccgcgattcgtcgtcttgcaaggcgtggtggtgtaaaacgtatcagtggtctgatctatgaagaaactcgtggtgttctcaagatatttcttgagaatgttattcgtgatgctgtcacttacactgaacatgctcgtcgcaaaacagttactgctatggatgttgtttatgcgctcaagaggcaaggaaggaccctttatggttttgggggttaggttagggtattgttaattagtagtaagaaaagtgaattagtaattagtcgttatagcttgttgaatcttttagtactgtatcacttttctaactcttgccaatatataattgttcctttcgtctttgttaatttattgaattttaaatctctgattc

SEQ ID NO: 2512 - DNA, 614 bp, Medicago truncatula
gcattatggccggggactcacattcgaattcaaatcctaatttctctaatttcccaaattttgtatttcgttttctcaaagttttctcttgaaaatgtcaggtcgtggtaagggaggtaagggactcggaaagggaggtgcaaagaggcatagaaaggttcttcgtgataacatccagggtatcaccaagcctgctattcgtcgattggcaagaagaggtggtgttaagagaatcagtggtttgatctatgaagaaaccagaggtgtcttgaagatcttcttggagaatgtcattcgtgatgctgtgacatacactgagcacgcaaggaggaagacagtgacagccatggatgttgtctatgctttgaagagacagggaagaaccctctatggatttggaggttgaagaatatgaagaagaaacactctttagtttattttttttatctttttcctttagctttgtaatttgaatatgcgattctaatctggaattcttgttatgatatttaggttaatatcttacttgtaattttcgttgagattgaaggatattcaatttgacatagtttgaaattgaaatttaatgaaaaggattacatttcttattactt

SEQ ID NO: 2513 - DNA, 536 bp, Medicago truncatula
atcacaaatctcaattcaaaaccctaaatcccaaattcaaagtttttcaaaagtctcgattgaaaatgtcaggtcgtggaaagggaggtaagggattaggaaagggaggtgcaaagagacatcgcaaagtgcttcgtgacaacatccaaggaatcacaaagccagcgattcggcgattagcgagaagaggaggtgtgaagagaatcagcgggttgatttatgaagaaactcgcggtgtgttgaagattttcttggagaatgtgataagagatgctgttacgtatactgaacatgcgaggaggaagacggttactgctatggatgttgtttatgcgttgaagagacaaggaaggactttgtatggtttcggaggttgaagaagatgatgaagaagttgatttagggttatggttatgaattatgtgtattttgaatgttagtttatttcgtaatgtttaatggtgaattagattgatgtatattcagtttttagctgaatttgaaatttgaattcaatgaaagagtaatgtttgggt

SEQ ID NO: 2514 - DNA, 626 bp, Medicago truncatula
atctaaaacaaacaaattacaaattgtaaatatcttcttcattttctcattgaaagaagctttttgatttcagatcaagatgtctgggcgtggaaaaggtggaaagggtttgggaaagggtggagcaaagcgacatcgtaaggtgcttcgtgacaacatccagggaataacaaagccagcgattcgtcgtcttgctcgtagaggaggagtgaagcgtatcagtggtttgatttatgaggagacacgtggcgtgttgaagatatttttggagaatgtgattagagatgctgtgacttacactgagcacgctagaaggaagacggttactgctatggatgtggtttatgccctcaagagacagggaagaaccctttacggatttgggggttagggtttctcttggattttattttggttgtaattgatgtttaattttggtacgaaattgttgctgtacggataattaggtagatttttaggaatcgatcttataatatttttgcagcaattctgtaatccaattcactattatgaattataaagttacaaccatcctattttcgttttctttttaattttgattttgattttgattttggatctgttaatgaaatttcagtagttca

SEQ ID NO: 2515 - DNA, 416 bp, Medicago truncatula
acacttgaaattcaaattacaatttcaaaaccctagatccccaaattttctatttcgttttctcaaattttctcttgaaaatgtcagggcgtggaaagggaggtaagggactcggaaagggaggtgcaaagaggcataggaaggttcttcgtgacaacatccagggtatcaccaagcctgctattcgtcgattggcaagaagaggtggtgttaagagaatcagtggattgatctatgaagaaaccagaggtgtcttgaagatcttcttggaaaatgtgatccgtgatgcagttacatacactgagcacgcaaggaggaagactgtgacagccatggatgttgtctatgctttgaagagacaaggaagaaccctctatggttttggaggttgatgaagaaaaacaagaagccctctt

SEQ ID NO: 2516 - DNA, 538 bp, Medicago truncatula
attatggccgggggacactgaaatcaaattacaatttcaaaaccctagatccccaaattttctatttcgttttctcaaattttctcttgaaaatgtcagggcgtggaaagggaggtaagggactcggaaagggaggtgcaaagaggcataggaaggttcttcgtgacaacatccagggtatcaccaagcctgctattcgtcgattggcaagaagaggtggtgttaagagaatcagtggattgatctatgaagaaaccagaggtgtcttgaagatcttcttggaaaatgtgatccgtgatgcagttacatacactgagcacgcaaggaggaagactgtgacagccatggatgttgtctatgctttgaagagacaaggaagaaccctctatggttttggaggttgatgaagaaaaacaagaagccctcttatgtgtattatgcttttaactttgttattagaacatgtaattgttctttaaaatgcttatttagattgttcctttgtaagtttcaacaagatttgaatctaatgaagtaa

SEQ ID NO: 2517 - DNA, 615 bp, Medicago truncatula
cacacatttcttcatctcaattcttctaagaatttttctttcgaatcaagatgtctggacgtggaaaaggtggaaagggattgggaaagggaggagcaaaacgacaccgtaaggtgcttcgtgataacattcaaggaattacgaagcctgcgattcgtcgtttggcacgtagaggaggagtgaagcgtataagcggtttgatctacgaagagacacgtggcgtgttgaagatctttttggagaatgttattcgtgatgctgttacttacacagagcacgctaggagaaagactgttactgctatggatgttgtttatgcattgaagagacaaggaaggactctttatggatttgggggttagggtttcaggattttctgttttttttcttgtcgttttttatttcaagttttatgggttgggaaaagtcttgctgtcaagaaattttggcaaggtttatggttgaatttaggtggtgttaacttaggttaagaatttaggacttgtgttaggtagttaactgtttcatggtgattctgttatgtaactactagtcttaatgaacaagtgtttatgattttagattttgaaatttactttctctgtttcttacgct

SEQ ID NO: 2518 - DNA, 597 bp, Medicago truncatula
gcacgaggatttcttcatctcaattcttctaagaatttttctttcgaatcaagatgtctggacgtggaaaaggtggaaagggattgggaaagggaggagcaaaacgacaccgtaaggtgcttcgtgataacattcaaggaattacgaagcctgcgattcgtcgtttggcacgtagaggaggagtgaagcgtataagcggtttgatctacgaagagacacgtggcgtgttgaagatctttttggagaatgttattcgtgatgctgttacttacacagagcacgctaggagaaagactgttactgctatggatgttgtttatgcattgaagagacaaggaaggactctttatggatttgggggttagggtttcaggattttctgttttttttcttgtcgttttttatttcaagttttatgggttgggaaaagtcttgctgtcaagaaattttggcaaggtttatggttgaatttaggtggtgttaacttaggttaagaatttaggacttgtgttaggtagttaactgtttcatggtgattctgttatgtaactactagtcttaatgaacaagtgtttatgattttagattttgaaaaaa

SEQ ID NO: 2519 - DNA, 545 bp, Cucumis melo
aactctcaacgtcaatttcagatcccttccatacgtctctaatatacgttctctaatctctacatcaggcttcgacaatgtcaggacgtggaaaaggaggtaaagggttggggaaaggaggagcaaagcgtcataggaaggttttgagggataacattcaaggaattacgaagccggctattcgccgactggctcgtagaggtggagttaagcgaattagtggtttgatctatgaagaaactagaggtgttttgaagatcttcctcgagaatgtgattcgtgatgctgtgacttacacagagcacgctaggaggaagacggtgaccgccatggatgtggtttatgctctgaaaaggcagggaaggaccttgtatggattcggtggttaggttttttatcgattgatttggatctttgctttagatctgtcatctctttacttgaagtgtttagttttaggattttatgtaactttactctcttttgttcagaaatattaaagctgttttgattgtatgtctgtgccaacttcttttttatatcta

SEQ ID NO: 2520 - DNA, 521 bp, Cucumis melo
  misc_feature (9)..(9): n is a, c, g, or t
  misc_feature (490)..(490): n is a, c, g, or t
gatcgaaancaaaatcaaaactcacaaccgatattgttccacatcgctgttctagtctaaccccacaatcaccggcgacaatgtctgggcgtggtaagggcggcaagggattgggaaagggaggagcaaagcgtcacaggaaggttttaagagataacattcagggcattaccaagcctgccattcgccgtttggctcgtagaggtggtgtgaaacgtatcagtggattgatctatgaagagaccagaggggttttgaagattttccttgagaatgtgattcgtgatgctgttacctatactgagcatgcaaggaggaagacggtgactgctatggatgtggtttatgctttgaaaaggcaaggaaggactttgtatggttttggaggttagggttagggtttgattcgaagaatgattgtagaccattacctttgatcttatattttgtagtcgaactcgttcttattgattaatgtaagttaattccncattagttggaagtgatggaagttttacttc

SEQ ID NO: 2521 - DNA, 684 bp, Nicotiana benthamiana
ctctctctctctctctctctctctctctctctctctctctctctctctctctctctctctctctctctctctctctctctctctctctctctctctctctctctctctctctctctctctctctctctcctcgttcctctcttttaaattcaaaacccttgaattcactttcaattatctctttctcaagcttttgaaaaatgtctggacgtggcaagggaggcaagggattggggaaaggaggagcaaagagacacaggaaagtgctgagagataacatccagggaattacaaagccagctattcgcaggcttgctcgtaggggtggtgtgaagcgtatttctgggttgatttacgaggagactcgtggagttcttaagatctttttggagaatgtgattcgcgatgctgtgacctacactgagcacgctaggaggaagactgttactgccatggatgttgtttacgctctcaagaggcagggaaggaccttgtacggatttggaggttaaatattggcggttagggtttattgtattttgttgttagtgattgtagattttatgtttgtgctttctgtttgtgttagtggtcagtttaagctagggtattttaatttccgttgttaaggtctggacattgtaatacctcgttatacaattaagtaaaacagaccatttccta

SEQ ID NO: 2522 - DNA, 557 bp, Nicotiana benthamiana
  misc_feature (553)..(554): n is a, c, g, or t
gcacgaggctgatttcaattcaaatctaaaaccctagaagcttcttttatcttcaaatttctgtgtgaaaatgtctggtcgtggaaagggaggaaagggattgggcaagggaggagctaagaggcacaggaaggtgctgagggataacatccaaggaattacgaagcccgcaattcgtcggttggctcgtaggggaggtgtgaagcgtatatctggtctgatctacgaagagacacgtggagtgctgaagatctttctagagaacgtgattcgtgatgctgttacctacaccgagcacgccaggagaaagactgttactgctatggatgtcgtttatgcactcaagaggcagggcaggactctctatggatttggtggttaggttgtttaggtgtgattttaggtaactgtatttgtagtaattgtagattttctggaatttctgttgtctctttgttggtttctccgcagctttgttctagttgttgttcttaaggtcttgataatgtaatttctcattacagattcaaggaacaaagttcattttctagannaaa

SEQ ID NO: 2523 - DNA, 685 bp, Nicotiana benthamiana
  misc_feature (4)..(4): n is a, c, g, or t
ttanggccgggatcgccctaatcattatctctcgcacaatttttcagcttcagggtctttaatttgcagagaaactaaaggttgattgaaaatgtctggacgtggaaagggaggaaaaggattaggaaagggaggagcaaaacgacaccgtaaagtcctccgcgataacatccaaggtatcacaaagccagcaatcaggcgtttagctcgtagaggaggagtgaagcgtatcagtggactcatctatgaagagacacgtggcgtgcttaagatctttttggagaatgtcattcgtgatgctgtaacttacactgagcacgctaggagaaagactgtgactgctatggatgttgtgtacgcgctcaagagacaaggaaggactttgtatggttttggaggttaatgtgaaacttttattttttctgcaagagtcttgctgtcgagaaaagaacaagaacggttaccatatggtatatgaggtttgttttgcttttgattagggatctgattcggtgtaattagtttggttacctattggtgataggtttcttttttagtagtattggtcattgggtaagctgaatttggtggatgcttgtttcaatatttctgaaacttgctttattgaaatgaatattagtgactgaattcagtttcaccgtctctcttggtattggttcgactg

SEQ ID NO: 2524 - DNA, 555 bp, Nuphar advena
  misc_feature (17)..(17): n is a, c, g, or t
cccgggctgcaggaatnggcacgaggcctcgtgccgaattcggcacgaggccaaaatcccccaaaatctagaaaaaacaggaaggcccaatttccggaaaaagagaaatgtcgggcaggggaaagggagggaaggggttgggcaaaggaggtgcgaagaggcacaggaaggttctgagggacaacatccagggcatcaccaagcccgccattcgccgcctcgctcgcaggggaggagtgaagcgcatcagcgggcttatctacgaggaaaccagaggtgtcctcaagatcttccttgagaacgttattcgcgatgccgtgacctacaccgagcatgcccgccggaagacggtgaccgccatggacgtcgtctatgcgctcaagcgccaggggaggaccctctatgggtttggtggttaagatggcctccttcatcttctttgttctttcttttgtttagtgggcttgtatgtggttttaaagggaacccattgtaatggtagcaatgtttgggaaagttcagtatgaatatatgggttttgtgatttctactgcg

SEQ ID NO: 2525 - DNA, 650 bp, Nuphar advena
aaaattctcgcatcggcttctcgaacccttctctttcttctccgtttcggttttctgcaactatttagggtttcgccgtttcgaggatgtccggccgtgggaagggtggcaaggggctcggcaagggaggcgccaagcgccacaggaaggtgctccgcgacaacattcaggggatcacgaagcccgccatccgtcgcctcgctcgccgtggtggcgtgaagcgaatcagcggtctcatctacgaggagaccagaggcgttctcaagatcttcttggagaacgtcatccgggacgccgtgacctacacggagcacgcccgccgaaagacggtcaccgccatggacgtcgtctatgccctcaagaggcagggcaggacgctctatgggttcggcggttagggtttctgatccaaagtcttgctgtcaggaaagaaaaaaattggttctctgtatgtcatgatcggcttttagagaatttagcggtttttgatttgggatggatttgatgttggggttagattttgctttctctctgtttcggttaaacttatttttcagttgaatgtaaagcttttggtgtttgtactcggtggcgctctttattcgttactgaatactatgaaatagatagagcatttcatcattttgatg

SEQ ID NO: 2526 - DNA, 624 bp, Nuphar advena
cagcttcgtcgggggtttctcggactccaggatttcgtcatcgcgaggatgtccgggagagggaagggcggaaagggtctgggcaagggaggcgccaagcggcacaggaaggtcctccgcgacaacatccaggggatcaccaagccggccattcgccgtctcgctcgccgtggtggtgtgaagcgcatcagcgggctcatctacgaggagacgcggggcgtcctcaagatcttccttgagaatgtcattcgcgatgctgtgacctacacggagcacgctcgccgaaagacggttacagccatggatgttgtctacgccctcaagaggcagggcaggactctctatggcttcggaggttagggtttctcatgcaaagtcttgctgtcaagaaaaaaatggttctttgtatctaacgagccgcttttagtctttaggattttgatttagtgttgggaaggggttagtggagtgagggctttcggttacctggctcttgttgaatttgtgtatttttctgctctagcatctgaaatgtcttctttatgctgggtgatttgaatagattcaacatttcatcgttcttatggttgaaattgtgtttttttaatgtttgattgatcggtt

SEQ ID NO: 2527 - DNA, 656 bp, Nuphar advena
  misc_feature (623)..(623): n is a, c, g, or t
aaatcttcattcgtcttctcaagtcctctcttcctccctctttctactccgttggggctttctaccgccatctagagttccttcgtttcgaggatgtccggccggggcaagggaggcaaggggctcggcaagggaggcgccaagcgccacaggaaggtgctccgcgacaacatccaggggatcacgaagcccgccatccgtcgcctcgctcgtcgtggtggcgtgaagcgtatcagcgggctcatctacgaggaaaccagaggagtgctcaagatcttcctggagaacgtcatccgggacgctgtgacctacacggagcacgcccgtcggaagaccgtcaccgccatggacgtcgtctatgccctcaagaggcagggtaggacgctctacgggtttggcggataaggtttcggactcaaaagtcttgctgtcaagaaagaaaaaaattgttatttgtatgtcacgatcagcttttagagaatctaggggttttggacttcggggttgtaattgatgttggggttagatttttatttctctgttttgttttcccttattttttagttgaatgtaaatcttttggtgtttggattttgtgatgctctgtttcatcacagaatacnttgaaatggatatggcattttatccttttgatg

SEQ ID NO: 2528 - DNA, 672 bp, Nuphar advena
  misc_feature (38)..(38): n is a, c, g, or t
  misc_feature (43)..(43): n is a, c, g, or t
  misc_feature (53)..(53): n is a, c, g, or t
  misc_feature (125)..(125): n is a, c, g, or t
  misc_feature (401)..(401): n is a, c, g, or t
  misc_feature (432)..(432): n is a, c, g, or t
  misc_feature (487)..(487): n is a, c, g, or t
  misc_feature (508)..(508): n is a, c, g, or t
  misc_feature (535)..(535): n is a, c, g, or t
gttcgtccttcgtcttcctcatctttctttcgtctacntcgtnggggtttctntaactctagggtttcgtcgtcgcgaggatgtccgggcgagggaagggcggaaaggggcttggcaagggaggngcgaagcgtcacaggaaggtcctacgcgacaacatccaggggattaccaagccggccattcgccgtctcgctcgccgtggtggtgtgaaacgcatcagcgggctcatctatgaggagacgcgtggcgttctgaagatcttccttgagaatgtcatccgagacgctgtgacatacactgagcatgcccgccggaagactgttacggccatggatgttgtctacgccctcaagaggcagggaaggaccctctatggatttggtggttaggggttcgcntgaaaagtcttgctgtcaagaaaatatttgnttccttgtatctaatgatcggtttttagtctttaggattttggtttagtggtgtngggggtagggttaggtgttangggaatgggagctttcggttcttttgnattttgttgaatttgtgtaaaaattccttctctggcatgtgaagggtcttctgtatgccgggtgatttgaatagagtcaacgtttcatcgttcctatgataaaaattgtgtttttatttaaatggttttggttgatc

SEQ ID NO: 2529 - DNA, 474 bp, Quercus alba
gagcggccgcccgggcaggtacgcggggatcaaaaatcaaaaccgattccaatttcaaatctcaaatcccagaaaactctattttcttctttcaatttctcaaaaaaatgtctgggcgtggaaagggaggcaagggtttgggcaagggaggagcgaaacggcaccgtaaggttcttcgcgataacatccagggaatcacgaagcctgcgattcgtcgtttggctcgcagaggtggagtgaagcgtatcagcggtctgatctacgaggagacacgtggcgtcctcaagatcttcttggagaatgtgatccgtgacgccgtgacctacaccgaacacgcaaggaggaagaccgtgacggccatggatgtcgtctatgccttgaagaggcaaggaaggactctctatggcttcggcggttaagaatcttgagatctatgattagatttgtgtacctcgccgcgaccacgtaaggcga

SEQ ID NO: 2530 - DNA, 641 bp, Quercus alba
caataattcaccaaatcctcaattcagatttttgaattcaagtcttggaaaatgtctgggcgtggaaagggaggtaagggtttgggaaaaggaggagcgaaacggcatcgtaaggtgcttcgcgataacatccagggaatcaccaagcccgctattcgccgattggctcgcaggggtggagtgaagcgtatcagcggtctgatctacgaggagacacgtggcgtcctcaagatcttcttggagaacgtgattcgcgacgccgtgacctacactgagcacgcaaggaggaagaccgtgacggccatggacgtcgtctatgccttgaagaggcaaggaaggactctctacgggtttgggggttagggggttttgtgttttgtgtttggtatgggactttgggaacaagtcttgctgtcaagaaagtccgatggtggtggtggtgttttttgttttgtaattaggggtggttctatttcaaatatgtgggtttttagggtttggttttaggtttattagttttagttctacttgtttgtgattcaaactctgaattgcaagttatgaagatttaatgcaaactagcttttgttaaattggagtatgaatggttgcaatggattatctttatttttatgttaaag

SEQ ID NO: 2531 - DNA, 550 bp, Quercus alba
caatctctctcagtctctctcgcccttttcgtttggatcagactgtgcgatacagatcttgaattgacctaacaaaatgtctggaagaggaaagggaggcaagggacttggaaaaggaggagcgaaacgacatcgtaaggttctccgtgataacattcagggaatcacaaagccagccattcgtcgtttggctcgcagaggaggagtgaagcgtatcagtggtctcatctacgaggagacgcgtggagtgctcaagatctttctcgagaatgtgatcagggacgctgtgacttacactgagcacgcgcgtcgcaagactgtgactgccatggatgttgtgtatgctctcaagaggcagggcaggactttgtatgggtttggtggttagggttttggaatcgaaggtagatttggcaaatttagaatttgtttggttttgttagcttgtattaaaatgttatgggtttgtaagtactgggttgagttctattttgtattgggaatggttggaactttggaatgaaaattggaggtggtggtgtttgatccc

SEQ ID NO: 2532 - DNA, 772 bp, Quercus alba
aaaacagtctttcaaaaacagagaaacagagagagaaaatgtcaggaagaggaaaaggaggcaagggtttgggaaagggaggagcgaaacggcaccgtaaggttctgagggataacatccagggaattaccaagcctgccattcggcgtttggccaggcgtggcggagtcaagcgtatcagcggtctcatctacgaggagacacgtggcgtcctcaagatcttcttggagaacgtgattcgcgatgctgtcacctacaccgagcacgctcgccgcaagactgttactgccatggatgttgtttacgctttgaagaggcagggcaggactctctatggttttgggggttagggtttggtttagtttgtttctttatagatttagataggtttgattttcggtatctctccttaatttctgagggtttattagaggtgtaatcatatttctgatatgaaagaagttaaattctttcatatcagaaatatgattacacctctaataaaccctctagaaatattcctttccgatgttttctgggttagactggcgaacaaccaatattctttagacaagcacagtttttttgaatatgagacccactttactgtcatgaattatcgtgggaggtttagtcacaagaatacaccagagtttgtgacagagtttgaacaggaacatcaagttaaatggtcagagatccatctgcgagtgagaacaatgattcgatcagtcttcgaggctgctgctgcagtacatccagatatgcacag

SEQ ID NO: 2533 - DNA, 562 bp, Elaeis guineensis
ggtccggagagacgaaggctggtagatgtagagagggggacccgtaaaagaagggagagagctcgaaggagatgtcgggacgaggcaagggaggtaagggtttgggaaagggaggtgcaaagcgccaccgcaaggtcctccgggacaacatccagggcatcaccaagcccgccatccggcgtctcgcacggcgtggtggcgtgaagcgtatcagcggtctcatctacgaggagacaagaggcgtgctcaagatcttcctggagaacgttatccgcgacgccgtcacctacacggagcacgctcgccggaagaccgtcaccgccatggacgttgtctacgctctcaagcgccagggccgcaccctctacggcttcggtggttagagccaacgttttcgggctcggccttaaaatttgatgttattatcctttttttccttttctcttttcagtttttttttccccaacaatgttcttgatgctcaagtatgttcagttttgtatgaaaacttttgggtgctgatggaacttttcttttggtaaattttgttcgttggctgcat

SEQ ID NO: 2534 - DNA, 586 bp, Elaeis guineensis
  misc_feature (224)..(224): n is a, c, g, or t
  misc_feature (443)..(443): n is a, c, g, or t
tctctgccgctccaaaattccccacctctccagagcttaggaaattttcgtaagataagatgtcgggccgtgggaaaggaggcaagggtttggggaagggtggcgcgaagcggcaccgtaaggtcctccgggataacatccaggggatcacgaagccggcgatccggcgtttggcgaggagaggaggggtgaagcggatcagcggcttgatctacgaggagacnaggggagttctcaagatattcttggagaatgtgatccgagatgccgtcacatacaccgagcacgcccgtcggaagaccgtcaccgccatggacgtggtctatgccctcaagaggcagggccggacactttatggattcggtggttagggtttctgatctatgaaaagtcttgctgtcaagaaaataatcaaaagtagagtacttcggtagctttcgatngcaggttttcgtgtgttggatggtgtctttgctgaatctatgcggtatatccgtctgttcttgtggtggagcgaaatccttttgtatattttgatgtacttttcatccatgaatgcaatgacctaccattgcctcaattatct

SEQ ID NO: 2535 - DNA, 618 bp, Elaeis guineensis
gagagatagagaggtaaagagataatggagaaataaaggtaggtggagaaagatagatagaaagagagagagccaggaaaggttccttccccttgttttctcctcgtgccgaattcggcacgaggatttcgtggaagatgtcgggacgcgggaagggaggcaagggtttggggaagggcggcgcgaagcgtcaccgcaaggtcctccgcgacaacatccagggcatcaccaagcccgcgatccggcgtctggcgaggcgtggcggcgtgaagcgcatcagcggtctcatctacgaagagacgagaggcgtgctcaagatcttcctggagaacgtcatccgcgatgccgtcacctacacggagcacgcccgacgcaagaccgtcacggccatggacgtcgtgtatgccctcaagcgtcagggccgtaccctctacggcttcggtggttagggttaggagaatagtattactttagcctaggatttttctactttagaattgggggctacggtttgatcgagatggcatgttattgtggggcaatcgaatgaatctgctagaattagggagtcggacgatgtaatcttgtggagaaattaatgactgaaatcgttttacg

SEQ ID NO: 2536 - DNA, 622 bp, Elaeis guineensis
actagttctcagaaagcaaatctaattctgcttcgttaatatagccatgtcgggtcgtgggaagggtggtaagggtctgggcaagggcggggcgaagcggcatcggaaggtgctccgcgacaacatccagggcatcacgaagccggcgatccgccgcctggctcgccgcggcggcgtgaagcgcatcagcggcctcatctacgaggagactcggggtgtcctcaagatcttcctcgagaacgtcatccgcgacgccgtcacctacaccgagcatgcccgccgcaagaccgtcaccgccatggacgtcgtctacgccctcaagcgccagggccgtaccctctatggctttggcggctgagatccatccattccgtggttattttttagaactcttttagggttttgggctcttcttatgtgagtgagatgcggcaagttattgctctgaatctggaatggaaatattaagttcgatttcatcttattatgaaatgtagaagaagaaaaagaagaaaaaaaaatcgaatcttgccatccagtgatgtgattatttgtcgatgctcgtcagtttattatatatggttatgtttcaattcaagagttaatgtggactacttggtct

SEQ ID NO: 2537 - DNA, 672 bp, Elaeis guineensis
  misc_feature (4)..(4): n is a, c, g, or t
aatntcctcgctctataaattctcccccatcctcccttccaatctccccatctccaattcccatcgtctctgaggaaagcaaaacaaatttcctccgttaaggcagccatgtcgggtcgcgggaagggcggtaagggtctcggcaagggcggggcgaagcggcaccggaaggtgctccgcgacaacatccagggcatcacgaagccggctatccgccgcctggctcgccgcggcggcgtgaagcgcatcagcggcctcatctacgaggagacccgtggtgtcctcaagatcttcctcgagaacgtcatacgcgacgccgtcacctacaccgagcacgctcgccgcaagactgtcaccgccatggatgtcgtctacgccctcaagcgccagggccgtaccctctatggctttggcggatgagatccatccattccgtggtttttttttcaaaagaaaaactctttagggttttggtctcttatgtgagtgggatgggatgctgtgagttattgttatgaaagtggaagggaaacattaagtttcatcttatcttattatgtattatgaaattaggaagaggaaaaaaaaatctaatcttgccagccagtgctgtgattgtttttttgatgttggtcagtttattttatataatcatgtttcaattcagagagt

SEQ ID NO: 2538 - DNA, 797 bp, Elaeis guineensis
atgattccagttgcaaaaatctcagacagcttccaactgtcaggctgaggagatggtttcaccctatcctttgatatagtcattatggtaccatcattgaggattgcaatgataaggaccataaatggtggaaagtcgaacttccaaatgagagcgagcagcatgaaaccgagcacaatacggattgtaattgaaaccctcgtgccaattcggcacgaggccaaatccctaatttcttatcccaggcgacagagaagcaatttttttttgcaccttttccctctgcattctacctcgatcgacgccatgtcgggccgcggcaagggaggaaagggcttgggcaagggcggggcgaagcgccaccgcaaggttctccgcgacaatatccagggcatcaccaagccggcgatccgccgcctcgcccgccgcggtggcgtgaagcggatcagtggccttatctacgaggagacccggggagtcctcaagatcttcctcgagaacgtcattcgcgacgccgtcacctacaccgagcacgcccgccggaagaccgtcaccgccatggacgttgtctacgccctcaagcgccaaggcaggaccctctatggcttcggcgggtgagctcctactgggactgggacggggtggtgggattggatgtggttggggtttgtgggagtgttagggtttcatgcgggtttatccgtgttttggctgtaaatcctcttgcgtctgttatgggatagaaaagatgcaaactttttaaattatggaatggaactctgaagctttgcttgaat

SEQ ID NO: 2539 - DNA, 501 bp, Allium cepa
ctcaatttctagactcttcattttgctctaaatactatccaaccgacaatgtcaggaagagggaagggaggaaaaggtttgggaaaaggtggagcgaagaggcacagaaaggtgctccgcgacaacatccaaggaattacgaaacctgccattcgtcgtcttgctcgccgtggcggtgtcaagagaattagcggtttgatctatgaagaaaccaggggtgttttgaagattttccttgagaatgtcatcagggatgccgtcacctacaccgaacatgcaaggaggaagactgtcacggccatggatgttgtttatgctcttaagaggcaaggaaggactctttatggcttcggtggttaaaactcatattctaagatcatgatgactttcggtaattttgtagtttagttgttaccgaggaagtaagcattttgtatctttgctgtatttgaatttccctgttggaattgaaaaacttgggtttaacagtttaatcatctt

SEQ ID NO: 2540 - DNA, 444 bp, Carica papaya
accatatctgtttttgcctcttttgttctgcagatctcttcaaagtctcagctctccggttccgtcgttaatcacctgatcaaaacatgtctggccgaggaaaaggtggaaaaggattgggaaagggaggagccaagcgtcatcgtaaggtgctccgagataacatccagggcattaccaagcccgcaattcgccgtttggctcgtagaggtggcgtgaagcgtatcagcggtttgatatacgaggagacccgaggtgttcttaagatcttcctggagaacgtgattcgcgatgctgtgacctacacggagcatgcgaggaggaagacggtgacggccatggatgtcgtttatgctttgaagaggcagggcaggaccctttacggattcggcggttagggttttgtttgagttgggaatttgcggcaagaggggaggggggaac

SEQ ID NO: 2541 - DNA, 442 bp, Carica papaya
agcgagtcctctcattcgattcgttctcaattacattttgatctgaaaactctccgagaaaatcaccgagttactgagaaaatgtcgggccgtggaaagggaggcaagggattgggcaagggaggagcaaagaggcacaggaaggtgctgagggataacatccagggaatcactaagcccgccattcgccgtttggctcgtcgaggtggcgtcaagcgtattagtggtctgatctacgaggaaacaagaggagtgttgaagatcttcttggagaatgtgattcgtgatgctgtgacatacaccgagcacgccaggagaaaaacagtgactgctatggatgttgtctacgccttgaagagacaaggtaggactctttacggtttcgggggttagaaacgtttcatcgatgcggctgtattgggattgtttaggtttagattcg

SEQ ID NO: 2542 - DNA, 629 bp, Carica papaya
atcaaatcaaacgctgagaagtgaaatccctaattctccaattccgagcaccttttttcaattttccagcgcgagctttcgacaatgtcaggacgcggcaagggaggcaagggtctcggcaagggaggtgcgaagcgtcaccgtaaggtcctccgcgacaacatccaggggattaccaagcccgcgatcagacgtctggcgagacgtggtggagtcaagcgaattagcggtctgatctacgaggagaccagaggcgtcctgaagattttcttggagaacgtgatccgcgatgcagtaacttataccgagcacgctaggaggaagaccgtgaccgcgatggacgttgtctatgcattaaagaggcagggcaggactctgtacgggtttggtggttgagttcttttgagcttaattgcttcccctttctggttctcttttgttaggttttcttttctctttttttaccttgatgttgtgattagtttagatccatgatcgatctcgaaagcaagtttgttgtttttgggttttcgtggtaaagcatatagcttgtaggctattttattgtatacagatctgaatcaactgatcatgtggcttctatcatggaattgtggaactgattaaac

SEQ ID NO: 2543 - DNA, 788 bp, Arachis hypogaea
attcattagcatattcttttccggttccgtattcacctcatcgttgtcgagagaaagctagcagccatgtctggaagaggtaaaggaggaaaaggtctcggaaagggaggagcaaagcgccaccgcaaggttctgagagataacatccagggtatcacgaagcccgccattcgccgtctcgcaaggcgtggtggtgtcaagcgtattagcggcctcatctacgaggagacacgtggcgtcctcaagatcttccttgagaacgtcattcgtgatgccgttacctacactgagcatgctcgccgcaagactgtcaccgccatggatgttgtctacgccctcaagaggcagggcaggacactctacggatttggaggctaaacacttcagaattgggaatttgttatcactatgttagaattagggtttatttgcgtcttctttctattatgctctgttttttgtcgataattgtattgtggattagctttccaattaggctctttaatttgtctacggattgtttcgatgaactcaaatatctcgcaaatttatagtcctagttaaatcttgcatctaattcaatatcattttcgaaacagttcagacttgtagctctggctctgttaaatttgttatacagcgttttcaaaagttgtttttcttccaaacttatggtgaatgcagagtattgtgaatgcagaatttaagttagcgtagttgttgctatcccttattgaatctatcttgaggttctgtattcgatttgaattgaatgagaatttttcgga

SEQ ID NO: 2544 - DNA, 720 bp, Arachis hypogaea
ttttcccaccacttatcaaaccatcagtttttattcaaaaccctaaccctaattcccaaatcacactttggaattctaagaaaatccttcaaatttccccgagaaaatgtcaggtcgcggaaagggtggcaagggattaggaaaaggaggagccaagaggcatcgtaaggttctccgcgataacattcagggaatcacgaagcctgcgattcggaggctggcaagaagaggtggcgtgaaacgaatcagtggtttgatctatgaagagactcgtggtgttcttaagatctttctggagaacgtgattcgtgatgcggtgacatacacggagcacgcaaggaggaagaccgtgacggccatggatgttgtttatgctctgaagaggcagggaaggaccctctatgggtttggaggctgaggcttccaaagtttggattttggaaaggttggtagatatcggaaggattttggaaattgggcatgtgatagacttgtgtttttaagaaaaaattggaagagaatttgtattttggtttgtattttattttggtctggtgaaaaatttgtagtttgtattgaatagttcaagtctacttgaattaaatttctttcctatagttttagctgtttattgttcatatgtgctttccatgtttctaatgcagtagctaccactagtttgttcaactcttattttattattatttacttcggttgatg

SEQ ID NO: 2545 - DNA, 695 bp, Arachis hypogaea
atcaaattcaagatcaaatctcaacagaaaaagcttctccgcacatctctttctctttagtgtttgaaaatgtcaggtcgtggaaagggaggaaagggattgggaaagggaggagcgaagaggcacagaaaggtgcttcgtgataacattcagggaatcacgaaacccgccattcgccgtttggctcgcaggggaggcgtcaagagaatcagtggcctcatctatgaggagacacgtggcgtcctcaagatcttcttggagaacgtcattcgcgatgccgttacctacaccgagcacgctcgccgcaaaaccgttactgccatggatgttgtttatgccctcaagaggcagggaaggactctctacggtttcggtggttgattctatttagggtttagtatttgctcctgcttgtaaatgtttcacgaattcggtgttataggtttttatggattttatcatcttgttgaagtgtttttgtttttgtttttggataatttgttttctggtcaattagagtgggcggtgcctgcctttgttcaattagagcctcgagtgcagaatgcaaaatattagcactaactagcaatgaatttaaatttgtcccattaaaagcttattagtatttctagtgtcttcggtttagttttgttgattttaaaatcctggtttgtatgttcaaattatattctggt

SEQ ID NO: 2546 - DNA, 670 bp, Arachis hypogaea
gctcactacactcgtcactcattgtatttcatttggagtagcgtccatcagcatctgcgagccatgtctggaagaggaaagggaggtaagggccttggaaagggaggagctaagcgtcaccgtaaggtactgagggataacatccagggtatcaccaaacccgccattcgccgtctcgcaaggcgtggcggtgtcaagcgtatcagcggtctcatttacgaggagacacgtggtgttctcaagatcttccttgagaacgtcattcgcgacgccgtgacctacactgagcacgctcgccgcaagacagttactgccatggatgtcgtctatgcactcaagaggcaaggcaggactctctatggttttggaggctaagcttcatcaaaaattggggatttttagcattgtttacgaaattaggtttattatagtctccgcttcgatgaatttgcttttgttcatattatattgtggactagctcttcaattgagtatttaacaatgcttttagttggctctgagtttatattgtggattagtcataggtagaagttgttgtttcaatctgattgtagctctggtttcgtgcaatacgaaatttataatagtatatgatgttccgcttctgcctcagttctccaattctatgacgaattaatcaattatagcg

SEQ ID NO: 2547 - DNA, 717 bp, Arachis hypogaea
gaacccccctcttcgttttcccaccacttatcaaaccatcaatttttattcaaaaccctaaccctaattcccaaatcacactttggaattctaagaaattccttcaaatttccccgagaaaatgtcaggtcgcggaaagggtggcaagggattgggaaaaggaggagccaagaggcatcgtaaggttctccgcgataacattcagggaatcacgaagcctgcgattcggaggctagcgagaagaggtggcgtgaaacgaatcagtggtttgatctatgaagagactcgtggtgttcttaagatctttttggagaacgtgattcgtgatgcggtgacatacacggagcacgcaaggaggaagacggtgacggctatggatgttgtttacgctctgaagaggcagggaaggaccctctatgggtttggaggctgaggcttctaaagtttggattttggaaagattggtagatattggaaggattttggaaattgggcatgtgatagacttgtgcttttttaagaaaaagttggaaggaaatctgtattttggtttgtattttattttattcccgtgaaaaaatttgtagtttgaattgaatagttcaagtttacttgaattgaattcctttcttgaacttttagctgttagtgtatatacttgatttggatatttctaaaggagtatttacaactagaaggttcaattccgtattttat

SEQ ID NO: 2548 - DNA, 562 bp, Arachis hypogaea
gaagaacagcgccatcgaaactccaacaacgttcaaataaattctttctaaaaaagaaaaatcttttatctagtgtttgaagatgtcgggtcgtggaaagggaggaaagggattgggaaagggaggagcgaagaggcacagaaaggtgcttcgtgataacattcagggaatcacgaaacccgccattcgccgtttggctcgcaggggaggcgtcaagagaatcagtggcctcatctatgaggagacacgtggcgtcctcaagatcttcttggagaacgtcattcgcgatgctgttacctacaccgagcacgctcgccgcaaaaccgttactgccatggatgtagtttatgccctcaagaggcagggaaggactctctacggtttcggtggttgattcgttctagggtttagtatttgctcctgtttgtaaatgtttcatggattattgagcttgatgaggtgtagtttggatctagaggaaatggaactgattacttcttttgttttggaagttgatgttataattctatatgaaatattaacgtgaagaagttagcaaaga

SEQ ID NO: 2549 - DNA, 548 bp, Arachis hypogaea
gtcatattttgcccattaattccacatcgtattatttgcctcaacaaaaagctatcaaccatgtccggaagaggaaagggtggcaagggcctcggaaagggaggagctaagcgccaccgtaaggttctgagggataacatccagggtatcaccaagcccgccattcgccgtcttgcaaggcgtggtggtgtcaagcgtatcagcggtctcatctacgaggagacacgtggcgttctcaagatcttccttgagaacgtcattcgcgatgccgtcacttacaccgagcacgctcgccgtaagacagttactgccatggatgtcgtctacgcactcaagaggcagggcaggaccctctatggatttggaggctaaatgaacttctcttaatttgggattttagggtttagatttattttcctagttttaaattcgattttctggatgtccctctttagggacttgttttgttgatacgagattatgactctttgaatgaatggtgtaaggcttttactatcagtggtataaatgaaaactgattgtttcct

SEQ ID NO: 2550 - DNA, 578 bp, Arachis hypogaea
agcgccatcgaaaccccaaacaacattcaaatatattcttgccaaaaaagaaaaatctcttgagtgttttgaaaatgtcaggtcgtggaaagggaggaaagggattgggaaagggaggagcgaagaggcacagaaaggtgcttcgtgataacattcaaggaatcacgaaacccgccattcgccgtttggctcgcaggggaggcgtcaagaggatcagcggtctcatctatgaggagacacgtggcgtcctcaagatcttcttggagaacgtcattcgcgatgccgttacctacaccgagcacgctcgccgcaaaaccgttactgccatggatgtcgtttatgccctcaagaggcagggaaggactctctacggtttcggtggttgattcaatttagggtttagtatttcctcgtgcttgtaaatgtttcatggattagtgagctcgatgaagtttagtgttggatctagaggaaatggaaatgattgttttttttttttattttggttttggaatcttgatgttatgtattctatatgaaatgttaagctgaaggagttactaaaaaattttcttttt

SEQ ID NO: 2551 - DNA, 470 bp, Capsicum annuum
ggcacgagtagtctctcatttcaaggtaaagaacaaagatgtcaggaagaggaaagggaggcaaaggattgggcaaaggaggagccaagaggcacaggaaggtactaagggacaacatccaaggaatcacaaagccagctattcgtaggcttgctcgtagaggtggtgtgaagcgtatttctggattgatttacgaggagactcgtggtgtactgaagattttcttggagaatgtgatacgtgatgcagtgacatacacagagcatgctaggaggaagacagttactgctatggatgtggtttatgccctcaagaggcaaggaagaactctttatggatttgggggttagggattgtgaaatttagggtaatgattgtagatttaatctttaggattgcttggttttcttttgtgtttgatggtgtaattctccgttacatattcaatgaaaagaaattgcttagccatt

SEQ ID NO: 2552 - DNA, 555 bp, Petunia hybrida
gcggggattcatcgctcatttcattttctatttcaaagttcaaaacaaaaccctagaaagtttaaaaatgtcgggacgtggaaagggaggaaaaggattgggaaagggaggagcaaagaggcacaggaaagtgttgagagataacattcaaggtattactaagcctgctattcgtcgtttggctcgtaggggtggtgtcaagcgtatttctggtttgatttatgaggagacacgtggcgtcttgaagatctttctagagaatgtgattcgtgatgccgttacctacacagagcatgccaggagaaagactgtcactgcaatggatgttgtttatgctcttaagaggcaaggaaggactctttatggatttggaggttgatttggtcagtttcaaaagtcttgctgtcaagaaaagaaaaatattgttttggatttatgtagggggttttatcatggtgtaattagtttggtttatgttttaatagtagtagaagtttgttttgtaagaatgaaatatggtggatgctgtttcacaactactgaaatttgctctgg

SEQ ID NO: 2553 - DNA, 953 bp, Pinus taeda
cggccggggattattgtcgagagcaacagagcgattggcaattgagattcgatctcgaggtcttttggttgtggagatttgaagggggaaagatgtctggacgtggaaagggaggcaagggtttgggaaaaggaggtgcaaagaggcacaggaaggtactgcgtgataacattcagggaattacaaagcccgccattaggcgtcttgccaggagaggcggtgtcaagcgtatcagcggccttatatatgaagaaacgaggggtgtactgaagatttttcttgagaatgtcatcagagatgccgtcacttacacagagcacgctaggagaaagactgtaaccgctatggatgttgtctacgccttgaaaaggcagggccgaaccctatacggctttggaggttaaagaacggggctctgttttttgttcatttaatgaattgctgatggcgttttcaaacgccataacttgctttctctggggatttgtaagcttgttggtgccgaagcaatgctgaattgctacttagagcatctgttaaatgtgtaaattgttcctctatgtgagggtttctctttagggtttcaattcaaatccaaatttgtatggaaaagctgttttcttatcaagctcctgatgttttgttaagtgtacattttagaatgcggtgtggatctttatattttgttataatagcaacgtatttatgttgtacgtttctacagacggtggggaaagcagactgtctgcagattacgcagcaaagtatgttgtttaggttgttagtcacaagagttttcttttaattgaattgccgcagaacgtttttagagtgggggctggtaattatctttaatggatgttctgcaattgaatggaatgctgaactgatggtagtgactgtctggttaagtttagctggaatatatttaaaaacagattttctctatgtga

SEQ ID NO: 2554 - DNA, 1001 bp, Pinus taeda
  misc_feature (930)..(930): n is a, c, g, or t
  misc_feature (934)..(934): n is a, c, g, or t
  misc_feature (939)..(939): n is a, c, g, or t
cggccggggattattgtcgagagcaacagagcgattggcaattgagattcgatctcgaggtcttttggttgtggagatttgaagggggaaagatgtctggacggggaaagggaggcaagggtttgggaaaaggaggtgcaaagaggcacaggaaggtactgcgtgataacattcagggaattacaaagcccgccattaggcgtcttgccaggagaggcggtgtcaagcgtatcagcggccttatatatgaagaaacgaggggtgtactgaagatttttcttgagaatgtcatcagagatgccgtcacttacacagagcacgctaggagaaagactgtaaccgctatggatgttgtctacgccttgaaaaggcagggccgaaccctatacggctttggaggttaaagaacggggctctgttttttgttcatttaatgaattgctgatggcgttttcaaacgccataacttgctttctctggggatttgtaatcttgttggtgccgaagcaatgctgaattgctacttagagcatctgttaaatgtgtaaattgttcctctatgtgagggtttctctttagggtttcaattcaaatccaaatttgtatggaaaagctgttttcttatcaagctcctgatgttttgttaagtgtacattttagaatgcggtgtggatctttatattttgttataatagcaacgtatttatgttgtacgtttctacagacggtggggaaagcagactgtctgcagattacgcagcaaagtatgttgtttaggttgttagtcacaagagttttcttttaattgaattgccgcagaacgtttttagagtgggggctggtaattatctttaatggatgttctgcaattgaatggaatgctgaactgatggtagtgactgtctggttaagtttagctggaatatattnaaanacagnttttctctatgtgagggtttttatttagggtttcaattaaattccaaagaaataaatacagg

SEQ ID NO: 2555 - DNA, 763 bp, Pinus taeda
gaagaacggtgtagaggaaagtctgctgtggcgggtagggttcgaagcggagcgaacgagttttatttgaaagcctcagtcgcgaagaaacaagaaaacaagtacaatgtctgggcgcggcaagggcggtaagggtttgggaaagggaggcgccaagaggcacaggaaggtgctgagggataacattcagggcatcaccaaaccggccatcagacgtctcgctaggagaggaggagtaaagcgtatcagcgggctcatctacgaagagacgaggggagtcttgaagatctttttggagaatgtcattagagacgccgttacttacactgagcacgcaaggcgcaagactgtcaccgccatggatgtcgtctatgcgctcaagaggcagggcagaaccctctacggctttggcggttaacattgaactcatttgtttcgtttctagggtttaaatcctggttcaattttggggtagatatttattttgcctgtcaaattttgagataaaggtgtgttgtttgcacttaattaatgcaatgaatagattgcattaatccttatctattttcttgctccgtttttaggataagtcgattttttaccagagcaatggttggattgaatacgtactgttttgtctgtcttttcgcttacaatatgaactgtgaacaaatggctgaatggccaacgcgttgtctctgtaataaatatgctgagaaaactgctaaatgttatatatatatatgaaatagttgtgtattag

SEQ ID NO: 2556 - DNA, 763 bp, Pinus taeda
  misc_feature (229)..(229): n is a, c, g, or t
gaagaacggtgtagaggaaagtctgctgtggcgggtagggttcgaagcggagcgaacgagttttatttgaaagcctcagtcgcgaagaaacaagaaaacaagtacaatgtctgggcgcggcaagggcggtaagggtttgggaaagggaggcgccaagaggcacaggaaggtgctgagggataacattcagggcatcaccaaaccggccatcagacgtctcgctaggagnggaggagtaaagcgtatcagcgggctcatctacgaagagacgaggggagtcttgaagatctttttggagaatgtcattagagacgccgttacttacactgagcacgcaaggcgcaagactgtcaccgccatggatgtcgtctatgcgctcaagaggcagggcagaaccctctacggctttggcggttaacattgaactcatttgtttcgtttctagggtttaaatcctggttcaattttggggtagatatttattttgcctgtcaaattttgagataaaggtgtgttgtttgcacttaattaatgcaatgaatagattgcattaatccttatctattttcttgctccgtttttaggataagtcgattttttaccagagcaatggttggattgaatacgtactgttttgtctgtcttttcgcttacaatatgaactgtgaacaaatggctgaatggccaacgcgttgtctctgtaataaatatgctgagaaaactgctaaatgttatatatatatatgaaatagttgtgtattag

SEQ ID NO: 2557 - DNA, 704 bp, Pinus taeda
atcattcgtggagagcagcacagcaatcagcgagcgagattcgaactcgagatctacctacggatttttaaagggttaaagatgtctggacgtggaaagggaggcaagggtttgggaaagggaggtgcgaagaggcacaggaaggttctgcgtgataacattcagggcatcacgaagccggctatcaggcgtcttgccagaagaggaggcgtcaagcgtatcagcggtctcatctacgaagaaacgagaggtgttttgaagatatttcttgagaatgtcatcagggatgctgttacatacacggagcacgccaggagaaagactgtcacagccatggatgtcgtttatgctttgaagaggcagggccgaaccctctatgggtttggaggttaaggaggcgggttgtcccgattgatttcgtcttctgatggtgtctctagatgccacttctttgtctctttgggaactgtttcttcgaacttctgttttgttgtagggttttcattcaaatcggctctacaaataactcttttgtatcttcaggttagggagcactgtgtcgtgtataatgcagaatgtgatatctttatgatttgtggtacttgcaatgtatatatatcctttattttcctagaaaatatgcggaatattattgtgcacgggttgtattgtaattattttgaatgtttttatgggtagcgtgt

SEQ ID NO: 2558 - DNA, 685 bp, Pinus taeda
  misc_feature (436)..(436): n is a, c, g, or t
  misc_feature (574)..(574): n is a, c, g, or t
  misc_feature (595)..(595): n is a, c, g, or t
  misc_feature (628)..(628): n is a, c, g, or t
  misc_feature (642)..(642): n is a, c, g, or t
  misc_feature (668)..(668): n is a, c, g, or t
cagcaatcagcgagtgagattcgaactcgagatctacctgacggatttttaaagggttaaagatgtctggacgtggaaagggaggcaagggtttgggaaagggaggtgcgaagaggcacaggaaggttttgcgtgataacattcagggcatcacgaagccggctatcaggcgtcttgccagaagaggaggcgtcaagcgtattagcggtctcatatacgaagaaacgagaggtgtcttgaagatatttcttgagaatgtcatcagggatgctgttacatacacagagcacgccaggagaaagactgtcacagccatggatgttgtttatgctttgaagaggcagggccgaaccctctatgggtttggaggttaaggaggcggggtgtcccgattgatttcgtcttctgatggtgtctctagatgccactttttatntctttgggaactgtatggaactgtttcttcgaacttctgttttgttctagggttttcgttcaaatcggctctacaaataactcttttgtatcttcaggttagggagcactgtgtcgtgtataatgcagaatgtgatanctttatgatttgtggtacttncaatgtatatatatcctgtattttcctagaaantatgcggaatattnttgtgcacgggttgtattgtattatnttgaatgtttttatggg

SEQ ID NO: 2559 - DNA, 814 bp, Pinus taeda
gagaagctcccactaacgaatcccgtccttacctctactatttccttgatcgcaggtttgtgcttcttccttgagtttcaagtatgtctggtcgtggcaaaggtggcaagggtctgggcaaaggtggtgccaaacgccacaggaaagttcttcgtgacaatatccagggtattacgaagcctgcaatcaggcgtctggcgagacgtggtggtgtgaagcgtattagcggactgatttatgaagagaccaggggtgtcctgaagatctttttagaaaatgtgatccgtgatgccgtgacctacacagaacacgccaggcgtaagactgttacggccatggatgttgtctatgccttgaagaggcagggaaggactctctatggttttggcggttaaatttctctttgcaaagtcttgcggtcaagaactggtgtctttagacaccaccatttttcttttggggtttgaactcgagacgggatacacgttttggtatgcaatgttgctttctctgtcagttttcaaattgtagatgaggtgtaacatctggaatcggttctaaatgtccaggtatctaactttagggtttgttttagcattttggaaaagaactggcaaacagttagcttgtagcttctgttctacagaaacattttaatgtaagccctttggaacactagggtttacgaattcttgttagggttctttgattctgttgaatgtcactgtaataggcttttgatattgaaatgcttgagctttcagtttttaaaaaaaaaaaaataccagaacaccccccctaccatcccttatcc

SEQ ID NO: 2560 - DNA, 780 bp, Pinus taeda
  misc_feature (769)..(769): n is a, c, g, or t
gagaagctcccactaacgaatcccgtccttacctctactatttccttgatcgcaggtttgtgcttcttccttgagtttcaagtatgtctggtcgtggcaaaggtggcaagggtctgggcaaaggtggtgccaaacgccacaggaaagttcttcgtgacaatatccagggtattacgaagcctgcaatcaggcgtctggcgagacgtggtggtgtgaagcgtattagcggactgatttatgaagagaccaggggtgtcctgaagatctttttagaaaatgtgatccgtgatgccgtgacctacacagaacacgccaggcgtaagactgttacggccatggatgttgtctatgccttgaagaggcagggaaggactctctatggttttggcggttaaatttctctttgcaaagtcttgcggtcaagaactggtgtctttagacaccaccatttttcttttggggtttgaactcgagacgggatacacgttttggtatgcaatgttgctttctctgtcagttttcaaattgtagatgaggtgtaacatctggaatcggttctaaatgtccaggtatctaactttagggtttgttttagcattttggaaaagaactggcaaacagttagcttgtagcttctgttctacagaaacattttaatgtaagccctttggaacactagggtttacgaattcttgttagggttctttgattctgttgaatgtcactgtaataggcttttgatattgaaatgcttgagctttcagttttnaaaaaaagaag

SEQ ID NO: 2561 - DNA, 528 bp, Populus trichocarpa
cttcggtttccgagaaaaaactttaaattttccaagaagtggaagatgtctgggagaggaaaaggaggaaaagggctaggaaagggaggtgcaaagaggcacaggaaggtgttgagagataacattcaaggaattacgaagccagcaattagaaggctagcaagaagaggtggtgtgaagagaattagcggtctcatttatgaagaaacaagaggagttttgaagatctttcttgagaatgtgattcgcgatgctgttacttatacagagcatgctaggagaaagactgtgactgccatggatgttgtctatgctctaaagaggcaaggtcgtactttgtatgggtttgggggttagggttttttgtgtcttctgttctgtttgtatgggtttcctttgctaagaaattttaatctttcgtgagctgtaactgaaaatttggatctataatggaaagatttcgtcaattctgtcttttgtctattgtctagtcttttttttattaatcaaatgttgctatttgaggcc

SEQ ID NO: 2562 - DNA, 524 bp, Populus trichocarpa
ctttggtttccgagaaaaactttaaattttccaagaagtggaagatgtctgggagaggaaaaggaggaaaagggctaggaaagggaggtgcaaagaggcacaggaaggtgttgagagataacattcaaggaattacgaagccagcaattagaaggctagcaagaagaggtggtgtgaagagaattagcggtctcatttatgaagaaacaagaggagtcttgaagatctttcttgagaatgtgattcgcgatgctgttacttatacagagcatgctaggagaaagactgtgactgccatggatgttgtctatgctctaaagaggcaaggtcgtactttgtatgggtttgggggttagggttttttgtgtcttctgttctgtttgtatgggtttcttttgctaagaaattttaatcttttgtgagctgtaactgaaaatttgaatctaaaatggaaagatttcgtaaattctgtcttgtctattgtcttatctttttttattaatcaaatatctttatttgaagcc

SEQ ID NO: 2563 - DNA, 841 bp, Populus trichocarpa
atcacacaaacaaacaagtctctccctctggatttcgattcttcacctcgagattcaattccaagtctgcagttcagatcctctcattaattgaagaaaatgtctggacgtggaaagggaggcaagggtctgggaaagggaggagccaagcgtcaccgtaaggttcttcgtgataacattcaaggtatcacaaagcctgcaatccgccgtcttgctcgtaggggtggggtcaagcgtatcagtggtttgatctatgaagagactcgtggtgtactcaagatcttccttgaaaatgttataagagatgctgtgacctacaccgagcatgctcgccgcaagactgtcactgccatggatgtggtgtacgcactcaagaggcagggaagaactctatacgggttcggtggttagggcttttgattttagaataagtcttgctgtcaagaaatttgcgttttttggggattgtaattagattggtaattagggtttttaggtaagttaagggtttgcgttgatggatttaactttgagtttttgtttgggaatggaatggtggtgttcgggttcaaattttgatgggctctttgctttttacttaatggtttggaccttctgtcaatttttggaccgagctcctttgatagatagaggcggcgggattggagataacacacggtgttcgggtctcctcggaattcaactctgaaagattttgggaccctgaaggccatgtgctccgcttatcagggaagatgagttgaccccgtaaagaaggaaattattgcctattttttatttttaaaaaattatttttaatatcaaaatattaaaataattt

SEQ ID NO: 2564 - DNA, 854 bp, Populus trichocarpa
atcacacaaacaaacaagtctctccctctggatttcggttcttcacctcgagattcaattccaagtctgcagttcagatcgtctccttaactgaagaaaatgtctggacgtggaaagggaggcaagggtctgggaaagggaggagccaagcgtcaccgtaaggttctccgtgataacattcaaggtatcacaaagcctgcaatccgccgtcttgctcgtaggggtggggtcaagcgtatcagtggtttgatctatgaagagactcgtggtgtactcaagatcttccttgaaaatgttataagggatgctgtgacctacaccgagcatgctcgccgcaagactgtcactgccatggatgtggtgtacgcactcaagaggcagggaagaactctatacgggttcggtggttagggcttctgattttagaataagtcttgctgtcaagaaatttgcgtttttcggggattgtaattagattggcaattagggtttttaggtactgttttgtaagtaagtaaagggtttgggttgatggatttaactttgggtttttgtctggaaatggaatggtggtgttcggattcaaattttgatgggctcttggctttttacttaatggtttggaccttctgtcaatttttggaccgagctcctttgatagatagaggcgcgggattggagataacacacggtgttcgggtctcctcggaattcaactctgaaagattttgggaccctgaaggccatgtgctccgcttatcagggaagatgagttgaccccgtaaagaaggaaattattgcctattttttatttttaaaaaattatttttaatatcaaaatattaaaataattt

SEQ ID NO: 2565 - DNA, 735 bp, Populus trichocarpa
gggcctaaaaaccatcccgcttaaaaatttccacttccaaagtacccacgatcccgctctacccaattccaccaatcagattcaaggatacacaatccaatggtcaataacctaaatctcaatcctcacgcggatcgccatctgatccaacgaccaccacaccgccttgccttctataaaactaactctccaaactctacctcatcgaatcaaatcacattaaatcaaaaaacaaaactcaaagtctgtaaaaaaatgtcagggagaggaaagggaggcaagggattgggaaagggaggggccaagaggcatcgtaaggttcttcgtgataacatccagggtatcaccaagcctgcgatccgtcgtctagcaaggcgtggtggtgtcaagcgtatcagtggtcttatctacgaggagaccagaggcgtgctcaagatcttcctggagaatgtgattcgtgacgctgtaacctacacagagcacgcacgccgcaagacagtgactgctatggatgtcgtgtatgctttgaagaggcaaggccgtactctttatggttttggtggttaaaggaatttggggattttctgggctagtggtcgatttagggtgttttgtttgttcttgttaggtacgtgggttgataggctttaggtagacgtctaattcttgtattttcaaagctgcaagtgtctctctcttgatgcttgatctaaatgaaatgctccttttcctttt

SEQ ID NO: 2566 - DNA, 728 bp, Populus trichocarpa
gggcctaaaaaccatcccgcttaaaaatttccacttccaaagtacccacgatcccgctctacccaattccaccaatcagattcaaggatacacaatccaatggtcaataacctaaatctcaatcctcacgcggatcgccatctgatccaacgaccaccacaccgccttgccttctataaaactaactctccaaactctacctcatcgaatcaaaacattaaatcaaaaaacaaaatctccgtaaaaaaatgtcagggagaggaaagggaggcaagggattgggaaagggaggggccaagaggcatcgtaaggttcttcgtgataacatccagggtatcaccaagcctgcgatccgtcgtctagcaaggcgtggtggtgtcaagcgtatcagtggtcttatctacgaggagaccagaggcgtgctcaagatcttcctggagaatgtgattcgtgatgctgtaacctacacagagcacgcacgccgcaagacagtgactgctatggatgtcgtgtatgctttgaagaggcaaggccgtactctttatggttttggtggttaaaggaatttggggattttctgggctagtggtcgatttagggtgttttgtttgttcttgttaggtacgtgggttgataggctttaggtagacgtctaattcttgtattttcaaagctgcaagtgtctctctcttgatgcttgatctaaatgaaatgctccttttcctttt

SEQ ID NO: 2567 - DNA, 620 bp, Populus trichocarpa
tgaagagctctgcctcgtataaatacccggccaaacctctctatgcaaatcaccattcaagcacataaaaaaagagaagaagctctccactgttagatttttcgagaaaacaggaaagtttgcgaagatgtcgggaagaggaaagggcggaaaggggctgggaaagggaggtgcaaagaggcacaggaaggtgttgagagataacatccaaggaatcacaaagccagcaattagaaggctagcaagaagaggaggcgtgaagagaattagtgggctgatttacgaggaaactagaggggttttgaagatcttccttgagaatgtgattcgtgatgctgttacttacacagagcatgctagaagaaagactgtcactgccatggatgttgtctatgctcttaagaggcaaggtcgtactttgtatgggtttgggggttaggatttatcgggtcttctattttgcttgtattgatttcctttgcttaggaatttagatcttctatgggctggaattgaaaaattggatctgtaattgaaacaattttttaatcctgattcagctgttgccattttaggccaaaattgcttgcttcgttttaattctttttggacttgatgct

SEQ ID NO: 2568 - DNA, 812 bp, Populus trichocarpa
agataaaaaaaatcaagaaatatagagtgaaaaaagaagaggaaaaaatgtcagggagaggaaaaggaggaaagggactgggaaaaggaggagccaagaggcatcgtaaggttcttcgagataacattcagggcatcaccaagcctgcgattcgtcgactggctaggcgtggcggagtcaagcgtatcagtgggcttatctatgaagaaaccagaggtgtcctcaagatcttcttggagaatgtgattcgtgatgcagtcacctacacagagcatgctcgccgcaagacagtgactgcaatggatgttgtatatgctttgaagagacagggccgtactttatatggttttggtggttgattcagtgattcatgtactgggctgattgagttttaggtcttttagaactgggttgtggatagctgtatctcttgctacccaagtgtcatgtatctatgtgtttctgttttaatgcttgaatgaatggctcttaatttgtgtttctgtttcctttctgcttcttatgattcgcttcaattctgtgagccctcaatgtctcgaaacaaggtcgcgagccgatctgtttggcttcatgatacatatagggaaggagatcctgccaagggagattaagcatatattggccgaataaatcagtgtgattgagccaaaaacttggcggagctcaaaaggacagaggcaagtctgtccagtgtttgcttagaccctgtttgaatttgatatttttttgccctttaatttttttttttgtgattttggatgttaatattaaaaataaataaataaatctta

SEQ ID NO: 2569 - DNA, 815 bp, Populus trichocarpa
agataaaaaaaaatcaagaaatctagagtgaaaaaagaagaggaaaaaatgtcagggagaggaaaaggaggaaagggactgggaaaaggaggagccaagaggcatcgtaaggttcttcgagataacattcagggcatcaccaagcctgcgattcgtcgactggctaggcgtggcggagtcaagcgtatcagtgggcttatctatgaagaaaccagaggtgtcctcaagatcttcttggagaatgtgattcgtgatgcagtcacctacacagagcatgctcgccgcaagacagtgactgcaatggatgttgtatatgctttgaagagacagggccgtactttatatggttttggtggttgatttagtgattcatgtactgggctgattgggttttaggtcttttagaactgggttgtggatagctgtatctcttgctacccaagtgtcatgtatctatgtgtttctgttttaatgcttgaatgaatggctcttaatttgtgtttctgtttcctttctgcttcttatgattcgcttcaattctgtgagccctcaatgtctcgaaacaaggtcgcgagccgatctgtttggcttcatgatacatatagggaaggagatcctgccaagggagattaagcatatattggccgaataaatcagtgtgattgagccaaaaacttggcggagctcaaaaggacagaggcaagtctgtccagtgtttgcttagaccctgtttgaatttgatatttttttgccctttaatttttttttttttgtgattttggatgttaatattaaaaataaataaataaatctta

SEQ ID NO: 2570 - DNA, 611 bp, Populus trichocarpa
acaaaatcccacacgtctttctttctcgatctcgattcccacctggacattcaattccaagtctgcactttcgatcttctcatcagctagataaacatgtctggacgtggaaagggaggcaagggcctgggaaagggaggagccaagcgtcatcgcaaggtccttcgtgataacattcaaggtatcacaaagcctgcaatccgccgtcttgctcggaggggtggggtcaagcgtatcagtggcttgatctatgaagagactcgtggtgtgctcaagatcttcctggagaatgttatcagagatgccgtgacctacactgagcatgctcgccgcaagaccgttactgccatggatgtggtgtatgccctcaagaggcagggaaggactctgtatgggttcggtggttagggcttttaattttaaaataaaagtcttgctgtcaagaaaagggcttttgagggatcgggtttagatttgctaatcaggtttttttaggtactgttttgtaagtataagtgcgtgatgggttaatgttgaattttttttttttaatttttggaatggaaatggttctgtttcgaattcaacttttgatgggctcgtatttttta

SEQ ID NO: 2571 - DNA, 579 bp, Populus trichocarpa
cacaggcagctgcaatcataaagccaaattgagatttttgagagagaatcaaggagggttaagcaaagatgtcaggaagaggaaagggaggtaagggattgggaaagggaggagccaagaggcacaggaaagttcttcgtgataatatccagggtatcacgaagcctgcgattcgtcgtctggctaggcgtgggggagtcaagcgtatcagtggtctcatctacgaggagaccagaggagttctcaagatcttcctggagaacgtgattcgtgatgctgtgacatacaccgagcacgctcgccgcaagactgtgactgctatggatgttgtgtatgctttgaaaaggcagggacgcactctctatgggttcggtggttaaggggatctggggattttctgggctagtggtcgatttagggtttttatatgtttcttgggtatgtggtttgataggcattaggcttcagctttacaaatagtggtagatatctgattcctctacttgcaaaacgtcatgtatctctctctcttgatacttgttctatatgaaaagctcttagtacttcgtattctgtttc

SEQ ID NO: 2572 - DNA, 478 bp, Populus trichocarpa
catcagctagataaacatgtctggacgtggaaagggaggcaagggcctgggaaagggaggagccaagcgtcatcgcaaggtccttcgtgataacattcaaggtatcacaaagcctgcaatccgccgtcttgctcgtaggggtggggtcaagcgtatcagtggcttgatctatgaagagactcgtggtgtgctcaagatcttcctcgagaatgttatcagagatgccgtgacctacactgagcatgctcgccgcaagaccgttactgccatggatgtggtgtatgccctcaagaggcagggaaggactctgtatgggttcggtggttagggcttttgatttaaaataaaagtcttgctgtcaagaaaagggcttctgagggattgggtttagatttgctaatcaggtttttttaggtactgttttgtaagtataagtgcgtgatgggttaatgttgatttttcgggctcgaatttcttt

SEQ ID NO: 2573 - DNA, 616 bp, Populus trichocarpa
tataaataccaggccatacctctctatgcaaatcaccattcaagcacataaaaaaagagaaaaagctctccactgtttgattttccgagaaaatactcaagttttgcaggaaagtttgcgaagatgtcgggaagaggaaagggcggaaaggggctgggaaagggaggtgcaaagaggcacaggaaggtgttgagagataacatccaaggaatcacaaagccagcaattagaaggctagcaagaagaggaggcgtgaagagaattagtgggctgatttacgaggaaactagaggggttttgaagatcttccttgagaatgtgattcgtgatgctgttacttacacagagcatgctagaagaaagactgtcactgccatggatgttgtctatgctcttaagaggcaaggtcgtactttgtatgggtttgggggttaggatttatcgggtcttctattttgcttgtattgatttcctttgcttaggaatttagatcttctatgggctggaattgaaaaataggatctgtaattgaaacaattttttaatcctgattcagctgttgccattttaggccaaaattgtttgcttcattttaattctttttggacttgatgct

SEQ ID NO: 2574 - DNA, 593 bp, Populus trichocarpa
tcacaggcagctgcaatcataaagccaacttgagatttttgagagagaatcaaggagggttaagcaaagatgtcaggaagaggaaagggaggtaagggactaggaaagggaggagccaagaggcacaggaaagttcttcgtgataatatccagggtatcacgaagcctgcgattcgtcgtctggctaggcgtggtggagtcaagcgtatcagtggtcttatctacgaggagaccagaggcgttctcaagatcttcctggagaacgtgattcgtgatgctgtcacgtacactgagcacgctcgtcgcaagacagtgactgctatggatgttgtgtatgctttgaagaggcagggacgcactctctatgggttcggtggttaagggatctggggattttctgggctagtggtcgatttagggtttttatgtgtttcttgggtatgtggtttgataggcattaggcttcagctttacaagtagtggtagatatctgattcctctgcttgcaaaacgtcatgtatctctctcttgatacttgttctatatgaaaagctcttattgcttcgtattctgttttccatcttgattagctt

SEQ ID NO: 2575 - DNA, 572 bp, Populus trichocarpa
tcacaggcagctgcaatcataaagccaacttgagatttttgagagagaatcaaggagggttaagcaaagatgtcaggaagaggaaagggaggtaagggactaggaaagggaggagccaagaggcacaggaaagttcttcgtgataatatccagggtatcacgaagcctgcgattcgtcgtctggctaggcgtggtggagtcaagcgtatcagtggtcttatctacgaggagaccagaggcgttctcaagatcttcctggagaacgtgattcgtgatgctgtcacgtacactgagcacgctcgtcgcaagacagtgactgctatggatgttgtgtatgctttgaagaggcagggacgcactctctatgggttcggtggttaagggatctggggattttctgggctagtggtcgatttagggtttttatgtgtttcttgggtatgtggtttgataggcattaggcttcagctttacaagtagtggtagatatctgattcctctgcttgcaaaacgtcatgtatctctctcttgatacttgttctatatgaaaagctcttattgcttcgtattct

SEQ ID NO: 2576 - DNA, 624 bp, Populus trichocarpa
gccaatctgaaaagttgaaaaaaccccgctctgcccactatatatacccaacaaatctcactgcgttcaccaaaagtggaagtctctccctttggtttccgagaaaaactttaaattctccaagaaagcttgcgtggaagatgtctgggagaggaaaaggaggaaaagggctaggaaagggaggtgcaaagaggcacaggaaggtgttgagagataacattcaaggaattacgaagccagcaattagaaggctagcaagaagaggcggtgtgaagagaattagcgggctcatttatgaagaaacaagaggagtcttgaagatctttcttgagaacgtgattcgcgatgctgttacttatacagagcatgctaggagaaagactgtgactgccatggatgttgtctatgctctaaagaggcaaggtcgtactttgtatgggtttgggggttaggtttttttgtgtcttttgttcagtttgtatgggtttattttgccaagaaatctatatcttctgtgagctgtagctgaaaatttgaatctataatggaaggatttcgtcaattcagacttttgtctcttgtcttatctttttcttattaatcaaatgttgctatttgaggcca

SEQ ID NO: 2577 - DNA, 555 bp, Populus trichocarpa
ccaaaagtggaagtctctccctttggtttccgagaaaaactttaaattttccaagaaagcttgcgtggaagatgtctgggagaggaaaaggaggaaaagggctaggaaagggaggtgcaaagaggcacaggaaggtgttaagagataacattcaaggaattacgaagccagcaattagaaggctagcaagaagaggtggtgtgaagagaattagcgggctcatttatgaagaaacaagaggagttttgaagatctttcttgagaacgtgattcgcgatgctgttacttatacagagcatgctaggagaaagactgtgactgccatggatgttgtctatgctctaaagaggcaaggtcgtactttgtatgggtttgggggttaggtttttttgtgtcttctgttcagtttgtatgggtttattttgccaagaaatctatatcttctgtgagctgtaactagaaatttgaatctataatggaaagatttcgtcaattcagacttttgtctcttgtcttatctttttcttattaatcaaatgttgctatttgaggcca

SEQ ID NO: 2578 - DNA, 519 bp, Papaver somniferum
ctcaatctaaatcgattaaaaaaattaacagcaaagaaatttctgtagagagaaaaaaatgtcaggaagaggaaaaggaggaaagggtttgggaaagggaggagcaaagaggcacaggaaggtgttgagagataatatccagggaatcactaaaccagctatcagaagattagcaagaagaggtggtgttaagcgtatcagtggtttgatttatgaagagactcgtggtgttcttaagatcttcttggagaatgtcattcgtgatgctgttacctacactgaacatgccaggagaaagactgtcactgctatggatgtcgtctatgctctcaagagacagggaagaactctctacggatttgggggttagggtttacttttctccatcttgtaaagaatgttgagactagggtttcaatttgctgttctttttagtttcacatgtacctggaaatcaattagatgaatgtgaaatgtttttaatatcaatgaaaatcagtaatcaactcgtttctgttt

SEQ ID NO: 2579 - DNA, 526 bp, Papaver somniferum
gaaagaaaaaaatccagagagaaagaaatttcaatttcagaggaaaaaaaatgtcaggaagaggaaaaggaggaaagggtttgggaaagggaggagcaaagaggcatagaaaagttttgagagataacatccaaggtattaccaagccagctatcagaagattagcaagaagaggtggagtgaaacgtatcagtggattgatttatgaagagactcgtggtgttcttaagatctttcttgagaatgtgattcgtgatgctgttacttacactgaacatgccaggagaaagactgttactgctatggatgttgtttatgctttgaaacgacaggggagaactctttatggatttggaggttagggtttggttttcttaaaattggggttttttgtaaagttaatattagggtttgggtaatttctcttggtttaattagttgacaatgaagtaattcgaagctgttatgagctttgttttgatttgtaatgctttggaaatgaatgggaaatttcagtttcttggtt

SEQ ID NO: 2580 - DNA, 491 bp, Solanum tuberosum
ctttcaatcttccaaaattcaatttcaaaaccctgaaaaatgtcgggccgtggtaagggaggtaagggattaggcaaaggaggagctaagaggcacaggaaggtgttaagagataacatccaaggtattaccaagccagctattcgtaggcttgctcgtagaggtggtgtgaagcgtatttctggattgatttatgaggaaactcgtggagtgcttaagatctttcttgaaaatgtgattcgtgatgctgttacatacactgagcatgctaggagaaagactgtgacggctatggatgttgtttatgctcttaagaggcagggaaggaccctttacggatttggaggttagggtgttggttagtggttgtagatttgggtttttagtgaagttgggttactttttttgtttgtttgtatgatctcgatattgtaattccttgttacacaaacaattaatggaaggggatcgtatttcgagtaaaaaaaaag

SEQ ID NO: 2581 - DNA, 448 bp, Prunus persica
tcatctcaattctcagtatctccatctgcaaaacgacgccgtaagcttcgaagatgtctggccgtggaaagggaggcaagggcctgggcaagggcggagccaagcggcaccgtaaggtccttagagacaacatccagggcatcaccaagcctgcgattcgaaggctcgccagaagaggaggcgtgaagagaatcagcggcctcatctacgaagagaccagaggtgttctcaagatcttcttggagaacgtgattcgcgacgccgtgacctacaccgagcacgctcggaggaagacggtgaccgccatggatgttgtctacgcgctcaagaggcagggcaggaccttgtacggattcgggggttaattttgtaaattcagggatcgaatataaacggtccagattcggccttgtagcttttcgctataattcgaaatccaagtatcttt

SEQ ID NO: 2582 - DNA, 477 bp, Prunus persica
gaacacattcaaaatcaaactgtttgagaggtcagaaaaaaatttccgagaaaatgtcagggagaggaaagggaggaaaagggttgggaaagggtggggcgaagaggcacaggaaggtgctgagggataacatccaaggcatcaccaagcccgccattcgaagacttgctcgtagaggcggagtgaagcgcatcagcggcctcatctacgaagaaaccagaggggttctcaagatcttcttggagaatgtgattcgcgatgctgtgacttacactgagcacgccaggaggaagacggtgactgccatggatgtggtctatgctctcaagaggcagggacgaaccctctatggtttcggaggttaaatctagcatatgtaatcaaatcccttctttgatttggggcttttgtaaaacttgttatgagcgaacaaagtgtttgatggtttttgaatctgtaatggcatgatttttaagc

SEQ ID NO: 2583 - DNA, 507 bp, Pseudoroegneria spicata
cgacaagtcaacctcaccgaggagaagaagagggaagcgaagatgtcgggccgcggcaagggaggcaagggtctcggcaagggcggcgccaagcgccaccggaaggtgctccgcgacaacatccagggtatcaccaagccggcgatccggcgtcttgcgcggcgtggcggcgtgaagcgcatctcggggctcatctacgaggagacccgcggcgtgctcaagatcttcctcgagaacgtcatccgcgacgccgtcacctacaccgagcacgcgcgccgcaagactgtcaccgccatggacgttgtctacgccctcaaacgccagggccgcaccctctacggcttcggaggctaggccaaggcgaggcgaatccagctcgcaccacttggatcagatattcagattagcagtagctaggcgctgttcagtgttcatggtaattgatgtaatttatgatgtatgctgcttgttcgctggaatggatcaaattgctgttatttaccctta

SEQ ID NO: 2584 - DNA, 543 bp, Pseudoroegneria spicata
ccgttccgcagcttgagattccacattcgctcgcagcttcagatcgtcagccatgtccgggcgcggcaagggaggcaagggtctcggcaagggcggcgccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttccttgagaacgtcatccgcgacgccgtcacctacaccgagcacgcccgccgcaagaccgtcaccgccatggacgttgtctacgctctcaagcgccagggccgcaccctctacggcttcggcggctagggccggccgacggtcgtcactctttctcgccgcctgcagattccaaaagcctcatgaaaccccgacttgtttagttcgccatttcctctctagttcgaaatgaatcgtggaacaaaattattcgcatatgttgttggaaatgaaacttgtctctgtgctaatacagtctttctgattta

SEQ ID NO: 2585 - DNA, 556 bp, Pseudoroegneria spicata
  misc_feature (7)..(7): n is a, c, g, or t
  misc_feature (10)..(10): n is a, c, g, or t
ccattanctntctcagctcgaaccaagggtagatcgtcagccatgtctgggcgcggcaagggaggaaagggactcggcaagggcggcgccaagcgccacaggaaggtgctgcgcgacaacatccagggcatcaccaagccggcgatccggcgcctggcgaggaggggcggcgtgaagcgcatctctgggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgtaccctctacggcttcggcggctaggcccaggccgccgtcaatcttcgtccgcaacccatcgcgcgcctcctcgccgtctgcactgcttactgccatgtcttttgttcagtagttgtagctggaacaatgttacctgtcctcccatttgtctatcgcggaatctctctaactagcttgtagctctatgagcccagtcatgaaatcgactatatcgtcttcccgtgca

SEQ ID NO: 2586 - DNA, 586 bp, Raphanus sativus
  misc_feature (254)..(254): n is a, c, g, or t
  misc_feature (314)..(314): n is a, c, g, or t
  misc_feature (321)..(321): n is a, c, g, or t
  misc_feature (344)..(344): n is a, c, g, or t
  misc_feature (371)..(371): n is a, c, g, or t
  misc_feature (406)..(406): n is a, c, g, or t
  misc_feature (416)..(416): n is a, c, g, or t
  misc_feature (539)..(539): n is a, c, g, or t
tctaaccgagattcttattcagcataaaactttctcaaccggaaaaaaacatgtcgggccgtggaaagggaggaaagggtttggggaaaggaggggcgaagcgtcacaggaaggttctgagagacaacatccagggaatcaccaagccggcgattcggaggttggctcgtagaggtggagtcaagcgtatcagcggtctcatctacgaggagacgcgtggcgtcctcaagatctttttggagaacgtcatccgngacgcagtcacttacaccgagcacgctaggaggaagacagtgaccgccatggatgtcgtntatgctntgaagaggcaagggaggactctntacgggttcggcggttaatggcgtttnttagattcgcgtttgcgtttctgtgtttttttttntggggatttntaatcgaatcatgtttttcattagcgtttgcgttttgaattatgtttgggtacgggcgtttatgtgttgcggtagcgtttcgtttttatatgtaattagggcttttattagcgatgcaatgtngaatcaattccatggctaagtttctggagaaatataattcgaatttt

SEQ ID NO: 2587 - DNA, 1367 bp, Raphanus sativus
  misc_feature (208)..(208): n is a, c, g, or t
ctttaaacgaatcatatctttatatatcttggaaaaaaaatcagtaacaccaaaaatcttgacttacaaatcgaataacaaattacaaatataaaccaaaacgtatatgaaatcccacaaaaataataccaaataaaatatctttcactcatccctgctgcatcaacaacgttttaaaacttgttttcttcttcccttcttctaaggngtcttgttttggcacccaccaaaccctaatgctcttgtcaagacctccgctgtaaagcatgaatccagcacccacattgttgggtgaagcttgcaagcatttcaccggaccttcatgcccatgtatgactccaaatttacagagcttaccactctcttctctcttccacagtccgatgctctcaagacagagagagggagacagacactgagtgagcttgggagagcttgagacctcaagaactgaagactcgagagagtgagctaagcagtgtgagcttgagacaagagagccaaaacacagaagagagagagggagagctcgagctgcggcaaagaagagagagagctctgaagaccaagttccaccaggaaacctttaacgtgaagctgcctctgctgataaaagagggagtatccatataggcccattactagccacatacgaatgatgacgttggtctcttgtgacgcttaaacattctctcggatcgtcatccatatccgtacaataaaaacactaatccaacggctgcggttcacttcgtcttcctttataaacacaaatctcaatctccatcgtcacagtcaaaatcatcatatcaatctaaaaactccaatcgagaaagaagttccaaatgtcaggaagagggaaaggaggaaagggactgggcaaaggaggagcgaagaggcacaggaaggttctgagagacaacatccaaggaatcacaaagcctgcgatcaggcgtctcgctcgcagaggaggagtgaagaggatcagcgggttgatctacgaagagacgagaggggttctgaagatctttctcgagaacgtgattagagacgccgtgacttacacggagcacgcgaggaggaagacggtgacggcgatggatgttgtttacgctttgaagaggcaaggtcgcactctttatgggttcggtggttaaaacctgtttaatattattttcttttcggtttggtcctgttgctagttgctactgatattaagtcttgctgtcaagaaatctaagtaggtttaggcttctactcctttgctggttcgtttctttgtctgtatcaatgatcttatgaaaattccattatcaaatattctcccatcattctcgatcgaataatatttagtaagttttttcgta

SEQ ID NO: 2588 - DNA, 586 bp, Raphanus sativus
gggacacatcgaaaacacaccaaagcgaatctcaattttaaaaactttccgagaaaaggaaaatgtctgggcgaggaaagggaggaaagggtttgggaaagggaggagccaagaggcacaggaaggttctccgtgacaacatccagggcatcacgaagccggcgattcgccgtttagcgagaagaggcggcgtcaagcgtatcagcggcttgatctacgaggagactcgcggtgttctcaagatctttctcgagaatgtgattcgcgacgctgttacttacactgagcacgctcgtaggaagacggtgacggcgatggatgttgtctacgcgttgaagaggcagggacggactttgtatggattcggcggttgaggggatgatgagattggcgtttgtaaatcgcgtttggtctttagggtttgtttgatttctattaagctgcttttagggtttcgttttagaatgtttcaccggtttgaattaaatgaaacgcttctttttatctatttgcttctctgcaaaattgtcggtattaaagctgaatcttcgtgttaactaagaacaaattaaacaacttcgtacct

SEQ ID NO: 2589 - DNA, 516 bp, Raphanus sativus
ggactcacaaatcatctaattctccttcattcgattctagagtaagttcaaaaaaatgtcaggaagaggaaaaggaggaaagggacttggaaaaggaggagcgaagagacacaggaaagttctgagagacaacatccaagggatcacgaagcctgcgatcaggagactcgctcgcagaggaggcgtgaagcgaatcagcggcttgatctacgaagaaaccagaggtgttctgaagatctttctcgagaatgtcatcagagacgccgtcacttacaccgagcacgcgaggaggaagacggtcacggcgatggatgttgtttacgctttgaagaggcaaggacgcactctctatggattcggtggttaattatctcggtttgctgtttgctactgattaagtcttgctgtcaagaaatcttagagtgttttgtcggttcgtttctttgttagtgtttttataattgtagtactgtaatgaaagttcgatcactctattttaagttttttttttgtgcc

SEQ ID NO: 2590 - DNA, 601 bp, Raphanus sativus
  misc_feature (21)..(21): n is a, c, g, or t
ggatcgtcaaatctcattttncttgtaaatctccacctccgatcaatttaaacagatctaacagaaacgatgtcgggaagaggaaagggaggaaagggactgggaaagggaggagctaagaggcacaggaaagtgctgagggataacatccagggcatcaccaagcccgcgatccgtcgtctcgcccgcagaggtggagtcaagcgtatcagcggactgatctacgaggagaccagaggagtcctcaagatcttcctcgagaacgtcatccgcgacgccgtcacctacacggagcacgcgcgcaggaagactgttactgctatggatgtggtctatgctctcaagaggcaaggacgcactctctacgggttcggcggttaatcaacgagtggttgggggattagggttgttaaattgtagctaaatctttagcaatcttgtgctgttaagttctcaattgaaagtggtgatgtctttgttacttttgtcgtgtaatatgaatccaaactcgaaatttaattttcatactctgtcccatgcccatatattactgtgattcatgttattgataatacattgtactccgaagcgttgcaaagga

SEQ ID NO: 2591 - DNA, 581 bp, Raphanus sativus
gattcaccagtcctgtcatatcgtcaatcgcatttcgctatcctctccgatcgatttttcaggagcttcggaatcaagaaatgtcgggaagaggaaaaggaggaaagggattggggaagggaggagcgaagaggcacaggaaggtgcttagggataacatccaaggcatcaccaagcctgccattcgtcgtcttgctcgcagaggtggtgtcaagcgtattagcggcctcatttacgaggagaccagaggtgtcctcaagatctttctcgagaatgtcatccgcgacgccgtcacctacactgagcacgctaggaggaagactgttacggctatggatgttgtctatgctttgaagaggcaaggacgcactctctacggattcggcggttgatcaacgatgtgagattttagtaggagacggaattagtgtgtggaaatgtgttgtttctgttatcgtccacttgtttagtagtaaaaagtaaaacaaggagctgtttcttgttgagccaatttgatgttccatttagctagctaaaattcagcaatctctgcttggattcttaaatgaaaattctgtttg

SEQ ID NO: 2592 - DNA, 462 bp, Raphanus sativus
gggaatcaccaaacatatcactcttctctaatcgaagtttgaaatcttaatttttccagaggaaaaaaaaagatgtcagggagaggaaagggaggaaaaggattgggaaagggaggagccaagaggcatcgcaaagttctccgagacaacatccaaggaatcaccaaaccagcgatccgtcgtctggccagaagaggaggtgtgaagcgtatcagcggattgatctacgaagagactcgcggcgtcctcaagatctttctggagaacgtgatccgcgacgccgttacatacacggagcacgctcgccggaaaacagttacggctatggacgttgtgtacgctctcaagaggcagggaagaactctgtacggattcggcggttgattcgattgtttctgtttcagattttgtaaaatgtttttatgagaatcaatgggaataataatatggcatctttttcca

SEQ ID NO: 2593 - DNA, 518 bp, Raphanus sativus
  misc_feature (56)..(56): n is a, c, g, or t
  misc_feature (86)..(86): n is a, c, g, or t
  misc_feature (149)..(149): n is a, c, g, or t
  misc_feature (155)..(155): n is a, c, g, or t
  misc_feature (167)..(167): n is a, c, g, or t
  misc_feature (179)..(179): n is a, c, g, or t
  misc_feature (191)..(191): n is a, c, g, or t
  misc_feature (200)..(200): n is a, c, g, or t
  misc_feature (221)..(221): n is a, c, g, or t
  misc_feature (257)..(257): n is a, c, g, or t
  misc_feature (296)..(296): n is a, c, g, or t
  misc_feature (323)..(323): n is a, c, g, or t
  misc_feature (350)..(350): n is a, c, g, or t
  misc_feature (362)..(362): n is a, c, g, or t
  misc_feature (376)..(376): n is a, c, g, or t
  misc_feature (436)..(436): n is a, c, g, or t
tttttctgtaaatctccatctccgatcaattagcagatctaacagaaacgatgtcnggaagaggaaagggaggaaagggactgggnaagggaggagcgaagaggcacaggaaagtgctgagggataacatccaaggcatcaccaagccngcgatncgtcgtctcgcncgcagaggtggngtcaagcgtatnagcggcctnatctacgaggagaccagaggngtcctcaagatcttcctcgagaacgtcatccgcgangccgtcacctacaccgagcacgctaggaggaagactgtnactgctatggatgtggtctatgctctnaagaggcaaggacgcactctctacggnttcggcggttantcaacgagtggttnggggattagggttgttaaattggttgttaaaattgtagctaaatctttagcaatcttgtnctgttaagttctcaattgaaagtggtgatgtctttgttactttggtcgtgtaatatgaatccaaacttgaagtttaactttc

SEQ ID NO: 2594 - DNA, 531 bp, Raphanus sativus
gcattacggccgggggactcacaaatcatctaattgtccttcattcgattaaagagtaagtccaaaaaaatgtcaggaagaggaaaaggaggaaagggattgggaaaaggaggagcgaagagacacaggaaagttctcagagacaacatccaaggaatcacgaagcctgcgatcaggagactcgctcgcagaggaggcgtgaagcgaatcagcggcttgatctacgaagaaacgagaggtgttttgaagatctttctcgagaatgttatcagagacgccgtcacttacaccgagcacgcgaggaggaagacggtcaccgcgatggatgtagtctatgctttgaagaggcaaggacgcactctctatggattcggtggttaattatctcggtttgctgtttgctactgattaagtcttgctgtcaagaaatctagagtgttttgtcggttcgtttctttgttagtgtttttgtaattgcagtactgttattgaagttttatcgtttggtataatgaaagttcgattactcca

SEQ ID NO: 2595 - DNA, 508 bp, Raphanus sativus
ggacacatcaaaaacacacaaagcgaatctcaattttaaaaactttccgagaaaaggaaaatgtctgggcgaggaaagggaggaaagggtttgggaaagggaggagccaagaggcacaggaaggttctccgcgacaacatccaagggattacaaagccggcgattcgccgtttagccagaagaggtggcgtcaagcgtatcagcggcttgatctacgaggagactcgcggtgttctcaagatctttctcgagaatgtgatccgtgacgctgttacttacactgagcacgctcgtaggaagacggtgacggcgatggatgttgtctacgcgttgaagaggcagggacggactttgtatggattcggcggttgaggggatgatgagattgtcgttttgtaaatcgcgtttggtctttagggtttgtttgatttctattaagctgcttttagggtttggttttagaatgtttcaccggtttgaattttaatgaaacgcttctttttatcta

SEQ ID NO: 2596 - DNA, 596 bp, Raphanus sativus
ggacaaattcaactctaaccgagattcttattcagcataaaactttctcaaccggaaaaaaacatgtcgggccgcggaaagggaggaaagggtttggggaaaggaggggcgaagcgtcacaggaaggttctgagagacaacatccagggaatcaccaagccggcgattcggaggttggctcgtagaggtggagtcaagcgtatcagcggtctcatctacgaagagacacgtggcgtcctcaagatcttcttggagaacgtcatccgtgatgcagttacctacacggagcacgccaggaggaagactgtgaccgccatggacgtcgtctatgctctgaagaggcaagggaggactctctacgggttcggcggttaaggggcgttttagattcgcgtttgcgtttctgtgtttcttttctgggaatttctaatcgaattatgtttttcattagcgtttgcgttttgaattatgtttgggtactggcgtttatgtgttgcggtagcgtttcgttttatgtgtaattaggcctttgattaacgatgcaatgtcaatccatggttaagaagtttctggagaaatatgattaaattttattt

SEQ ID NO: 2597 - DNA, 582 bp, Oryza sativa
caggttccttgaagtccctcgaaggggacgagcgagcgcggcggccatgtcggggcgcggcaagggcggcaaggggctcggcaagggcggcgcgaagaggcatcgcaaggtgctccgcgacaacatccagggcatcaccaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgaggtccgccgctgcatccgcctggccgtggggacaagtcttggctcgcggtcaagaaatccgggaggatatctccaattgatctgggtctcagttagtagtagtagcagtagtttgtgttggcatcgttcttgtgcctggggcaagtttgctttcgtgttctgaacttgtgctgtgtaaatccgtatggtgttttagctattaacaaagttgggtcattcgctgc

SEQ ID NO: 2598 - DNA, 844 bp, Oryza sativa
accaagagccacagcgatttcagatctccccaagtagtagacttctctcttcttccatctcggattcgtctcggtctcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggagggggggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtagagagacccggatgtgccacgggtgggtttttagtagtaggattagtagtatcccaactcctggttgtgatttgctcatttccatagatgtaatgacattacgatttcaatcgtagcaaaattatttgtttcctgcatttctgatcccgttgctgctgtgatttgagatgtgaatgctgatctgaatttgcaacaaggggtaagctgttgttgaagcacgtacagtagttgagagaatcatctaaaagcaacagaatagtggtagtatctctgtatacgaagttcgaactatgctgcagaaaaaaaacacaacaaagtttcgaatt

SEQ ID NO: 2599 - DNA, 616 bp, Oryza sativa
acctcccacggatcgctccattttcacctccgcgcccaaacgcctcctcccaccgctataaataccccgcccatctcctccgcatctcacaagcaaaatccccaaatcctccagatcgtcttcgtcttccacctcgagctcttacgcatcgtcagccatgtcgggccgcggcaagggaggcaagggtcttggcaagggcggcgcgaagcggcacaggaaggtgctgcgcgacaacatccagggcatcaccaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagttcccggccccctgtgctcgatccagatctgatgccgttagcgttgcttagggtttcgttgcggaaattgtactacttcgttgtttctgcttgtgcaaagtgaatggatggttggattaaatgaatcattttctctcttgattagt

SEQ ID NO: 2600 - DNA, 595 bp, Oryza sativa
actccaatcaccaccgcttcttctcctcctccatttcctctcgttcctctctctctctctctctctctcgtgcggcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcgtgcctccatcccccatctctcccatgttgtctggccgtggaatccaccttgttcagttcgccgtttagttttgtagggtttacctgaatcatgaaactgtgaagcagatgatgtttgcacctgggatttgaattgaaacatgtttcagggccaatgttatggatctgtcc

SEQ ID NO: 2601 - DNA, 839 bp, Oryza sativa
aaatcccactccaatcaccaccacctcttctccaattccactcgcttttctctctctctcgtgcgtcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcaaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcttgcctccctccgccatctctcccatgtcgtctggccgtgcccacaagtcttgcggtcaagaaaaaaagtttgatggaaagccgtggaatccaccttgttcagttcgctgtttagtttttctagtgtttacctgaatcatgaaattgtgaagcaaatgatgtttgcaactgggatttgaattgaaacatgtttcagagccaatgttgtggatctgtcctcttgttgatgtgcaatttgtgtttgtccgttttgggatgaaattttgttttggttagtgcgatttggtgaacttaggctgagttcgatataggtttctggttgaaatctacattgcatattgggctgatacatcttgaaatgtgctatatattgatttgaccatcgctgaccaatactaagaacagcggatttgcagaatatcaa

SEQ ID NO: 2602 - DNA, 865 bp, Oryza sativa
atgcggagatcactagccagtagccacggcccaaatcacgcagaaccgtgcgcgcctaccggaaccacgaaattttcaatctctccccacaccgcaaaacgcgaaattttccacggcccccgcgcgcgggctccactccaccgaaaacccagccaaacgcgccagatccgcgcctcctccactcacacgcggatcgctccccgatccaacggcaggcgctgcccccccgcaccactcacgcggatcgctccccgatccgacggctgcccactcccctcccaactctatatatatccacccctcccaaaccaaaaatcctccacatccaaatctcgccaccaaaaaaatccccaattccgccgtcgtcttcgtcgccgtcgccgcgaggatgtctgggcgcgggaagggagggaagggcctgggcaagggaggcgcgaagcgccaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctccccccaaatatttctctctcttcgtgtcgaggcgtcgcgtgttggttgccctgtgtagattgctgatttcaatgtagtacttagattctggcagtgaagaactgcaagtaaacttgtttgaaattcaccttgttgctattaatctaatgcaagtttttgca

SEQ ID NO: 2603 - DNA, 721 bp, Oryza sativa
cctcctccccacctcatcaccaccgccgccaaccactcctcaccaagtcaaagtttcttcctcgcgaccggcggcgagcggcggcggcggcgatgtctgggagaggcaagggcggcaaggggctcgggaagggcggcgcgaagaggcacaggaaggtgctgcgcgacaacatccaggggatcacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctaggcgaggcgatgcgaggccacgcgattggatagggattcgattagtgccatgttcttcagttcgtcgtagtagcctagcctcttctcctgtagctgttgtttcatctcgtctcctgttccttcattaattagggatgtatgaactactggttcgttcgttcgaatggaataggaaatctgcagtgatttaccctctaaattcagttgcaatctcttgccgtgctatgtgaacgttttgcaacctgcattgttctagttggtgacactggttgacctgtattgcccaatttgttttgagcgattttgaaatttcaagag

SEQ ID NO: 2604 - DNA, 548 bp, Oryza sativa
ctccatctaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcc

SEQ ID NO: 2605 - DNA, 614 bp, Rosa hybrid cultivar
gatccattcgcaaaagcaaccaatatctctctctctcttaagcaaatccaatttctgatttgagctgagcaacgatgtccggccgcggcaagggaggcaagggtctgggcaaagggggagccaagcgtcacaggaaggtcctccgcgataacatccagggcatcaccaagcccgccattcgccgtctggctcgccgtggcggcgtcaagcgtatctccggcctgatctacgaggagacacgtggcgtgctcaagatctttctcgagaacgtcatccgtgacgccgtcacttacactgagcacgctcggaggaagaccgtcaccgccatggatgtggtgtatgcgctcaagaggcaaggaaggactctttacgggttcgggggttagggtttctggggatcaaagtcttgccgtcaagaatagattgtgttggttggtaatggaagaagtagtggtactagggtttaggtttgtatggtcttctattttgtaattactagtctggtttaggcttctgggaatctgaatgggtttctcctagtttgtaatttgcaattccttctctgaattgcggtttctgaagaaattgaaaagcctgttccttttgttactaaa

SEQ ID NO: 2606 - DNA, 530 bp, Rosa hybrid cultivar
gacaacaaaatcatcccaactctaacatctaaaccaaaatcagattttctctccttcaaattttccggtgaaaatgtcaggccgcggcaagggaggcaagggtttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgttacctacaccgagcacgcccggaggaagaccgtcaccgccatggatgtcgtctatgctctcaagaggcaaggaaggaccctctacgggtttgggggttaatttggggattttacttggtgggtttagtttaggactggttctaggtattttatgtttagatctgggtggaatgagtattgggttgttgaatttgctgttcatgtaatttgcaaccgtattttgaagtaatggaagtttaatttct

SEQ ID NO: 2607 - DNA, 546 bp, Rosa hybrid cultivar
gacacaacaaaatcatcccaactctaacatctaaaccaaaatcagattttctctccttcaaattttccggtgaaaatgtcaggccgcggcaagggaggcaagggtttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgttacctacaccgagcacgcccggaggaagaccgtcaccgccatggatgtcgtctatgctctcaagaggcaaggaaggaccctctacgggtttgggggttaatttggggattttacttggtgggtttagtttaggactggttctaggtattttatgtttagatctgggtggaatgagtattgggttgttgaatttgctgttcatgtaatttgcaaccgtattttgaagtaatggaagtttaatttctacaaaaaaaaaaaa

SEQ ID NO: 2608 - DNA, 513 bp, Secale cereale
  misc_feature (510)..(510): n is a, c, g, or t
aggcaaagcagttcctcttcttcctaatcacactctctcggagcggagatgtccgggcgcggcaagggtggcaaggggctgggaaagggcggcgccaagcggcaccggaaggtcctccgcgacaacatccagggcatcaccaagccggcgatccggaggctggcgaggaggggcggcgtgaagcgcatctccggcctcatctacgaggagacccgcggcgttctcaagatcttcctcgagaacgtcatccgcgacgccgtcacctacaccgagcacgcccgccgcaagaccgtcaccgctatggacgtcgtctacgcgctcaagcgccagggccgcaccctctacggcttcggaggctagatgcgtgtagtggagcaacttcctcgtttgctctgtgtgatatgtgctgtggtggattgatttactgatttggtgtgcggcgttgtatcctgtcttgggttcagtaggctgtgtaataccctgttctgttcaatgcaatcacttctattntga

SEQ ID NO: 2609 - DNA, 587 bp, Secale cereale
  misc_feature (547)..(547): n is a, c, g, or t
gttcttgcaaatccacatccgctcccagctcgaagaggatcgtgagccatgtccgggcgcggcaagggaggcaaggggctcggcaagggcggcgccaaacgccacaggaaggttctgcgcgacaacatccagggcatcaccaagccggccatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcacgctctacggattcggcggctaggccaccaccggaccagtagcctgatagtcgggtgtaatcgccgcagccatctcgctgctgtttgccctgcccttgtttgttgtctggatgtacttctgtactagtagtacggaatcgaaattgcagcagtttacccttgaattcggacctaatctgtcggtctgttgatgtttgttcgtgcgcgggncagatattaccagtgcgttcttcagttgtgttgctctgta

SEQ ID NO: 2610 - DNA, 574 bp, Secale cereale
ggcagccaccaccagaccggcagcgcgcgcacacacaccagccaagccaagcgaagctcgccggagagagaagcgccggagatgtccggccgcggcaagggagggaaggggctgggcaagggcggcgccaagcgccaccggaaggtgctgcgcgacaacatccagggcatcaccaagccggccatccggcgcctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctagcccgcgccggtccactcgagtccacctcacgccgccagccagattcgtagcatagctagctatggttgtccagtgttccattttcttcagtgtaattgccgcatctcgcttctgttgttcagtgttcagtgattggatgtacatcagtgataggatggaaatcgcagcattttaccctcga

SEQ ID NO: 2611 - DNA, 529 bp, Senecio madagascariensis
tggatcccccgggctgcaggctcaaatcaaaatcatttcaatcaaaccctaatctaccaaaaatgtcagggcgtggaaagggaggaaagggattaggaaagggaggagcaaaacgacatcgtaaggttctccgcgataacatccagggtatcaccaaacctgctatccgtcgtttggcccgtagaggcggtgtcaagcgtatcagtggtttgatctacgaagagacacgtggcgtcctcaagatctttctagaaaatgtcatcagagatgctgtcacctacaccgagcacgctcgccgtaaaaccgtcaccgcaatggacgtcgtctatgctcttaagagacaaggccgtactctctacgggttcggtggttagatctatagtatcagttttagtagtatgtgtaggtttactgttttcgttttgttgcgatttagatcctatctcagatctatagttttcatgtagtcacctcagaattatgtttcggtgaaatgttaatttgtgtttgcgtttaactgtgtgaaaaa

SEQ ID NO: 2612 - DNA, 445 bp, Senecio madagascariensis
tggatcccccgggctgcaggctttttcaaaaatgtctggacgtggaaagggaggaaagggtttgggaaaaggcggagcaaagcgtcatcgaaaagttctccgagacaacattcaaggaatcacaaagccagcaattcgaaggcttgccagaaggggtggagtgaaaagaatcagtggactgatttacgaagaaactcgaggtgtgttgaagatctttttggagaatgtgattcgtgatgcggttacttacacggaacatgctcgtaggaagactgttactgcaatggatgttgtctacgctctcaagagacaaggccgaactctttacgggtttggtggctaaatagatagatttaatcgatcaatatgttccctttggttttttatgtagtggatctttatgtaatgctaagtttatttattagatcaatctagtttttaaaat

SEQ ID NO: 2613 - DNA, 473 bp, Senecio madagascariensis
cgcagtcggtactccaacttttcaaatcattttcagttcgttcaacgatgtcgggccgtggaaagggaggaaagggacttggaaagggcggagcgaagcgtcaccgaaaagttctccgtgacaacattcaaggaattaccaaaccggcgatcaggaggcttgcgagacgaggtggtgtgaagcgtatcagtggattgatttacgaagaaacgcgtggtgtgttgaagatatttttggaaaatgtgattcgtgatgcggttacttacaccgagcacgctcgccgtaaaaccgttacagccatggatgtcgtttacgctctcaagagacaagggcgtactctgtacggatttggtggttaggctttatgttttggtttcagatctgtttgattactagtattatgtgtagagttgttttgatgtaattcaagcttgattgcggtttaatatgaatttcaatcgatttagctaaac

SEQ ID NO: 2614 - DNA, 460 bp, Senecio madagascariensis
taaactctaattcaacaaaatcatgtctgggcgtggaaagggaggaaagggactcggaaagggtggagctaagcgtcatcgcaaagttctccgggacaacattcagggtatcaccaaaccggccatcaggagactcgccaggagaggtggagtgaagagaatcagtggtttgatctatgaagagacacgtggcgttcttaagatcttcctagagaatgtcatccgtgatgctgttacctacaccgagcacgctagaaggaagactgtcactgctatggatgtcgtttatgctttgaagagacaaggaagaactttgtatggtttcggaggttaattgttagttagatctatgaaaatgaatgcttatgaattggttggtagtttttaaaatggtgacttgtaattgatgaagttttctctgatgttaatggaattaaatgaaaatgtttaatctttttac

SEQ ID NO: 2615 - DNA, 536 bp, Senecio madagascariensis
aaagcagtggtatcaacgcagagtacgcggggaccccaaattcaaaattcacaatccaaaccaaaatcagaaaaaatgtcaggaagaggaaagggaggtaagggattaggcaagggcggagcaaaacgacatcgtaaggttctccgtgacaacatccaaggaatcaccaaaccggccatccgtcgtctagctcgccgtggcggtgtgaagcgtatcagcggtttgatttacgaagagacacgtggcgtgttgaagatatttttggagaatgtgattcgtgatgcggtgacgtatactgagcatgcgagaaggaagacggttacggctatggatgttgtttatgctttgaaacgacagggaaggactctttatggttttggtggttagggttagggttagggttagggtttgtgtaagtggttaggtggtggtggattatcgttacggtttatgtttacttttcagatcttgttggttagtagtcttttgtgtagagtttttcgatgtaattgaagtttgattgcggtttaatatga

SEQ ID NO: 2616 - DNA, 430 bp, Sesamum indicum
ttcagattcatcctcggaagatcctccgtcgggagttcatataaattcattgagatcgtagagaatgtcaggaagaggaaagggaggcaagggtttggggaagggcggagctaagcgccacaggaaggtgctgagggataacatccagggtatcaccaagccggcgattcggcgtttggcccgtcgtggcggtgttaagcgcatcagcggtttaatctacgaggagactcgcggtgttttgaagattttcctggagaatgtcattcgtgacgccgtcacctacactgagcatgctcggcggaagacggtgaccgccatggacgtggtttatgccctcaagaggcagggacgcaccctttatggtttcggaggctaggattttctagggttacgattggatatggtgatatttgtgtagatttagtcagtt

SEQ ID NO: 2617 - DNA, 831 bp, Glycine max
cagtacagaaaacgcagttctcaccatttccctctcgattgtgagacttgttgttgttaactgaacttttctgagcaagaatgtctgggcgtggaaagggaggcaagggtttgggaaagggaggagcgaaacgacaccgtaaggtgctgcgcgataacattcagggaatcaccaagcccgcgattcggcgtttggctcgtaggggtggcgtgaagcgtatcagtggtctcatctacgaagagacacgtggcgtgctcaagatctttttggagaacgtgattcgtgacgccgttacctacactgagcatgctaggagaaagaccgttacggcaatggacgtggtttatgctctcaagagacagggaaggaccctctacggatttgggggctaggtttttttattttattgttaggttcttttgttttggaggctaatctggatttgagaaacccttgctgttatggatatagtaaaaagaaatggcaaggattgggtgtgggaagttgccggtggtgttgcagtaacttgtaatgcagtctttagctgttattgctggcaagtttgtaattgaatcactatatgttgctaatgttagaatcttggtattagtattattttcgcgtttggttattgttacctgaaattgtgttgtggacttgtgggtaatgagctagtggattgttgtttagtgatttagcgttttcgaaatggatttagttgaatgtgctagcaatgcagttttgcttggtcctctataggaccactttatcaggttggttcgcgtcgttattccctattagtgaaatattacttttgtaataatgttcagg

SEQ ID NO: 2618 - DNA, 650 bp, Glycine max
ccaaaacaagtgtacaagagtacaaccttttcaactccgaaggcgagccacgatgtcaggaagaggaaagggaggcaagggtttgggaaagggaggagcgaagaggcaccgtaaggttctgagggacaacatccaggggatcaccaagcctgcgattcggcgcttggcgaggcgtggcggcgtcaagcgtatcagcggtctcatctacgaagagacacgtggcgttctcaagatcttcctcgaaaacgtcattcgcgacgctgttacttacaccgagcacgctcgccgcaaaaccgtcactgccatggacgttgtttatgccctcaaaagacagggcaggaccctttacggtttcggtggttagttaggacattatggtaggctcttactcttattagtatcgaatcatatgttgctagatggatcttcacattgtaatggctgttgttgtttaatttctgttcccagcttatttttcttttagccgcgcttattaactgatcacttcttttgagtgataatgtgactagagatttttatttatttatttatttctgggtattgcgaacttgagggtggaaacattattataaaatgaaaaggaagtgcgtcgccgtttgcattgaatcatataatctttttataagcta

SEQ ID NO: 2619 - DNA, 743 bp, Glycine max
atcacatttaaaatcaaaacaacaaattttcagactcaacaagcttcgaaccaaatcttattgagaaaatgtctggtcgtggaaagggtggaaagggtttgggaaagggaggtgccaagaggcacaggaaggttcttcgtgacaacatccagggcatcacgaaacctgcgattcgtaggttagcgagaagaggtggcgtgaagaggatcagtggtttgatctacgaggaaaccagaggagttctgaagatattcttggagaacgtgattcgcgatgctgtgacctacactgagcacgctaggaggaagacggttactgctatggatgttgtttatgctcttaagaggcagggaaggaccctctatggttttggaggctaaaaagttcttagtgttattggattctattgcagcgaaaaaatacctgttcttttgaatcggtgtgatgttttggtttaggtttgttctgtaagatatgaagtttattctgttctgttctgcatagaaaatgtacaactttaattgaaattaaacgaaggagcaacgttttcgtgcttatacatttttttccacggttatgaagattttttcgctgtggttcttaggttattgcattgtgtggattaatttgggggtaatcgaaaactgtgtttaggttctgtttttaatgtagtttttgattgtaaaggagtgatatgttacgcattaagtaactgacaaattttcaattggaaatgctaggat

SEQ ID NO: 2620 - DNA, 624 bp, Glycine max
aagttagtttaatttgagtgtatattcagagagaaaaacgaagaaaacatcgtgaagcatgtctggaagaggaaagggagggaagggtctaggaaagggaggagcgaaacggcaccgtaaggttctgagggataacattcagggaatcacgaagcccgcgattcggcgtctggcgcgacgtggtggcgtgaagcgtatcagtggtctcatctatgaagaaactcgcggtgttctcaagatcttcctcgagaacgtcattcgcgacgctgtcacctatactgagcacgctcgccgcaagaccgtcactgctatggacgttgtttacgctctcaagaggcagggcaggaccctctatggtttcggtggttagagatttggggagtggattagggtttctcatcaatttcgttgttgatagttctttagctcttcttgtttgcctttgagttgtagctatgagaaattttaatatgtttatctgattaacttggatatatatatttatatcgtggcctgggtagattcattgttttctcgttattttgcttgtgccaaactgaatttaattgcaatgtttgttctttcggctaagttgaatttgattgttcaatttaattttgagtc

SEQ ID NO: 2621 - DNA, 729 bp, Glycine max
acctatcaagttaatttgcgtctatattcattttggcatcgaggttgaatctcatcggagagagaaaaaccataaccatgtctggaagaggaaagggaggcaagggtctcggaaagggaggagcgaaacgacaccgtaaggttctgagggataacattcagggcataacgaagcccgcaattcgccgtctcgcgagacgtggcggcgtgaagcgtatcagtggtctcatctacgaagaaacccgcggtgttctcaagatcttcctcgagaacgtcattcgcgacgctgtcacctacactgagcacgctcgccgcaagaccgtcactgccatggacgttgtttacgccctcaagaggcagggcaggaccctctacggtttcggcggttagagaattaccgatttctgcattgcgtcgtggattagggtttcttatagtgtcagtcaatttcgctgttgatattatgcaacggttctttagctgtagcttgagatttaacgattgttctttgagtcgtagttatgagaatttttagtatgtcaatttgattatatttatgccttcttgttactcagcatgcaacgctaaactgaaatttatttgcaatgttcttatgcctaagttgaatttgattgttcaatttaaatcgtgaaaggaatagtgtaatttaatcggattgcaatttttgttgcctcggtttgaggttgatgaagtaagagtcttcggtata

SEQ ID NO: 2622 - DNA, 747 bp, Glycine max
aaccaagtttgcttgcgtgtatattcattttagcatcaaggttgaatctcagagaaaaacaaacatcgacaagcatgtctggaagaggaaagggaggcaagggtctcggaaagggaggagccaaacgacaccgtaaggttctgagggataacattcagggaatcaccaagcccgcgattcgccgtctggccagacgtggtggcgtcaagcgtatcagtggtcttatctatgaagaaactcgcggtgttctcaagatctttctagagaacgtcattcgtgacgctgtcacctacactgaacacgctcgccgcaagaccgtcactgccatggacgttgtttacgccctcaagaggcaggggaggaccctttacggatttggcggttagacaattggggatttctgcactgcgtcctcgattagggtttcttatagtgtcaatttcgatgtttatattctgcaatagttctttagctgtagcttgaggtttagcaactgctcttgtttcgctttgggttgtagctatgagaacttttaatatggtaatcaagattaacttcaactttttatgatgtggcctggttaaatgcattgtttatttatgccttctcgttatttagcttgcccttatctaacatttagttgcaagatcgtgctatattcttaagcttaagttgaatttcattgttcaatttatattatggtcattgtcatctgcccgcgaaattaatgagacggtgatttaatca

SEQ ID NO: 2623 - DNA, 878 bp, Glycine max
atcgcagcgtcacattcaaaacaaactccgaaagaaacagtcagaatcagaatcagaagaagcgagcaaagatgtcgggtcgtggaaagggaggcaagggtttgggtaagggaggagccaagaggcacaggaaggtgctccgcgataacatccagggaatcacaaaacccgccattcgccgtttggctcgcagaggcggcgtcaagagaatcagtggcctcatctatgaagaaacccgcggcgtccttaagatcttcctcgagaacgttattcgcgacgctgttacctacaccgagcatgctaggaggaagactgttaccgctatggatgttgtttatgctctcaagaggcagggcaggactctctatggtttcggtggttaaattttagggttttgatgggcttagcagctggttatttttgtaaatggtcgtttgtttgggagtatttgattttgtgcttttttgttttttagcctttcttgttaggtgtattgttatttttgcttcaattgaaatggaacaaagagtgttttgtttctggaattctcttcttgttgaaggtgtacactgattacccgctagttaattgcgactttggagataaaatttgtgttaatttttgtggctgcaccatgcagtgcaaatataccctcgtgtttagtttgcagcttttgtgatcgttattgcgtctgttcttaccgtgctcaaagggtagccagaggttaagaggaacaagttgattcctaggtcgcggattagattgaaattaaatttctgctgttggtctagcttgcaattgattatatgtaagtgtaaatttttatattattagtgtgtaattttgttttctcttgagtttcatatttatttatgtaa

SEQ ID NO: 2624 - DNA, 660 bp, Glycine max
aattcaaatcaaaatcgcaaatcctcaaattcgatttcctaccaatttctctcgagaaaatgtctggtcgtggaaaaggtggcaagggtttgggcaagggaggcgccaagaggcacaggaaagttcttcgcgataacattcagggtatcacgaaacctgcgattcgtaggttagcgagaagaggtggtgtgaagagaatcagtggtttgatctacgaggaaaccaggggggttctgaagattttcttggagaacgtgattcgagatgctgtgacctacaccgagcacgctaggaggaagacggtgactgccatggatgtggtttatgcgctcaagaggcagggaaggaccctctacggttttggaggctaaagaatttaacccttcttttctgggttgcaggataagacattggttcttttgaatttgcgtggtgttttagtttaggtttgttatgtatcatacgaatctctggtttgcatagaaaatatttcatttgaaatttaaatggagtatcgtttctgttaggcatattatttcggctaaattagtttttttttcttctattctattttattatttaggtgtaatttgttttttttttatgttttgagattcaaatgatgatttaaaattatttaaagataaatttgaattgtca

SEQ ID NO: 2625 - DNA, 761 bp, Glycine max
atcatcaaatcaaaaaccctaattcccaaattctctcatttatcaagtttcaaccaagaaaagcagcaacaatgtcgggtcgcggaaagggtgggaagggtttaggaaagggaggagcaaagaggcatcgcaaggtgctccgcgacaatatccagggaatcacgaagcccgcgattcggagactggcgagaagaggtggcgtgaagagaatcagtggtttgatctacgaagagaccaggggcgtgctcaagatctttctcgagaacgtgattcgcgatgccgtgacgtacacggagcacgctaggaggaagacagtgacggccatggatgtcgtttacgctctcaagaggcagggaaggactctctatggtttcggaggctgagggtttggccttctttggtggctttggtttgtgtaaatggaaggaatttgtgttttgtagtgattatatatgtacttggattatcttctgctcggtacatgctcaaggttcttctgtttttttttttttaattctactagtaattgcatcctaattgttttgaattgaagtaaatttagtgaatgatgaatgttggatgttctatttctcgcatttattattgttagtagtggtgtgggagagataacttttaagtgggttgttaatgctaatattaatttgttccttttttgctttcttacaactgggattgatgtggagaagtttgatagttgattcttgtggtgttattttgaaacattgttttgtgttctttat

SEQ ID NO: 2626 - DNA, 693 bp, Glycine max
accgcgaaacgcacatttcactattcattctcgtttccctttcgactgtgattgtttgttaactgaacttttcgagcaaaatgtctggacgtggaaaggggggcaagggtttgggaaagggaggagcgaaacgacaccgtaaggtgttgcgcgataacattcagggaatcaccaagcctgcgattcggcgtttggctcgcaggggtggtgtgaagcgtatcagtggtctcatctacgaggagacacgtggcgtgctcaagatctttctggagaacgtgattcgtgacgccgttacctacactgagcacgctaggagaaagaccgttacggcaatggatgtggtttatgctctcaagagacaaggaagaaccctctacggatttggaggctagtttgtttttttttttttttttttaatttttattgttaggtttcgtttgttttggaggtttatgtgggatgtaagagacccttgctattagggagatagggaaaaaaattgcaaggatttggtgtagtaagttgctggtggtgttttaggtataagggtttctataacatgtaatgtattgagctatattgctgccaagcttgtaattgtatcacaatatgttgctaatgtcagattcttgtttttctgtttattgcttctgcttagtctatttagagcaatccaaacgcggcctacttttg

SEQ ID NO: 2627 - DNA, 768 bp, Glycine max
atcacaacactaacacaggtaaattaatttctcgtatcgaaaatcatttccaccaccacaatttttttttatttccgtttactaaagattagtaattgtttggtttgtgtgtagattttgattcgattcgattcgattcagtcgaggttttaagcagcagcaagatgtctgggcgtggaaagggaggaaagggattgggaaaaggaggagcaaaacgacatcgtaaggtgctccgcgacaacattcagggaattacgaagccagcgattcgtcgtttggctcgcaggggtggcgtgaagcgtatcagcggtttgatctacgaggagactcgcggtgttctcaagatcttcttggagaatgtcatccgtgacgccgttacttacacggagcacgctaggaggaagaccgttacggctatggacgttgtttatgcgcttaagaggcagggaaggaccctctacggatttggtggttagggtttttgcttgattttcctcgccagggaaaagtcttgctgtcaagaaaaacaaacgaggcatggattggggtagtttttttttattttttatggtggtgtttgtagtgaatggggaaaattaggagcaattttatgcttacttgttggtgtcaattatgtgatgtaactactccgttgaaatgtagaattattttggcttttaaaaatcgtttcgtaaatcaatttatagtttctatttaagttaattatgttttgctttttctcaaaatatttcttcctgttcttccttg

SEQ ID NO: 2628 - DNA, 678 bp, Glycine max
atcccatttgaaatcaaaatcaaaaacaccaaatcctctaattcaagtttgcaccaagttttcctgagaaaatgtctggtcgtggaaagggtggaaagggtttgggaaagggaggtgccaagaggcacaggaaggttcttcgcgacaacattcagggcattacgaaacctgcgattcgtaggttagcgagaagaggtggcgtgaagaggatcagtggtttgatctacgaggaaaccagaggggttctgaagatattcttggagaacgtgattcgcgatgctgtgacttataccgagcacgctaggaggaagacggttactgccatggatgttgtttatgctctcaagagacagggaaggaccctctatggctttggaggctaaagagttgtttttcttgttgtcccatgtgctcattttcttggatgctgaagatgtttaggttcattttgtaacataggatgcttgttcagtttaattttggatgtaaaatgttgaactatgattgaaattatatggactaattttttgttggtggaagtatagcttggaatggcctcacattgtttgtttgatattaggaaaatattgcagtgaattatgaaatgttttgacatggaaaaccgaatttagtaatctgatagttggcttgtttcctgcaatatgccgagtttctgct

SEQ ID NO: 2629 - DNA, 602 bp, Glycine max
attgggtagacgaaaaacaaaaagttggctctatataaaccccgcgtggcaaatcagagctcaattctgaatcagaagaagcgagcgaaaatgtcgggtcgtggaaagggaggcaagggtttgggaaagggaggagccaagaggcacaggaaggtgcttcgtgacaacatccagggtatcaccaaacccgcaattcggcgtttggctcgcagaggtggtgttaagagaatcagtggtctcatctacgaggagacacgtggcgtcctcaagatcttcctcgagaacgttattcgcgacgctgttacctacaccgagcacgctagaagaaagaccgttaccgctatggatgttgtttatgctctcaagaggcagggcaggactctctacggtttcggtggttaatttctagggtttccatcggcgtagcagctgcttattggttattgttgtaaatggttgctttttaggcttcttgttatatttgcttcaattgtaatggaacaaagagtattttgtttctggtatttgaatcttaatggttgaagttctcttaattgtcatggttactctgattatatgctagttaattgcgacttaagaga

SEQ ID NO: 2630 - DNA, 573 bp, Glycine max
aattcaaaccaaaatcccaaatcctcaaattcgatttgtaccaaattttcctccacaaaatgtctggtcgtgggaaaggtggcaaggggtttgggaaagggaggtgccaagaggcacagaaaagttcttcgtgataacattcaaggtatcacgaaacctgcgattcgtaggttagcgagaagaggtggcgttaagaggatcagtggtttgatctatgaggaaaccagaggagttctgaagattttcttggagaacgtgattcgagatgctgtgacctacaccgagcacgctaggaggaagacggtgactgccatggatgtggtttatgcgctcaagaggcagggaaggaccctctatggtttcggaggctgaatgattgattcttagtattattaaattatgttgcaggatataatattatgcctgttcttctgaaattcggtgtgatgtttagtttagattcgttctgtaacatatgaatcttcaaaggttctgttcggcacagaaaatgtactactttaattgaaattaaaatgaaggagcagcgttttcgtggtgcattttatagcttaa

SEQ ID NO: 2631 - DNA, 535 bp, Glycine max
atccaaattcaagttcgcaccaaattttcctcccaaaatgtcaggccgtggaaaaggtgggaagggtttgggaaagggaggagctaagaggcacagaaaggttcttcgtgacaacattcaaggaatcacgaaacctgcgattcgtaggttagcgagaagaggtggcgtgaagaggatcagtggtttgatttacgaggaaaccagaggagttctgaagatattcttggagaacgtgattcgcgatgctgtaacctacactgagcacgctaggaggaaaactgttactgctatggatgtcgtttatgctctcaagagacagggaaggaccctctatggctttggaggctaaagaatagaatctttaggtttaatgactgtgttgcaggataaaacattggttcttttgaatttgcgtgaagtttagtttaggttttggtttgttctgtaacatacgaagctatgtttgctcagaaaatgtaaaacttcaattgaaatctaaatgaaggagtgttgttttcgtggcgcatattttctc

SEQ ID NO: 2632 - DNA, 724 bp, Glycine max
attccaattcaaacagaaaacctaatttctcaaatttgatttcgcaccaaattttcctcactaaaatgtctggtcgtggaaagggtggcaagggtttgggaaagggaggtgccaagaggcacaggaaggttctgcgcgataacattcaaggaatcacgaaacctgcgattcgtaggttagcgagaagaggtggcgtgaaaaggatcagtggtttgatctacgaggaaaccagaggagttctgaagatattcttggagaacgtgattcgtgatgctgtgacctacactgagcacgctaggaggaagacagtgactgctatggacgtggtttatgctcttaagaggcagggaaggaccctctacggttttggaggctgaacaattctttttttggctgtgctcctatgtgcttgttctcttggatgctggtgatgtttaggttcatcctgtaacataggcttattcagctctagatgtaaaacgttgaaccgtaattggaattatatgaattagtacttttttgttggtggaaattatagctcgaaactttggcctcacgttttttatttggtattatcatgctctgcactggaatgttttgacatggaaactggtcttgtaatttagatttgataaaaggaaaggaaaagtacactattcaatgatgttttgtattgtataaaggttaattgaattttgatttgtgaaagagacaatatgctgaa

SEQ ID NO: 2633 - DNA, 1582 bp, Picea glauca
  misc_feature (28)..(28): n is a, c, g, or t
  misc_feature (728)..(728): n is a, c, g, or t
  misc_feature (803)..(803): n is a, c, g, or t
  misc_feature (897)..(897): n is a, c, g, or t
  misc_feature (943)..(943): n is a, c, g, or t
ttaattaaattaatcccccccccccccncattattgtcgagagcagcagagcgataggcaattgagattcgatctcgggaccttttgctagcggagatttgaagagtaaaagatgtctgggcgtggaaagggaggtaagggtctgggaaaaggaggtgcgaaaaggcacaggaaggttttgcgagataacatccagggcatcacaaagccggccatcaggcgtcttgccagaagaggaggcgttaagcgtatcagcggcctcatatatgaagaaacgagaggtgtgttgaagatctttctcgagaatgtcatcagggatgcagttacttacacagagcatgcaaggagaaagaccgttactgccatggatgtcgtctatgccttgaaaaggcagggccgaaccctatacggatttggaggttaaggaaggagggctctggtttcctctttttaatggattactcatggtgtttcttaacaccaccattgtgcttctttgggaacttgtaagcatgttatcgctgaagccatgttgaattgcggctttgagcatttgttatatgtgtaaattgtctttttgtgcgagggtttctatttagggtttcgattcaaatccgaatttgtatggaaggactatttttgtattttaaatttatgatattttcttaaatgcgcatcgtaaaatgcaatgcagtatgaatgttcgtattttgccacactagcaactngtatcggttatatttctaaaaagggttgtcagtctttatgatgcctctttctaactgttgtgttgttttccttgnttctcatgaaacaaggtaaaatggtgctagggttaactgatgtttctgaaagtggatcacctgttatacaatgcttggtaatctaagcattaantgtatttgttttctcattcaatggacaatggttttatttggtaaanaataatattagattccgcatcagtttatcttgtaggattttggtcgaaatattgattgcattgcaattttgtggtatatgtgccttgagattttgtgtgcattttgcttcctttgagatcggagatgtttaggcagttttttatcctgtcggaggtattcaattattcaaactaatcaagttacaatattgaagaattggtttctagagccatagctgtggttcacaagataagtgagatcttgaatctctttcaaaattatggaaaatctacgaagagtcgcattctgctattttcgtcttttctgtaatatgctgctcagtctatttctcatagagcactgttatgtgcatagggaacaccaaacactctgaattagttttatattgctctgccatatttgtaactgtaagcttgtgttcatcataaaaggttatcgtctgtataagtcacacgatatatagtgagctactgcgagagattaaaactagacttgattttgaagtatctagtcacgttgtaaagggcactttccggtgagtctctcacttgcaagtactttgaggggccgatgaattgttcaccaatatttctttaactttgaaaccctcttgggtgattgaattttttctcaaaaaa

SEQ ID NO: 2634 - DNA, 695 bp, Picea glauca
cccccccccccccgagaaccgtgttgaggaagtctgctgtggcgtgtagggttcgaattgcagcgagcgagtttgatttgaaagccctcagtctcgaagaaacaagaaaacaacaacaatgtctggccgcggcaagggtgggaagggtttgggaaagggaggagcgaagaggcacaggaaggtgctgagggataacatccagggcatcaccaagcctgccatcagacgtcttgccaggagaggaggcgtcaagcgtatcagcggactcatctacgaagagaccaggggagtattgaagatctttctggagaatgttatcagagacgccgtcacttatactgagcacgcaaggcgcaagactgtcaccgccatggatgtcgtctacgcactcaagaggcagggcagaaccctctacggctttggcggttaacgtccaactcatctgtcttcacttgtttcatctctagggtttttggttaattttattttctggttcaattttggggaagatatctgtgttgcctgccgaatcttgtactatattactatatgttgtttgtattgaactagtgcaatggatagggtgcattaatctatatatatgtgcttcctctgtttcccagaggaaccgatttctcaccagaacaagtattggattggataatgtattattttactccttttatctgttttca

SEQ ID NO: 2635 - DNA, 894 bp, Picea glauca
ccccccccccccccccgattccatcgttggtttgaccgagaagcttctcttcataatcccgttcttccctctaatattttcttgatcgcgggcgcgtgtttcttctttgagattcgaagatgtctgggcgtggcaagggcggtaagggtttgggcaaaggtggtgccaagcgccacaggaaagttcttcgtgataatattcagggtattacgaaacccgcaatcaggcgtctggcgaggcgtggtggtgtaaagcgtatcagcgggttgatctatgaagaaaccaggggtgtactgaaaatcttcttggaaaacgttatccgtgatgctgtgacctacacagaacacgccaggcgtaagactgttacagccatggatgtcgtctatgccctcaagaggcagggcaggaccctgtatggttttggcggttaaatttctctttgcaaagtcttgcggtcaagaactggtgtctatagacaccaccttttttcttttgggatttgaactcaaggcgggatacgtgttttggtatgtaatgctgctttctctgtcagttctcaaagtgtagatgtgatttagcaggtggaatcggtcctaaatgtagaagggccctattttagggttactggttggggtggaattagtttgttttagtatctgtgtccagggctggtaaacaaatctgtagtatcttttaacctccgtgcttcgaaaaatgtgctaatggaaatccgttggaacgttagagttgtcggaattttgttagggttttgaatttttattgaatatcactgtcacgggttcttcatgtactgattatttttttctctttgtatttttgagtttattaaatgtgtgtggtttcattgcaaaaaattaaatgtttgtgggtttc

SEQ ID NO: 2636 - DNA, 810 bp, Picea glauca
cccccccccccccgaaactcattattcgtcgagagcagcacaccagtcagctactgagattcgaactccagatctacccagattttcaacagtaaagatgtccggacgtggaaagggaggcaagggtttgggtaaggggggtgcgaagaggcacaggaaggttttgcgggataacattcagggcattacaaagccggccatcaggcgtcttgccagaagaggaggcgtcaagcgtattagcggtctcatctatgaagaaacgagaggtgtgttgaagatatttctcgagaatgtcatcagggacgccgtaacatacacagagcacgccaggagaaagactgtcacagccatggacgttgtttacgccttgaagagacagggccgaactctctacgggtttggaggttaagaaggagggaggatgcctctttcagtcatttcattgcatattttgatggtgtctctagatacccctttttcgaccttttgggaactagtaagcttgatagcactgatagcatcctgaattgttgcttcaagcatttgttttgtggtagttttttaattttcagtgttgttttaagggtttttgattcaaatcggggttgcaagggaagaactctttagcatctttgggttagggagcttatatggtgtatgatgcataatgtggtatggatctttaggatttgtggtatttgcaatgtatatatcctacatgttcttggaaaggacgcggaatacaattgtgcacgggccgtattgtaattaatgttgttatgtgattatttacttttgtttatttttcat

SEQ ID NO: 2637 - DNA, 599 bp, Picea glauca
tgtggcgtgtagggttcgaatcgcagcgagcgagtttgatttgaaagccctcagtcgtgaagaaagaagaaaacaagaacaatgtctgggcgcggcaagggcggtaagggtttgggaaagggaggagcgaagaggcacaggaaggtgctgagggataacattcagggcatcaccaagcctgccatcagacgtctcgccaggagaggaggcgttaagcgtatcagcggactcatctatgaagagacgagaggtgtcttgaagatctttctggagaatgttatcagagacgccgtcacttacactgagcacgcaaggcgcaagactgtcactgccatggatgtcgtctatgccctcaagaggcagggcagaaccctctacggctttggcggttaacatccatctcatttgtcttaacttgtttcatcgccagggttaaaatcctggttcaattttggggaaggtatctgtcttgtctgtcaaatcttgtactgtattacgatatgttgtttgcactgaattaatgcaatgtataaattgcattaatctatatctattttcttgttccgttttaaagaggaagcaatttcttacctgaaaaa

SEQ ID NO: 2638 - DNA, 553 bp, Euphorbia esula
  misc_feature (11)..(11): n is a, c, g, or t
  misc_feature (476)..(476): n is a, c, g, or t
ctctaattccnctttcaattaactcaattcgaagatgtcaggccgaggaaagggaggaaaggggcttggaaagggcggagcaaagcgtcaccggaaagttctccgggataatatccagggaattacaaagccagcgattcgtcgtcttgctcgtagaggtggagttaagagaatcagcgggttgatctatgaggaaacccgtggagttttgaagatatttttggagaatgtgatccgtgatgctgtgacttacacagagcacgccaggaggaagacggtgactgccatggatgtggtttatgctttgaagaggcaaggaaggactctctacggtttcggaggttagaagaggaacgagatccgtcgacggataagtcttgctgtcaagaaaatgtggaggcggcgtgcttagggtgttgttaggataatgtttagggtttgtgttaaatggtatttgtgtaattacttggggagtnttttagaggttgctgtaatttcactctttcaatgaaatatcgttctattttcagaagaaagaagaaaaaaaatgcgt

SEQ ID NO: 2639 - DNA, 561 bp, Euphorbia esula
  misc_feature (9)..(10): n is a, c, g, or t
  misc_feature (65)..(66): n is a, c, g, or t
  misc_feature (68)..(68): n is a, c, g, or t
  misc_feature (439)..(439): n is a, c, g, or t
  misc_feature (445)..(445): n is a, c, g, or t
  misc_feature (461)..(461): n is a, c, g, or t
  misc_feature (467)..(467): n is a, c, g, or t
atccggcgnngttttcaaaatcaagcagtcgttctccttgaaattgaaaacagagagaagaatcnnanagaatgtcaggaagaggaaagggagggaaaggattgggaaaaggaggagccaagaggcacaggaaagtgctgagagataacattcaaggaattacgaagcctgccattagaaggcttgctcggagaggaggcgtgaagcgtattagcggtctaatttatgaagagactcgaggtgtgctcaagatcttccttgagaatgtgattcgtgatgctgttacttacactgagcatgccaggagaaagactgtcaccgccatggatgttgtttatgctctcaagaggcagggtcgcactctctacggctttggcggttaattaatccctaactttgattgtttgtagcgcctgtatatttttttagatctaagtcnattttnctttattgcttatttnaagctncaattggaaccattatcagtctttatgtgctccaattttcatgatattttggaattcacctgtgtttttgctaattgaaagcttctattgaatc

SEQ ID NO: 2640 - DNA, 562 bp, Fragaria vesca
ccacacaaccaattcaagctctcttcgactcgcttctatacctctccgatattctgaatcagagctcttaggttgaatcaacaatgtctgggcgtggaaagggaggcaagggactgggaaagggaggagcaaaacgacaccgtaaggtcctccgtgacaatattcagggtatcactaagccggccatacgtcggttggctcgcagaggaggagtcaagcgtatcagtggcttgatttatgaggaaacaagaggggtgctcaagatttttcttgagaatgtgatcagagacgccgtgacctacactgagcacgctcgccgcaagactgtgactgccatggatgtggtgtatgcgttgaagaggcaaggcaggactctgtatgggtttggtggctagaggggttttggggtctttacaagtcttgctgctgtcaagaaaatggaaaatgggtttagggttgtgttttagtttggtttaggtgttgaagaaattgtaattagggtttggaattgaaatttaatggaatggaatggtggtgtttgatctgaaaaaagaaaaaaaaa

SEQ ID NO: 2641 - DNA, 503 bp, Fragaria vesca
caaaatcagagtctctccttcaaattttccggtgaaaaatgtcaggccgcggcaaaggaggcaagggattgggaaagggaggagccaagcgtcacaggaaggtcctcagggataacatccagggcatcaccaagcccgccattcgccgtctcgctcgccgtggcggcgtcaagcgtatctccggtctcatctacgaggagactcgtggtgtcctcaagatattcctcgagaacgtcatccgtgacgctgttacttacactgagcacgcccgcaggaagaccgtcaccgccatggatgtcgtctatgctctcaagaggcagggaaggaccctctacggattcgggggttgatctgggaactcttttatcaatattgggtcttaaatttagtagttattctagtggtctaatgttagatctgggtttcattagtttttgatttctgaacttgctgttcatgtaatttgtgattattttgggtaaatggaagtttattttatcggt

SEQ ID NO: 2642 - DNA, 462 bp, Fragaria vesca
ccggtgaacaatgtcaggccgcggcaaaggaggcaagggattgggaaagggaggagccaagcgtcacaggaaggtgctgagggataacatccagggcatcactaagcccgccatccgccgtttggctcgcagaggcggcgtcaagcgtatctccggtctcatctatgaagaaaccagaggcgtcctcaagatcttcctcgaaaacgtcatccgtgacgccgtcacctacactgagcacgcccggaggaagaccgtcaccgccatggacgtcgtctatgctttgaagaggcaggggaggaccctctacggatttgggggttaaatcgttgggtgttggtttagggttgcttccaggattggagtttagatctgggtgctatggatattctgtaataaaattagctgttcatgtaatttgtaccctcatttcgaagtaatagtagtttgttatgtttttgcatc

SEQ ID NO: 2643 - DNA, 730 bp, Saccharum officinarum
  misc_feature (654)..(655): n is a, c, g, or t
  misc_feature (700)..(700): n is a, c, g, or t
ctccccttcacacgagcgcaaacacaaccacccacccacaacttccaagcaggggaggcgaccggcggcggagatgtcgggcaggggcaagggcggcaaggggctcgggaagggcggcgcgaagcgtcaccggaaggtgctgcgcgacaacatccagggcataacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctaggttaggtcagggtagttgcctgtcgaggcgtctcggatcggtgatactagtttggttaccttcctgtgttcgtctggtagttgctgtagtggttgtaactggttgatttgtccgtcatgttgtgtgcgtctgtaagcaccgctggttcgatggaattggaatggatgacgaagtacgaaagttatccagtttgatttgaaacatgctccaatgtagcgttgcctctaattggatatctcgcaattggttccaattgtgcacgcacttannccaaatcccacacctcacacctccatccaccataccaccatcctnacaccctcacacacaacctcacatgctcac

SEQ ID NO: 2644 - DNA, 774 bp, Saccharum officinarum
  misc_feature (747)..(747): n is a, c, g, or t
  misc_feature (750)..(750): n is a, c, g, or t
aaagcgttcgcctgcgctaccggtccggatttgaaggctctacccacgcggtaccggttacgattggccgggtataccgacgcgtgctatcaccttcatgcccgccgcctgcagtctactactccgaggaaacccatcacccacccgagcggaagaagccatgtctgggcgcggcaagggcggcaaggggctcggcaagggcggcgcgaagcgtcaccggaaggtgctgcgcgacaacatccagggcatcaccaagccggcgatccggcggctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctggtgggctcccctcgatgttcccccttctgcagctgcgatgttgtctggccgtgccaacaagtcttgcggtcaagaaagtttcaggaactctttgtagttcatctctggctgtagtaggtttatctgaattgtaagactgtagcaggtttacctgaatcatgcagtatcgaaatcatgtgaacatcagatgttggaaatcaaagcttgttttgcaacctgtcattcctcaatgcaagtgaatgtattatgctgggccgtcttttctggtccnaanaatgaatctggaggattataatat

SEQ ID NO: 2645 - DNA, 685 bp, Saccharum officinarum
aagctggtcgcctgcagtaccggtgcagaattcccggatcgaccgactcatccacgcgtccgcccacccacgaaatccccaattcccaacctcacctccgagttcgagcgaccatgtcggggcgcggcaagggcggcaaggggctgggcaagggcggcgcgaagcgccaccgcaaggtcctccgcgacaacatccagggcatcacgaagccggcgatccggaggctggcgaggaggggcggcgtgaagcgcatctcggggctcatctacgaggagacccgcggcgtgctcaagatcttcctcgagaacgttatccgcgacgccgtcacctacacggagcacgcccgccgcaagaccgtcaccgccatggacgtcgtctacgcgctcaagcgccagggccgcaccctctacggattcggcggctgaggggtgccccccgccgctggtggccgtggcaaaagtcttgggtcgcggtcaagaaatcgagggaggcgagggtattctggcccatatgcttagtttcgtagtcttatcggtagtgcttattgttacggttgttgggttcgatcactctagagccatggtcaagtagtagtatatgagttgtaccgcatttccttgtcttatgaacttcccatgtatgaaatgtggattcacttgatatcccgtggacaactggctaattc

SEQ ID NO: 2646 - DNA, 570 bp, Saccharum officinarum
ctccccttcacacgagcgcaaacacaaccacccacccacaacatccaagcaggggaggcggccggcggcggagatgtcgggcaggggcaagggcggcaaggggctcgggaagggcggcgcgaagcgtcaccggaaggtgctgcgcgacaacatccagggcataacgaagccggcgatccggaggctggcgaggaggggcggcgtgaagcgcatctccgggctgatctacgaggagacccgcggcgtgctcaagatcttcctcgagaacgtcatccgcgacgctgtcacctacacggagcacgcccgccgcaagaccgtcaccgccatggacgtcgtctacgccctcaagcgccagggccgcaccctctacggcttcggcggctaggttaggtcagggtagttgcctgtcgaggcgtctcggatcggtgttactagtttggttaccttcctgtgttcgtctggtagtggttgtaactggttgatttgtccgtcatgttgtgcgtctgtaagcaccgctggttcgatggaattggaatggatgacgaagtaggaaatttatccagtttgatt

SEQ ID NO: 2647 - DNA, 695 bp, Saccharum officinarum
atacattttcccaggaacagcttgccatgttcgccagcttaatcgaccctataggaaagctgtcgctccaggaccggtcggatttcccggtcgaccacgcgccgccaattcttcttctccgtcagagaagagggcccgtgcgaggcggcggcggcggcgatgtcggggcgcggcaagggaggcaagggtctgggcaagggcggcgcgaagcggcaccggaaggtgctccgcgacaacatccagggcatcaccaagccggcgatccggaggctggcgcggaggggcggcgtgaagcgcatctcggggctcatctacgaggagacccgcggcgtgctcaagatcttcctcgagaacgtcatccgcgacgccgtcacctacaccgagcatgcgcgccgcaagaccgtcaccgccatggacgtcgtctacgcgctcaagcgccagggccgcaccctctacggcttcggaggctaggcgcctcttcgtagctggggaacggttggggaatatttctctctgtcgctgtgggtcgtagtgttgctgcagttgctgcgttcgtggatgtaatcctacagtatgtttctgcaatgaagaaatgcgagtaatgatgctctgccactagtaatcatgctacgtatgttgtctgggtgattgttttccggagaaatagtagtaacagtaactcgtcaggaaccaag

SEQ ID NO: 2648 - DNA, 759 bp, Saccharum officinarum
cgcggcgaattcgaatcccacaatttttgtagcacacaccaccgtcactcgagtcttctttcctcttcggcggcgatgtctgggcgcggcaagggcggcaaggggctgggcaagggcggcgcgaagcgccaccgcaaggtcctccgcgacaacatccaggggatcacgaagccggcgatccggaggctggcgaggaggggcggcgtgaagcgcatctccgggctcatctacgaggagacccgcggcgttctcaagatcttcctcgagaacgtcatccgcgacgccgtcacctacaccgagcacgcgcgccgcaagaccgtcaccgccatggacgtcgtctacgcgctcaagcgccagggccgcaccctctacgggttcggcggctgagcgcgtgcgcgtctcctccgtcctctgctgctgctgctcgttccgccttacgtactcctttcggatccctgttccgtgctttccttgatgtagacagttatcggattcttaggtctcttccgtgtctcgttattaggtggaatcatgtgtccctagtagcactgaaagttcaacacccagttgtatcttcctttgcagcaatgaaatgttaagtctgattggctattattccctgtgaagataaatagattatagggtggatcgctttataggatacaagttaacctctcagtctttcgatttatgattgttctatagtggaaactatatttatttactcgtccggtgtttaatagattgtagattgcaaag

SEQ ID NO: 2649 - DNA, 643 bp, Saccharum officinarum
  misc_feature (354)..(354): n is a, c, g, or t
  misc_feature (406)..(406): n is a, c, g, or t
  misc_feature (413)..(415): n is a, c, g, or t
  misc_feature (513)..(513): n is a, c, g, or t
gcgaagatgtcggggcgcggcaagggcggcaagggcctgggcaagggtggcgcgaagcgtcacaggaaggtgctccgcgacaacatccaggggatcaccaagccggcgatccggaggctggcgcggagaggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggccggccgcgcctcgcccctctccttggtctgcctntgtcgccgtcgctgtggttgtagtgttgctgcaattcgctagttgtgtctgnctgaggnnnaaaaatgctactgtggcaagcatgttgcatatgttgcctgtttctgattgagtctaattctgaagaaatgtgcctatgatgacttgctcaagattcangcatgctcaatttgttcacacattaactctcttggctgcgtgtgttactgcttttctttgtgcaagtacgaaccatttcaattcttttggccttcagaccttgaatttcaatcctagaatgcatctctgt

SEQ ID NO: 2650 - DNA, 529 bp, Saccharum officinarum
cgacgatgtcggggcgcggcaagggcggcaagggcctgggcaagggcggcgcgaagcgtcaccggaaggtgctccgcgacaacatccaggggatcaccaagccggcgatccggaggctggcgcggagaggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggccggccgcgcctcgcccctctccttggtctacctgtgtcgccgtcgctgtggctgtagtgttgctgcaattcgcaagttgtgtctggctgggggaaaaaaatgctgctgtggcaggcatgttgcatatgttgtctgtttctgattgagtcttattctgaagaaatgtgccaatgatgacttgctcaagattcaagcatgctcaatttgttc

SEQ ID NO: 2651 - DNA, 626 bp, Saccharum officinarum
tcctcttcctcgcttcctcctgatccgcattccaagttccagcagcgaagctctcggtttcggcgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcattcctcatccggtggcgaactgcatgtggtggcggaggtggtcgtgttgtgtgccgtgtctagtgtagtctgtgctctctgtatcggtgctgtgttctgtggtggttgtgctctatctacgctttgggtgttgctgtaatatctagttgtcattatcaatggaaaaccctcggttctagcctatcaaataaactgtatcgctgtcaattcagtgtctctccaacaacaaaggtccaacaggtgcg

SEQ ID NO: 2652 - DNA, 612 bp, Saccharum officinarum
cacccaccaaatccccaattcccaacctcacctccgagttcgagcgaccatgtcggggcgcggcaagggcggcaaggggctgggcaagggcggcgcgaagcgccaccgcaaggtcctccgcgacaacatccagggcatcacgaagccggcgatccggaggctggcgaggaggggcggcgtgaagcgcatctcggggctcatctacgaggagacccgcggcgtgctcaagatcttcctagagaacgtcatccgcgacgccgtcacctacacggagcacgcccgccgcaagaccgtcaccgccatggacgtcgtctacgcgctcaagcgccagggccgcaccctctacggattcggcggctgaggggtgccccccgccgctggtggccgtggcaaaagtcataggtcacggtcaagaaatcgagggaggcgagggtattctggcccatatgcttagtttcgtagtcttatcggtagtgcttattgttacaggttgttgggttcgatcactctagagccatggtcaagtagtagtatatgagttgtaccgcatttccttgtcttctgaacttcccatgtatgaaatgtggattcacttgatatcccgtggacaac

SEQ ID NO: 2653 - DNA, 664 bp, Saccharum officinarum
gaaagcacctcccaaaaaaattccccaatccctccgagacgaacgagcgcgtgaaagcgaaggcaccggcgggcggcgacgatgtcggggcgcggcaagggcggcaaggggctgggcaagggcggagcgaagcgccaccggaaggtgctccgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggaggctaaggatgggttgggcgcctctcctcctttctgtcgtggatgccgtgtgtcgttagggctacgttgtttatttctctgcctgtggctggaactggtggtggtagtattgttgcagttgtgcttctgatgtaatccaatcttattgttcgagaattgaagtgattcctggtcaacctttggccgtcaatcttgtgccacttttctcgcgaattaaatccatcaaattcgtgaagaatttcttttttcttggaaatttgagtggatattaagccca

SEQ ID NO: 2654 - DNA, 715 bp, Saccharum officinarum
  misc_feature (650)..(650): n is a, c, g, or t
gctcagtcactccaccaccactccaccagcaagcgaaaaatccccaatcccttcttctccgcttgccaggatgtcgggtcgcggcaagggcggcaagggcctgggcaagggcggcgcgaagcgtcaccggaaggttctccgcgacaacatccaggggatcaccaagccggcgatccggaggctggcgcggaggggcggcgtgaagcgcatctccgggctcatctacgaggagacccgcggcgtgctcaagatcttcctcgagaacgtcatccgtgacgctgtcacctacaccgagcacgcgcgccgtaagaccgtcaccgccatggacgtcgtctacgcgctcaagcgccagggccgcaccctctacggtttcggcggctaggctgcgtctctctgtcgcggttctagtgttgctgcaattcgcacgttgtgcctaggtggggaatatggtagctactgtagcactggagcaagcatgttgcatgttgtctgtttcatattgaatcttatcctcaagaaatgccaatgatgacttgttcagaactcccaacatgctccatttgactgctttcgtttgtactagtgcgaaccatttcagttcttctgctgaacttcagacttatcagttccatggctttaacttgagccangatgtgtccaacgcacattgcatctctgtacaacaggctttttttattgcatattggataggcga

SEQ ID NO: 2655 - DNA, 712 bp, Saccharum officinarum
  misc_feature (565)..(565): n is a, c, g, or t
  misc_feature (568)..(568): n is a, c, g, or t
  misc_feature (677)..(677): n is a, c, g, or t
caggctcaccccaccaaccagcaagcaaaaaaattccccaattccttcgtctccgttagagaagaggccgacgatgtcgggtcgcggcaagggcggcaagggcctgggcaagggcggcgcgaagcgtcaccggaaggtgctccgcgacaacatccaggggatcaccaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcacgccgcaagactgtcaccgccatggacgtcgtctacgcgctcaagcgccagggccgcactctctacggcttcggcggctaggccgctgtcgctgtggttccagtcttgctgcaattcgcaatttgtgcctgggtggggaaaatgctagttactgtagaactgagcaagcatggtgaatatgtctgtttcatattgaatcttattctgaagaaatggcagtgatgatgacttgttcaggactcccaacatgctccatttgantgntttcgtttgtactaccgcgagccatttcagtttttttcgttaaccttggcttaggcccgggttagtttgtaaaaaattttgcaaaaatttttcagaatcttcgttccgngaagcaagccagactatccaaaagggcggcccgtt

SEQ ID NO: 2656 - DNA, 693 bp, Saccharum officinarum
  misc_feature (622)..(622): n is a, c, g, or t
  misc_feature (631)..(631): n is a, c, g, or t
tctcgccccaaatccactcaaacctccgctcctccagcggcctcctgcccgttcgtctcgaagcagcaggcagccatgtcgggccgcggcaagggaggcaagggcctgggcaagggcggcgccaagcgccaccggaaggtgctccgcgataacatccagggcatcacgaagccagcgatccggaggctggcgaggaggggcggcgtgaagcgcatctccgggctgatctacgaggagactcgcggcgtgctcaagatcttcctcgagaacgtcatccgcgacgccgtcacctacacggagcacgcccgccgcaagaccgtcaccgccatggatgtcgtctacgcgctcaagcgccagggccgcaccctctacggtttcggcggctgagccttggctccgtccgcgtcctctggccatgtggttgtggtcaggtgctagctagggttgttgatggattaggggagtttgttactttgtgttgggtttgcactgtgcttagtgtttatgtttgtaacggagattggaaccttatcaattgaaggaatggatgttcagttatctgtgttcattcccattgactcactttgtttctgtcttgattcatcaatttttttcccctatncgtatggtnaaattttggttatctcctttgaatccttgaaactttggtaataattatgatttggccggagt

SEQ ID NO: 2657 - DNA, 561 bp, Saccharum officinarum
cccacgcgtccgacaggctcaccccaccaaccagcaagcaaaaaaattccccaattccttcgtctccgttagagaagaggccgacgatgtcgggtcgcggcaagggcggcaagggcctgggcaagggcggcgcgaagcgtcaccggaaggtgctccgcgacaacatccaggggatcacgaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagactgtcaccgccatggacgtcgtctacgcgctcaagcgccagggccgcacgctctacggcttcggcggctaggccgctgtcgctgtggttccagtcttgctgcaattcgcaatttgtgcctgggtggggaaaatgctagttactgtagaactgagcaagcatggtgaatatgttgtctgtttcatattgaatcttattctgaagaaatggcagtgatgatgacttgttcaggact

SEQ ID NO: 2658 - DNA, 602 bp, Saccharum officinarum
cgcggcgaatttgaatcccacaatcttcgtagcacaccactacaccagcgtcttcttcctcttcggcagtgatgtctgggcgcggcaagggcggcaaggggctgggcaagggcggcgcgaagcgccaccgcaaggtcctccgcgacaacatccaggggatcacgaagccggcgatccggaggctggcgaggaggggcggcgtgaagcgcatctccgggctcatctacgaggagacccgcggcgttctcaagatcttcctcgagaacgtcatccgcgacgccgtcacctacaccgagcacgcgcgccgcaagaccgtcaccgccatggacgtcgtctacgcgctcaagcgccagggccgcaccctctacgggttcggcggctgagcgcgtgcgcgtctcctccgtcctctgcagctgctgctcgttccgccttacgtactcctttcggatccctgttccgtgctttccttcatgtagacagttatcggattcttaggtctctgccgtgtctcgttattaggtggaatcatgtgttggtagcactgaaagttcaacacccagttgtatcttcctttgcagcaatgaaatgttaactctgattgg

SEQ ID NO: 2659 - DNA, 772 bp, Saccharum officinarum
tcgcaaatctccaaacccacctccacaatctcctctcgtgttcagccatgtcgggccgcggcaagggaggcaagggtctgggcaagggcggcgcgaagcgccaccgcaaggtgctccgcgacaacatccagggcatcacgaagccggcgatccggaggctggcgcgcaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctgtacggcttcggcggctaggcgcgtcccgcccccaatctccggggcggtggtgctaggtgtagcagctgttagggtttcgttccgtctgttgtctgtggtctctggttgtcttgtgcaaagttatctggtctgtggtgtggaggaagaatgcaagatgaatgaaatggatctgtgttctattttaaaaaaaaatattcatgtatctatttttttcttgtttgcttctcttctcttttgctggggcggcctgttctttataacccatgctctccataccgttttatcctacattatattctttcttttttattactccatttttttatttaatgtctcctgcgtttttcaaatctctaattttcgtaataacttgcggtttctcaatattaatattttcttgcataacaatatcctctttttcttgtttactt

SEQ ID NO: 2660 - DNA, 670 bp, Saccharum officinarum
  misc_feature (8)..(8): n is a, c, g, or t
  misc_feature (585)..(585): n is a, c, g, or t
  misc_feature (646)..(646): n is a, c, g, or t
  misc_feature (663)..(663): n is a, c, g, or t
ccaccggntccacccacgcgtccgctcctcttcacacgagcgcagacacaaccatccgcctactacttccaagcaggggaggcgaccggcggcggagatgtcgggcagaggtaagggcggcaaggggctcgggaagggcggcgcgaagcgtcaccggaaggtgctgcgcgacaacatccagggcatcacgaagccggcgatccggaggctggcgaggaggggcggcgtgaagcgcatctccgggctgatctacgaggagacccgcggcgttctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctaggttaggtcagggtagttgcctgtcgaggcgtctcggatcggtgttactagtttggttaccttcctgtgttcgtctggtagttgctgtagtggttgtaactggttgatttgtccgtcatgttgtgtgcgtctgtaagcaccgctggttcgatggaattggaatggatgacgaagtangaaagttatccagtttggtttgaaacatgctccaatgtaacgttgcctctaattggatttntcgcaattggttttcanttgtgca

SEQ ID NO: 2661 - DNA, 979 bp, Saccharum officinarum
  misc_feature (557)..(557): n is a, c, g, or t
ctcgcttcctcctgttccgcattccaagtgccagcagcgaagctctcggtttcggtgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcattcctcatccggtggcgaactgcatgtggtggcggagggggtcgtgttgtgtgccgtgtctagtgtagtctgtgctctctgtgtcggtgctgtgttgtgtggtggttgtgctctatctacgctttgggtgttgctgtaatatctaagatgtattatcaatggaaaaccctcggttctagccttnaaaaaaagattaaagaaaatataaactttatctgctgggcggccgcttctaaaaaaacaaagcttacgaccccgtgcatgcaaaagtattaactttttaaataggggaacctaaaattaaattcactggggcgcgtattttaacaacgttagaactgggaaaaaaccttgccgttaccccaacttaatatcgtttgtgaataaaattcccctttttgtcagtgtgtgggtttatttgcaaaaataggccctcaatcagatattgcctttttctaaaaagattagtccaactcttaaatatgcgaaattggtaactcccccccttgaaacgtgtgactaataaaacctgatgaatgttgtagatggttaatctaacaaagtgtgaaccataaacattttccgaatgacatatatatgactcct

SEQ ID NO: 2662 - DNA, 563 bp, Saccharum officinarum
cggcgaattcgaatcccacaatttttggagggcacaccaccgtcactcgagtcttctttcctcttcggcggcgatgtctgggcgcggcaagggcggcaaggggctgggcaagggcggcgcgaagcgccaccgcaaggtcctccgcgacaacatccaggggatcacgaagccggcgatccggaggctggcgaggaggggcggcgtgaagcgcatctccgggctcatctatgaggagacccgcggcgttctcaagatcttcctcgagaacgtcatccgcgacgccgtcacctacaccgagcacgcgcgccgcaagaccgtcaccgccatggacgtcgtctacgcgctcaagcgccagggccgcaccctctacgggttcggcggctgatcgcgtgcccgtctcctacgtcctctgcaactgatgctcaatcgccttacgtactcctttccgatcactgtccgagctttccttgaagacaccagtatcggattcttaagtctctaccgagtctcgatattaaggtggaaaacagtggtcccctaattacacataaagtccaacaccc

SEQ ID NO: 2663 - DNA, 656 bp, Saccharum officinarum
accggcccgatatgcgggccgacccaccgtgcgtacgacagctcaccccaccaacagcaagcgatcgaaaaaattccccaatcccctcgtctccgcggcgaagatgtcggggcgcggcaagggcggcaagggcctgggcaagggcggcgcgaagcgtcaccggaaggtgctccgcgacaacatccaggggatcaccaagccggcgatccggaggctggcgcggagaggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggtcggccgtgcctcgcccctctccttcgtccgcctgtgttgccgtcgctgtggttgtagtgttgctgcaattcgctagttgtgcctgggtgaggaaaaaaaatgctattgtggcaagcatgttgcatatgttgtctgtttctgattgagtcttattctgaagaaatatgccaatgatgacttgctcaaggttgaagcatgccccatttgttcacagaataactgtcttggctgcgtgtgtt

SEQ ID NO: 2664 - DNA, 543 bp, Saccharum officinarum
  misc_feature (539)..(539): n is a, c, g, or t
ctcctgatccgcattccaagttccagcagcgaagctctcggtttcggcgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcattcctcatccggtggcgaactgcatgtggtggcggaggtggtcgtgttgtgtgccgtgtctagtgtagtctgtgctctctgtaatcgtgctgtgttctgtggtgggtgtgctctatctacgctttgggtggttgctgaatatctaggttgcattatcaatggaaaaccctcggntcta

SEQ ID NO: 2665 - DNA, 618 bp, Saccharum officinarum
  misc_feature (1)..(1): n is a, c, g, or t
naccgattcggattggcgacccacgccgtccgcaaacggccgaaatgggtatctcgccccaaatccactcaaatctccgctcctccagcagcctcctgcccgttcgtctcgaagcagcaggcagccatgtcgggccgcggcaagggaggcaagggcctgggcaagggcggcgccaagcgccaccggaaggtgctccgcgacaacatccagggcatcacgaagccggcgatccggaggctggcgaggaggggcggcgtgaagcgcatctccgggctgatctacgaggagactcgcggcgtgctcaagatcttcctcgagaacgtcatccgcgacgccgtcacctacacggagcacgcccgccgcaagaccgtcaccgccatggatgtcgtctacgcgctcaagcgccagggccgcaccctctacggtttcggcggctgagccttggctccttccgcgtcctctggtcatgtggttgtggtcaggtgctagctagggttgttgatggattaggggagtttgtgactttgtgtttggtttgcactgtgcttagtgtttatgtttgtaacggagattggaaccttatcaattgaaggaatggatgttcagttatctgtgttc

SEQ ID NO: 2666 - DNA, 615 bp, Saccharum officinarum
ccaagctccttccaacaccagaaaaagtccgtcagagaagagggcccgtgcgaggcggcggcggcggcggcgatgtcggggcgcggcaagggaggcaagggtctgggcaagggcggcgcgaagcggcaccggaaggtgctccgcgacaacatccagggcatcaccaagccggcgatccggaggctggcgcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggaggctaggcgcctcttcgtagttggggaacggttgggatatttctctctgtcgctgtgggtcgtagtgttgctgcagttgctgcgttcgtggatgtaatcctacagtatgtttctgatgaagaattggcaataatggtgctctggcatgaaaaaatgctagtaatcatgctgcgtattgtggcttggtgaattgtttcctgaaaattggtagtaacaataactcgctcaggaaccaag

SEQ ID NO: 2667 - DNA, 558 bp, Saccharum officinarum
ctcgctccaaatccactcaaatctccgctcctccagcagcctcctgcccgttcgtctcgaagcagcaggcagccatgtcgggccgcggcaagggaggcaagggcctgggcaagggcggcgccaagcgccaccggaaggtgctccgcgacaacatccagggcatcacgaagccggcgatccggaggctggcgaggaggggcggcgtgaagcgcatctccgggctgatctacgaggagactcgcggcgtgctcaagatcttcctcgagaacgtcatccgcgacgccgtcacctacacggagcacgcccgccgcaagaccgtcaccgccatggatgtcgtctacgcgctcaagcgccagggccgcaccctctacggtttcggcggctgagcgtggctccgtccgcgtcctccggcgatgtggttggggtggtggctagggttcctgatggatgtaggggagtttgtgttgtctgcactgtgtttaacttaattaggcgtttatggttgtaacggagattggaatcttatcaattgaaggaatggattgtcaattatctgtg

SEQ ID NO: 2668 - DNA, 549 bp, Saccharum officinarum
aaaaattccccaatccctccgagacgaacgagcgcgtgaaagcgaaggcaccggcgggcggcgacgatgtcggggcgcggcaagggcggcaaggggctgggcaagggcggagcgaagcgccaccggaaggtgctccgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggaggctaaggatgggttgggcgcctctcctcctttctgtcgtggatgccgtgtgtcgttagggctacgttgtttatttctctgcctgtggctggaactggtggtggtagtattgttgcagttgtgcttctgatgtaatccaatcttattgttcgagaattgaagtgattcctggtcaac

SEQ ID NO: 2669 - DNA, 570 bp, Saccharum officinarum
gcacctccccaaaaaaattccccaattcctttcgagacgacgagcgcgtgaaagagaaggcaccggcggccggcgacgatgtcggggcgcggcaagggcggcaaggggctgggcaagggcggagcgaagcgccaccggaaggtgctccgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggaggctaaggatgggttgggcgcctttcctccttgctgtcgtggatgccttgtgtcgttagggctacgttgtttatttctctgcctgtggctggaactggtggtagtagtattgttgcagttgtttctgatgtaatccaatcttattgttctagaatttaagtgattcctggtcaaccttttgccgtc

SEQ ID NO: 2670 - DNA, 561 bp, Saccharum officinarum
  misc_feature (464)..(464): n is a, c, g, or t
  misc_feature (539)..(539): n is a, c, g, or t
  misc_feature (561)..(561): n is a, c, g, or t
aatccactcaaacctccgctcctccagcagcctcgtgcccgttcgtctcgaagcagccggctgccatgtcgggccgcggcaagggaggcaagggcctgggcaagggcggcgccaagcgccaccggaaggtgctccgcgacaacatccagggcatcacgaagccggcgatccggaggctggcgaggagaggcggcgtgaagcgcatctccgggctgatctacgaggagacacgcggcgtgctcaagatcttcctcgagaacgtcatccgcgacgccgtcacctacacggagcacgcccgccgcaagaccgtcaccgccatggacgtcgtctacgcgctcaagcgacagggccgcaccctctacggcttcggcggctgagccttggctccgtccgcgtcctccggccatgtggttgtggtcaggtgctagctagggttgctgatggattaggggagtttgtgactntgtgttgggtctgcactgtgcttagtggtcaggtgctagctagggttgctgatggattaggggagtttgtgactntgtgttgggtctgcgctgtgcn

SEQ ID NO: 2671 - DNA, 666 bp, Saccharum officinarum
  misc_feature (582)..(582): n is a, c, g, or t
aaccttcctcgcccgaaatccactcaaacctccgctcctccagcatcctcctgcccgttcgtctcgaagcagcaggcagccatgtcgggccgcggcaagggaggcaagggcctgggcaagggcggcgccaagcgccaccggaaggtgctccgcgacaacatccagggcatcacgaagccggcgatccggaggctggcgaggagaggcggcgtgaagcgcatctccgggctgatctacgaggagactcgcggcgtgctcaagatcttcctcgagaacgtcatccgcgacgccgtcacctacacggagcacgcccgccgcaagaccgtcaccgccatggacgtcgtctacgcgctcaagcgacagggccgcaccctctacggcttcggcggctgagccttcggctccgttcgcgtcctccggccatgtggttctggtggtcaggcgctagctaaggtccctgatggattaggggtatgtgactttgtgtcgggtctgcactgtgtttgtggttgtaacggagattggaaccttatccattgaaggaatggatggtcatttatctgaattgttcttcattccccnccaacaaaccccaccacacacacccccccccaacccccacccccacccaaaccacccaccccccccccaccaacccacccaaaa

SEQ ID NO: 2672 - DNA, 553 bp, Saccharum officinarum
ctcgcttcctcctgatccccattccaagttccagcagcgaagctctcggtttcggcgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcattcctcatccggtggcgaactgcatgtggtggcggaggtggtcgtgttgtgtgccgtgtctagtgtagtctgtgctctctgtatcggtgctgtgttctgtggtggttgtgctctatctacgctttgggtgttgtaatatctagttgtcattatcaatggaaaaccctcggttctagcctc

SEQ ID NO: 2673 - DNA, 597 bp, Saccharum officinarum
gtcccgccgcctgcagtctactactccgaggaaacccatcacccacccgagcggaagaagccatgtctgggcgcggcaagggcggcaaggggctcggcaagggcggcgcgaagcgtcaccggaaggtgctgcgcgacaacatccagggcatcaccaagccggcgatccggcggctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctggtgggctcccctcgatgttcccccttctgcagctgcgatgttgtctggccgtgccaacaagtcttgcggtcaagaaagtttcaggaactctttgtagttcatctctggctgtagtaggtttatctgaattgtaagactgtagcaggtttacctgaatcatgcagtatcgaaatcatgtgaacatcagatgttggaaatcaaagcttgttttgcaacctg

SEQ ID NO: 2674 - DNA, 602 bp, Saccharum officinarum
caccttcagtcccgctgcctgcagtctactactccgaggaaatccatcacccacccgagcggaagaagccatgtctgggcgcggcaagggcggcaaggggctcggcaagggcggcgcgaagcgtcaccggaaggtgctgcgcgacaacatccagggcatcaccaagccggcgatccggcggctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctggtgggctcccctcgatgttctcccttctgcagctgcgatgttgtctggccgtgccaacaagtcttgcggtcaagaaagtttcaggaactcttgttagttcatctctggctgtagtaggtttatctgaattgtaagacagtagcaggtttatctgaatcatgcagtattgaaatcatgtgagcaccagatgttggaaatcaaagcttgttttgcaac

SEQ ID NO: 2675 - DNA, 543 bp, Saccharum officinarum
ctgttccgcattccaagtgccagcagcaaagctctcggtttcggtgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcattcctcatccggtggcgaactgcatgtggtggcggagggggtcgtgttgtgtgccgtgtctagtgtagtctgtgctctctgtgtcggtgctgtgttgtgtggtggttgtgctctatctacgctttgggtggtgctgaatatctaggtgtcattatcaatggaaaaccctcggttctagcct

SEQ ID NO: 2676 - DNA, 555 bp, Saccharum officinarum
gtcgtcgcctggaggccggccggaattccgcgttgaacacgcgttcgcccaattcttcttctccgtcagagaagagggcccgtgcgaggcggcggcggcggcgatgtcggggcgcggcaagggaggcaagggtctgggcaagggcggcgcgaagcggcaccggaaggtgctccgcgacaacatccagggcatcaccaagccggcgatccggaggctggcgcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggaggctaggcgcctcttcgtagctggggaacggttggggaatatttctctctgtcgctgtgggtcgtagtgttgctgcagttgctgcgttcgtggatgtaatcctacagtatgtttctgcaatgaagaaatgcgagtaatgatgctct

SEQ ID NO: 2677 - DNA, 735 bp, Helianthus annuus
  misc_feature (563)..(563): n is a, c, g, or t
aagcgagatggtgggcaaaaggggctggtttcaaaggattatagctcggtttgaacgtaaagactttcaactggtagccatcaaacttgtggcccccgctaagtcctaagcccacaagctatagcacgatcttaaggacaggccagtttctgatgggttgtgtcggttccatactcgtggtcgcgtaatccaaaacaccacaacaaacaaacaaacaatgtccggaagaggtaaaggaggcaaggggctgggaaagggaggagcaaaacgacaccgtaaagttctccgtgataacatccaaggtatcaccaagccggctattcgtcggctggcgcgccgtggcggcgttaagcggatcagcgggctaatctacgaggagacacgtggcgtgttgaagatctttctcgaaaatgttattcgtgatgcggttacctacaccgagcatgctcgtcggaaaactgttactgctatggatgttgtttatgcgttgaagcgacagggccgtactctgtatggttttggtggttagggtttgtttttgttacagatctgttggtttaaanttgttcatgtatttgtgtaattgaagtttctagtgaattgcaaactttgcattttacgattaatgattgatttggggctgaattgaaagtgcatttgacttggtatgcatcacaagtgtttgatgcaatgtgtgtgagtttctcacttcagtttgatttacattttatatgc

SEQ ID NO: 2678 - DNA, 590 bp, Helianthus annuus
  misc_feature (561)..(561): n is a, c, g, or t
acgcggggacacaactccttaataaaatcctgcttcattcctaaccagaattcaaatcaaatcaaatctcgatttcgatccaaaaatgtcaggccgtgggaagggaggaaagggattgggaaagggaggagcaaaacgacacaggaaggttcttcgcgacaacattcagggaatcacgaagccggcgattcgaagattggctcgcagaggaggcgtgaagcgtatcagcgggttgatctatgaagaaactcgtggagttctcaagatttttcttgagaatgttattagagatgctgtgacttacactgagcatgctcgccggaagactgttacggcgatggatgttgtatatgctttgaaacgacagggtcgtactctgtatggttttggtggttaggtttagcgtgttagttgtagacatggatcatttctatcttgttcttctttgttttaggttagttatcattctccatctcgggccatggtttcatgttaaaagttctttgaattatatttgaagtcagttgaatttctttgtcttaaaaaaaaaaagaccccccnggcccaaaccttgttggccgcctcggccc

SEQ ID NO: 2679 - DNA, 517 bp, Helianthus annuus
atcatccaaacacaccatttactcatccaattcaatttctagagagagaaaatgtcaggaagaggaaagggaggtaaggggttgggaaagggaggagcaaaacgacaccgtaaagttctccgtgacaacatccagggtatcacgaagcccgcgataaggaggctggcgagaagaggaggtgtgaagcgtattagcggtttaatctacgaggagacacgtggcgtcttgaagatctttttggagaatgtgattcgtgatgcggttacctacacagagcatgctcgccggaagactgttactgccatggatgttgtttatgctttgaaacgacagggccgtaccctctatggctttggtggttagggttagggtttgtagcagtggttgtttagatttatgatgttggtagtatgtgtagggatctaggatatgttggtgtaattgaaggtcgtttgcgattactagaagttgttaattgatttcagaatttcaatgttattttcttgttgttttgaga

SEQ ID NO: 2680 - DNA, 649 bp, Helianthus annuus
  misc_feature (1)..(1): n is a, c, g, or t
  misc_feature (3)..(6): n is a, c, g, or t
  misc_feature (8)..(9): n is a, c, g, or t
  misc_feature (11)..(11): n is a, c, g, or t
  misc_feature (13)..(13): n is a, c, g, or t
  misc_feature (15)..(17): n is a, c, g, or t
  misc_feature (20)..(25): n is a, c, g, or t
  misc_feature (27)..(31): n is a, c, g, or t
  misc_feature (33)..(39): n is a, c, g, or t
  misc_feature (41)..(43): n is a, c, g, or t
  misc_feature (45)..(53): n is a, c, g, or t
  misc_feature (56)..(56): n is a, c, g, or t
  misc_feature (58)..(59): n is a, c, g, or t
  misc_feature (414)..(414): n is a, c, g, or t
ncnnnngnngncntnnnttnnnnnngnnnnntnnnnnnntnnngnnnnnnnnnatnannctccatcttcatctcttacaaatcacaggtgatttgaagaaatttgagaatgtcgggacgtggaaagggaggaaagggattggggaaaggaggagcaaaacgacaccgtaaagttctccgtgacaacattcagggaatcacgaagcctgcgatccggcgtttggcgagaaggggtggagtgaagcgtatcagcgggttgatctacgaggagactcgtggagtgttgaagatctttttggaaaatgtgatcagagatgcggttacttacacggagcatgctcgtaggaagactgtgactgctatggatgtggtgtatgcgttgaagagacaaggtcgtactctgtatgggtttggnggttagggttttgagtttgggaagtcttgacgggtcgggttatgtcgggtcaaaaattagatagttgtggggtgttaggttagggttttgattgctagttgttgaaatgaaatgtggttaatagtgtgtttatgttttctattaagaagtaatgaagtggtttttggctagtctctggctttttattaagatattgtgttagtttatcatatacttcatcaacggtttggatgca

SEQ ID NO: 2681 - DNA, 514 bp, Helianthus annuus
  misc_feature (393)..(393): n is a, c, g, or t
  misc_feature (410)..(410): n is a, c, g, or t
  misc_feature (478)..(478): n is a, c, g, or t
  misc_feature (493)..(493): n is a, c, g, or t
acgcggggacattatctgcatcatcgtctcttcaaactttcagatttcgaaacaatttgaagaaatttaacaatgtcaggccgtggaaagggaggcaaagggttgggaaagggaggagcaaaacgacaccgtaaggttcttcgtgataacattcagggaatcactaaacctgctatccgtagattggctcgcagaggaggtgtgaagcgtatcagtggtttgatatatgaggagacacgtggtgttctcaagatctttttggaaaatgttatcagagatgctgtcacctacactgagcacgctcgcaggaagactgtgaccgccatggatgtggtgtatgcgctcaagagacagggccgtaccctgtacggatttggtggttagggttttagnctttagtgctaggtttntgatgttgagatttgtttgaattatgttggaatatacagtgaatggcaatttttcttttgaattgaanttgagagtcaaatancgaagtctctggatttatttg

SEQ ID NO: 2682 - DNA, 547 bp, Helianthus annuus
  misc_feature (42)..(42): n is a, c, g, or t
  misc_feature (47)..(47): n is a, c, g, or t
  misc_feature (51)..(51): n is a, c, g, or t
  misc_feature (304)..(304): n is a, c, g, or t
  misc_feature (343)..(343): n is a, c, g, or t
  misc_feature (441)..(441): n is a, c, g, or t
acggggacatccatcaaatcaccactaaatctcaaatcagcnttgtngaanaatgtcaggccgtggtaagggaggaaaggggctgggcaagggcggagcaaagcgtcaccgaaaggttctccgagataacattcaggggatcacgaagccggcgatcaggaggctggcgagaagaggaggagtgaagaggatcagtgggttgatctatgaggagactcgtggtgtgttgaagatctttttggagaatgtgattcgtgatgcggttacatacactgagcatgctcgcaggaagacggtcactgcnatggatgttgtgtatgcacttaagaggcaggggaggacnctctatggatttggaggttgaaattgttagcttttatgttttgttgttttggtttagggttatgtgtaaattgaaagtttcgttaacgaagggttcgnttgttatgatcaatgttcttttgtttgactgttgattgttttgataattgtgttgaaggcactgcagctcaatttgaaatcaattcaataatcagcgttcagctat

SEQ ID NO: 2683 - DNA, 510 bp, Helianthus annuus
  misc_feature (492)..(492): n is a, c, g, or t
  misc_feature (496)..(496): n is a, c, g, or t
acgcggggaaacaaaaaacccaaattcatttctaggagtagaaaatctagagagagaaaatgtcaggaagaggaaagggaggcaagggattgggaaagggaggagcaaagcgtcaccggaaagttctccgggacaacattcaaggcatcacgaagccggcgatcaggcgtcttgctcgaagaggaggtgtgaagcgtataagtgggttgatctatgaagagacacgtggagtgctgaagatatttcttgagaatgttatccgtgatgcggttacgtacactgaacatgctcgccggaaaactgttacggcgatggatgttgtttatgcgttgaagcgtcaaggccgtactctctacggttttggtggttagggttttaatttaggggtcagggttattgtcttgttaatcttttatttggttttggtattaatcgatgttatgaaccgatgttacatgtaattggtggttttaatacaatattagtttagtnatcntcaaacaaaatcca

SEQ ID NO: 2684 - DNA, 468 bp, Helianthus annuus
  misc_feature (36)..(36): n is a, c, g, or t
  misc_feature (363)..(363): n is a, c, g, or t
  misc_feature (378)..(378): n is a, c, g, or t
  misc_feature (381)..(381): n is a, c, g, or t
  misc_feature (386)..(386): n is a, c, g, or t
  misc_feature (393)..(393): n is a, c, g, or t
  misc_feature (397)..(398): n is a, c, g, or t
  misc_feature (400)..(401): n is a, c, g, or t
  misc_feature (403)..(403): n is a, c, g, or t
  misc_feature (405)..(405): n is a, c, g, or t
  misc_feature (407)..(407): n is a, c, g, or t
  misc_feature (412)..(412): n is a, c, g, or t
  misc_feature (419)..(420): n is a, c, g, or t
  misc_feature (423)..(424): n is a, c, g, or t
  misc_feature (427)..(429): n is a, c, g, or t
  misc_feature (431)..(431): n is a, c, g, or t
acgcggggaaatcacttctacacatccattccttcnaaccaaaaaagaaacatgtcaggaagaggcaaaggaggaaaaggcctaggaaaaggaggagcaaaacgacaccgtaaagttctccgtgacaacattcaaggcatcacaaaaccagctattaggcggttagccagacgaggcggagttaaacgtatcagcggcttgatatacgaggagacgcgtggtgttctcaagatctttctagaaaatgttattcgtgatgcggttacttacaccgaacatgctcgcaggaaaacagttactgctatggatgttgtttatgctttgaaacgccaaggccgtactctttacggttttggcggttantttgttagtctgttntgntttgntttgtgntgtnnanntnantncatgnatttgtnnttnnttnnntnatatcgaaatcgagatttttactatatttttaatccg

SEQ ID NO: 2685 - DNA, 536 bp, Helianthus annuus
gtgcgccgcccaggcacgtactcggggatcactcaaatctttcaaatcaaatctcaatctcaatttcatttcatttcaacaacaatgtcaggccgtggaaagggaggcaagggattgggaaagggaggagcaaaacgacaccgtaaggttcttcgtgacaacatccagggaatcaccaagccagcgatccgcagattggctcgcagaggaggtgtgaagcgtatcagcggtttgatctatgaggagacgcgtggcgttctgaagatctttttggaaaatgttatcagagatgctgtcacctacactgagcacgctcgaaggaagactgtgaccgccatggatgtggtgtatgcgctcaagagacagggccgtactctgtacggtttcggtggttagggtttagggtgctgattgtagatctgttggatttgtgttttgttttgttttagtgttggtgttgttgttctccatctcggagtcattgtttcgtgttaagaattgctctaattaatggaattaaattgtgctgggtttcg

SEQ ID NO: 2686 - DNA, 542 bp, Helianthus annuus
cccgcctttaacaaaccccacctatataaaaccccacccatttccaccatcacaaacacccaccacccaattcatcaccaatcaatcaaacccacaatctcaaatcaaccatgtctggccgtggaaagggaggcaaggggctcggaaagggcggagcaaagcgacacagaaaggttcttcgtgacaacattcagggaatcaccaaacccgccattcgcagattggctcgcagaggtggagtcaagcgtatcagcggcttgatctatgaagagacacgtggcgtgttgaagatctttttggaaaatgtcatcagagacgctgttacctacaccgaacacgctcgccgtaaaactgtcactgctatggatgtcgtttatgcccttaaacgacagggccgtaccttgtacggtttcggtggttagatcattttagggttagggtttttagaagattatctgtttcgttgtaatctatgttatgttatctgttttcaattcaccatcttggtgtatggtttaatgatgaagaagtttcttatttta

SEQ ID NO: 2687 - DNA, 520 bp, Helianthus annuus
  misc_feature (243)..(243): n is a, c, g, or t
atcatccaaacaacaccatttactcattcaattcaattcaatttctagagagagaaaatgtcaggaagaggaaagggaggcaaggggttgggaaagggaggagcaaaacgacaccgtaaagttctccgtgataacatccagggtatcacgaagccggcgattaggaggctggcgagaagaggaggtgtgaagcgtattagcggtttaatctacgaggagacacgtggcgtcttgaagatcttnttggagaatgtgattcgtgatgcggttacctacacagagcatgctcgccggaagactgtcactgctatggatgttgtttatgctttgaaacgacagggccgtaccctctatggctttgggggttagggttagggtttgtcggagtggttgtttagatttacgatgttggtagtatgtgtagggatctaggatatattagtgtaattgaaggtcgtttgcgattactagaagttgttaattgatttcagaatttcaatgttattttcttgtttttgag

SEQ ID NO: 2688 - DNA, 496 bp, Helianthus annuus
  misc_feature (53)..(53): n is a, c, g, or t
atcatcaggtgatttgaagaaatttgagaatgtcgggacgtggaaagggaggnaagggattggggaaaggaggagcaaaacgacaccgtaaagttctccgtgacaacattcagggaatcacgaagcctgcgatccggcgtttggcgagaagaggtggagtgaagcgtatcagcgggttgatctacgaggagactcgtggagtgttgaagatctttttggaaaatgtgatcagagatgctgttacttacacggagcatgctcgtaggaagactgtgactgctatggatgtggtgtatgcgttgaagagacaaggccgtactctgtatgggtttggtggttagggttttttgagtttgggaagtcttgacgggtcgggttatgtcgggtcaaaatctagatagttgtggggtgttaggttagtgattgattactggttgttgaaatgaaatgtggttaatattgtggttatgttttctattatgaagtaatgaagtgg

SEQ ID NO: 2689 - DNA, 446 bp, Helianthus annuus
cggggataaaattcaaaaaacaatcttcaatttcgaacagcagcaatcatgtcagggagagggaaaggaggaaagggactgggaaagggaggagcaaaacgacaccgtaaggttctccgggacaacattcagggcatcaccaaaccggcgatccgacggttggcaagacgtgggggagtgaaacgtataagcggtctgatatatgaggagactcgtggtgttctcaagatctttctagaaaatgttattcgtgacgccgttacctacaccgagcatgctcgccggaaaactgttactgctatggatgtggtctatgcgttgaagcgtcagggacgcactctgtacggtttcggtggttagtacgagggaagttagatctgagttgtttggttatgtttgtgttgtatgatagatagttaatggaatgaaaagttagatttgattta

SEQ ID NO: 2690 - DNA, 703 bp, Panicum virgatum
gacccacctcagcaccaggctccacacttcacaccagcgcaaccaccaccacctacaagcgggagcgagcggcggcttcggcgatgtcgggcaggggcaagggcggcaaggggctcgggaagggcggcgcgaagcgtcaccggaaggtgctccgcgacaacatccaggggatcacgaagccggcgatccggaggctggcgaggaggggcggcgtgaagcgcatctccgggctgatctatgaggagacccgcggcgtgctcaagatcttcctcgagaacgtcatccgcgacgccgtcacctacacggagcacgcccgccgcaagaccgtcaccgcgatggacgtcgtctacgcgctcaagcgccagggccgcaccctctacggcttcggcggctaggttaggggtctgccgatgtgattcggttcgatgggtagccctatcgccttcatgtgttccggtagttgctgtagcggagatgtagtagctggttgcttggtcccttccgtgctggttgggtggatgtaagaaccgctggttcgaggcaattggttttcatgcaggatgctgatgtaggaaatttgaagttcaaatttggttctgttcagtttagacttatgttctttgtctcgatgtggattatacgatgctattttgttttgttcagttttcatcaattttggaaccccctttctggctgcacagac

SEQ ID NO: 2691 - DNA, 714 bp, Panicum virgatum
tcgctatccccaaatcaccaccgagctctctcgatttcaatctcaccaccacctccgagctaggagccatgtcgggccgcggcaagggaggcaaggggctgggcaagggcggcgcgaagcggcaccgcaaggtcctccgcgacaacatccagggcatcaccaagccggcgatccggaggctggcgcgcaggggcggggtgaagcgcatctccggcctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagatccgccttgggtcccaggctggtcgatggtgctagggttagcaacggtgtggtgtttggcgttcgttccatctgatgtgatgtctggaggtgtctccgactccgtgtctgttttgtgcaaagtagtaatgtgtctctgtgattggaaatggagtccgaagcttatgaatgaaatcgatctgtgtttacttttctaactgcatctctgttgcatagggtttctgctgtgatgccgtgttgcgcagatctctgttgctcgatgaatgctttgggttggtgttcattctggggcattgctgctcctttgaattgcttaaggttcgtccttctcgc

SEQ ID NO: 2692 - DNA, 1046 bp, Panicum virgatum
gggtcgacccacgcgtccgctcagcttgaatccccccacgcccgctcgaatccactcctccggggaatccaccacccgtccggtcgtcggcaagcatgtctgggcgcggcaagggcggcaaggggctcggcaagggcggcgcgaagcgccaccggaaggtgctgcgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgtaccctctacggcttcggcggctaggctgatgcgctccccccttagctgtctcccttctgcagcttcgacgttatctgggcggtgctcacaggtcttgcggtcaagaaagtctcagactcgcttgtttagctcatctctggctgtagtaggtttatctgaatcatgagacagtaatgaattgatgttaccttctgaaattgggagccaatcttgtcgtgcttacttgtgatttttctatgcaaatggccggtgttctgtgctgtgtatctatttgatggattcttttacaatcacaaaaaaaaagcccacgcgtccgcccacgcgtccggacacatgctaccccctcgactgatctgcgccgccgcccagcgcacagaccgtcggtgcctcccataaaaacccaaacacaaaaaagaaagaaagaaaaaagagatcgctccctcctccgccacgccactccactccactccgtcggcaagtccccgctcttctcgcggcatctgcttgggcggctacccaggcagcgatgctacactccaagtgaagctgaagctgatacacttcgcgctactagaatcagaaccgtccgtttgcttaagcagccgtgttctctcagtctcttcccgtggtcgcacgttctggggcaagtgaagcagtggagca

SEQ ID NO: 2693 - DNA, 660 bp, Panicum virgatum
ccacgcgtccgccatccaccgccagccaattcgaaaactccgccaaatctctcgcagcagcagagtcttctccctctccgtcgtcggcgatgtctgggcgcggcaagggcggcaaggggctgggcaagggcggcgccaagcgccaccgcaaggtgctccgcgacaacatccagggcatcaccaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctgagcgcgccctctccctcgtatgcagctgctggcggtggtgcttgcttgcttgttcgtttgggttacccgtgctgggcgttccgtttggtgatgtagagatactatcagattcgtatctgtgctgtcttttgttcttagtaggtggatgtgaagtacgggtctagaaattccaactgccagttgtatctcagttccgtttcctttgcagcaatgaaatgttaaccccgatctgctaccaattgccgtggttcttttggcac

SEQ ID NO: 2694 - DNA, 849 bp, Panicum virgatum
agattccaacctcaaaccaaaaaatcccccaattccggcgtgcgagagcgcgaggagggaggccaaggcggcggcgatgtcggggcgaggcaaggggggcaaggggctgggcaagggcggcgccaagcggcaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgacaggggcgcaccctctacggcttcggcggctaggcggcgctggcgccggcgcgcctcctgcggggcgctgcgccctcgggcgtttcgtggatgcggtgccgtctgtgattagggatgcttcgttgtttagttacttcgtcggcttgtgtcctggtgggtctggagctgatcttgctagcgatccctgttcgaattgttggtgacgaactgctattaatcttgtctgtctggagtgcctgtgcttctgttgtgattgttgtttcaagcggaatcttgttctgaatataagtgctagtagctacttattgtcgcaaaggttgtttcggtctaaccgtgctagtagctacttattgctctgaatcatgttttgggttgcaagtgcaattggtaccattgtttaaagggtcagttggatccatgtcactacaatttcacagagttgtggtggcatgaatcgaattttcccttgtttaaaaatgggcatgcttcttgac

SEQ ID NO: 2695 - DNA, 609 bp, Panicum virgatum
ctgcccaaaatccccaaatcttcctcctcccaaatccttcgaatcctccgcgcctccggcaagctccaggtcgtcgtcgcagcagaagctatgtcgggccgcggcaagggaggcaagggcctgggcaagggcggcgccaagcggcacaggaaggtgctccgcgacaacatccagggcatcacgaagccggcgatccggcggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagcctggccgccccccgcccgcgccctgtgggtcgcgtgcaggcacctagctagggttcctgatgggttagaggagttgatgtgctgcgttctgtcctgtgcctagctgcgttgtggtgttgacttaatagtaggtgtttatggttgtaatggtgaattggaagcctatcaattgaatgaatcgatgttctgaggcatgattagagtt

SEQ ID NO: 2696 - DNA, 606 bp, Panicum virgatum
caatcctcttccaacgcttcctcctccaaattccatctcctccgagcggtcgcggcgagagaagcttccggttcggcgatgtcggggcgcggcaagggcggcaaggggctgggcaagggcggcgccaagcgccaccgcaaggtgctccgcgacaacatccagggcatcaccaagccggccatccggaggctggccaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcggttccccttctggtggcgaaggcgaactacatgcggtgggctgtgtgttctggtctagtgtagtcagtgctctctgtatcgaactatcgatgctgtgtcgtggtggttgtactctgctcttcgagtaggtgttcgaatttctactccgtctgctgtaatatctagttgctgtaatcaatgcaaaatccttggttctagcctcagttgcgcct

SEQ ID NO: 2697 - DNA, 734 bp, Panicum virgatum
caaatcctcttccatcgcttcatcctccaaattccaactcctccgagcggttgcggcgagcgaagcttccggttcggcgatgtcggggcgcggcaagggcggcaaggggctgggcaagggcggcgccaagcgccaccgcaaggtgctccgcgacaacatccagggcatcaccaagccggccatccggaggctggccaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctttacggcttcggcggctagatcggttcagcttctggtggcgaaggcgaactacatgtggtggggtgtgtgttctggtttagtgtagtcagggctctctgtatcgatgctgtgtcgtggtggttgtagtctatctactctgtgagtagttgtttgcgtttctagtcctctgcagtaatatctagttgctgttatcaatggaaaaccttggctctagcctcaggttcgcctcagtttcgtctgcgttctggtttacggttctgagatcgatgtaacgcagctcatagctcaatgctgtacgagtacaattgcctaggcagttggcatttccttcaagaaggtataaaaactaatttattatctt

SEQ ID NO: 2698 - DNA, 676 bp, Panicum virgatum
aaagaagttgctctcttcacacgagcgcaaccaccaccacccaccactacaagcggaagcgaggcggcggcggcggcggcggcgatgtcgggcaggggcaagggcggcaaggggctcgggaagggcggcgcgaagcgtcaccggaaggtgctccgcgacaacatccagggcatcacgaagccggcgatccggaggctggcgaggaggggcggagtgaagcgcatctccgggctgatctacgaggagacccgcggcgtgctcaagatcttcctcgagaacgtcatccgcgacgccgtcacctacacggagcacgcccgccgcaagaccgtcacagccatggacgtcgtctacgcgctcaagcgccagggccgcaccctctacggcttcggcggctaggttaggggtctgtcgatgtggttcggttccatgggtagccttatcgccttccatgttttccggtagttgctgtagcggagtagtagctggttgcttggtccctttggcgtcgggtgtgtggatgtaagaaccgctggttcgaagcaattggtctggatgcaggatgctgatgtaggaaatctgcagttcactttcaattgttattctacgaatactgtttgtctcgaagtaaactctgcacaaattgtcctggattgggcggtgtaaacctgttcggttc

SEQ ID NO: 2699 - DNA, 712 bp, Panicum virgatum
cccaaatccccacccccaaaatcccccaatcccccaacctctccgagtcgagcgagcgaccatgtctgggcgcggcaagggcggcaaggggctgggcaagggcggcgcgaagcgtcaccgcaaggtcctccgcgacaacatccagggcatcacgaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagacagtcaccgccatggacgtcgtctacgcgctcaagcgccagggccgcaccctctacggattcggcggctgaggggcgccgccgccgccgcccggtggccgtgccaaaagtcttgggtcgcggtcaagaaatcgcggaggaggcgagattgttctggtccatatatgctctgtttcgtaggcttaccagtagtgctaaatattgttggttggcggtttggatcattctagagccgcggtcgagtagtactgtagtagtatgtgaagctgtatggcaaagttcacctgcatatgctatctgttctgaacttcagatatatgaatccggtgccttgccgtgtttatgatgtgtattcgcttcatacctcatcagaacagctggtgaattcacttgaaatcttgaattgcttct

SEQ ID NO: 2700 - DNA, 586 bp, Panicum virgatum
ccccagtcccccacatcaccaccgagctctcgatttcaatctcaccacctccgagggagccatgtcgggccgcggcaagggaggcaaggggctgggcaagggcggcgcgaagcgccaccgcaaggtcctccgcgacaacatccagggcatcaccaagccggcgatccggaggctggcgcgcaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagctctgcctctccgttccggcggcgctcctgcttttggtcagacggtgctaggtttagcagtggtggtaggcgttctcgttccatcagttgtcgggaagagtccgtgtctgttttgtgcaaagtcatctgttctgtgatgagaaatggatcccgaaggttatgaatgaaatcgatccatgtttacttttctaactgcagatctctgttactcg

SEQ ID NO: 2701 - DNA, 603 bp, Panicum virgatum
aaatccccaaatcttcctcctcccaaatccctcgaatcctccgcgcctcgggcaagctctaggtcgtcgtcgcagcagcagccatgtcgggccgcggcaagggaggcaagggcctgggcaagggcggcgcgaagcgccaccggaaggtgctccgcgacaacatccagggcatcacgaagccggcgatccggaggctggcgaggaggggcggcgtgaagcgcatctccgggctgatctacgaggagacccgcggcgtgctcaagatcttcctcgagaacgtcatccgcgacgccgtgacctacacggagcacgcccgccgcaagaccgtcaccgccatggacgtcgtctacgcgctcaagcgccagggccgcaccctctacggcttcggcggctgagcccctggcccccgcccgcgtcctgtgtgtcgcgtgcaggcgcaagctggggttcctgatgggttagagaagttgatgtgctgggttctgtcctgtgcctagctgcgttgtggtgttaacttaatagttggtgtttatggttgtaatggtgaagtatggtagcctatcaattgaatgaatggatgttctgaggtatgattcgtgtttt

SEQ ID NO: 2702 - DNA, 720 bp, Panicum virgatum
aattcacaagctcccccaccagaaaacaacaatccccaatttccttcgtgctcgcggcggcggcgatgtcggggcgcggcaagggcggcaaggggctgggcaagggcggcgccaagcgccaccgcaaggtgctccgcgacaacatccaggggatcaccaagccggcgatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgccagggacgcaccctctacggcttcggcggctaggccctggcgccggtgcgcccccgtctgaggcgcggttcctggattggtgccgtgtgtggttagggatgagggttcgttgtcaagggattggctgtgttggctttctgaatgtagtctgtctttgtgccgtgaagaaatgcgtactgcctatcttgtacgaggattgaacatgcctgcagcaaagaaatggtcgagtttcaaatgctgtgcttctgactgaatcttatcctgaagaaagtaacacgttcagtaatcggcatggctttctggatgaatttcggatgtgaccgtgtgaaaatgccacccgttgaatcacaatgcagagggacttgtattttcgtgt

SEQ ID NO: 2703 - DNA, 538 bp, Panicum virgatum
cccaaccctccacatcaccaccgagctctcgatttcaatctcaccaccatgtcgggccgcggcaagggaggcaaggggctgggcaagggcggcgcgaagcggcaccgcaaggtcctgcgcgacaacatccagggcatcaccaagccggcgatccggaggttggcccgcaggggcggcgtgaagcgcatctccgggctgatctacgaggagacgcgcggcgtgctcaagatcttcctcgagaacgtgatccgcgacgccgtcacctacacggagcacgcccgccgcaagaccgtcaccgccatggacgtcgtgtacgcgctcaagcgccagggccgcaccctctacggcttcggcggctgagatctgccttgggtcccaggctggtcgatggtgttagggttagcaatggtgtttggcgttcgttccatcagatgtctgaaggtgtatccttgtctgttttgtgcaaagcagtaatatgttctttgatgggaaatggaatccgaagcttatgaatgaaatccatcagtgttacttttct

SEQ ID NO: 2704 - DNA, 721 bp, Panicum virgatum
ccttgaatccccacccccgctcaaatccactccgaggaatccacaacccgtctggtcgtcggcaagcatgtctgggcgcggcaagggcggcaaggggctgggcaagggcggcgcaaagcgccaccggaaggtgctgcgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcactgccatggacgtagtctacgcgctcaagcgccagggccgtaccctctacggcttcggcggctaggctgatgcactcgccccctcgctgtctcccttctgcagctacgacgttatctgggcattgctcacaggtcttgctgtcaagaaagtctcagattcgcttgattagctcatctctggctgtagtaggtttatctgaaccatgagacattaatgaattgaagttaccttgtgaaattgggagccaagcttgtcgcggttgacttgtgacttttctgtgcatgtggctggtgttcttcttttactgctctatgaatgctgtgattattatgaaagcaagctggtcgtgctctgctagttctgtttcttgtgccgtttcgaattaatcagtggaatttcttgtgct

SEQ ID NO: 2705 - DNA, 631 bp, Panicum virgatum
cacttcacaccagcgcaaccaccaccacctacaagcgggagcgagcggcggcttcggcgatgtcgggcaggggcaagggcggcaaggggctcgggaagggcggcgcgaagcgtcaccggaaggtgctccgcgacaacatccaggggatcacgaagccggcgatccggaggctggcgaggaggggcggcgtgaagcgcatctccgggctgatctatgaggagacccgcggcgtgctcaagatcttcctcgagaacgtcatccgcgacgccgtcacctacacggagcacgcccgccgcaagaccgtcaccgcgatggacgtcgtctacgcgctcaagcgccagggccgcaccctctacggcttcggcggctaggttaggggtctgccgacgtgattcgggtcgatgggtagccctatcgccttcatgtgttccggtagttgctgtagcggagatgtagtcgctggttgcttggtctcttccgtgctggttgggtggatgtaagaaccgctgcttcgaagcacttggtttgcatgcaggatgctgatgtaggaaatttggttctgttcagtttagacttatgctcattgtctcgatgtggattatacgatgctattttgttttgttcagttttc

SEQ ID NO: 2706 - DNA, 590 bp, Tamarix hispida
  misc_feature (447)..(447): n is a, c, g, or t
gtgagcgaggaaggggatcaaaatcaatctcgctcttctttccttcaatcaagctctttactctcacagacagaaaatgtcaggccgtggaaagggaggcaaaggtttgggcaaaggtggggccaaacgtcaccgaaaggttctacgtgacaacattcaaggaatcaccaagcctgcaattaggcgtctagctagaagaggcggtgtcaagcgtatcagtggtttgatctacgaagaaactcgaggtgtgttgaagatctttcttgaaaatgttatccgtgatgccgtgacctacactgagcacgccagaaggaagactgttacagctatggatgttgtctatgctttgaagaggcaaggaaggaccttgtatggattcggtggttaagaaatttagggcagatcaaatgtagttacaaatcaatttagggttagggtttcgagttngattgcagaagtgtaattggtattagtttcgagtttggtgtttatgttagtagtcccttgttcggggtttgagggttttactgtaattgtccgtctctgtggtaatgaatttctcattcagtctattcttcgtttttcattct

SEQ ID NO: 2707 - DNA, 846 bp, Tamarix hispida
ggggatccccagcacacaaaattcctcatcaacaactctccaacattgtcattctctctcttttaaaaacaagaaggaatgtcaggccgtggcaagggaggcaaaggtcttggtaaaggaggagctaagcgacacaggaaggtattaagagataatattcaaggaataacaaagccagcaatccgtcgtttagctcgtcgtggtggtgtcaagcgtatcagtggtctgatctacgaagaaactcgtggtgtattgaagatatttcttgagaatgtgatccgtgatgctgtgacttacactgagcacgcaaggaggaagactgttacagctatggatgttgtttatgcattgaagagacagggtaggactttgtatggtttcggagggtaattaattatttctacttattgattttctgggttttgtggttggttggtggtgtttgaattaggtaaggggtatgagaatttgccgtgcattggtgtaaatgtttgatgatgccttagtggaaatggcttagttggcgtaatcgaattctctactgtcgaatggaacgaggaattgtagttcttgactttcagatctgttttgtctctcttggtttatggtattttgaattttttcaaatgttcacgggagcaatttgaaagctctttcaaataactggacatcgtactgccaaaaaaacattaaatcaattttcttagttcgttctaagctaaacctgattttctagctatttgagaatcttattgagaaggcgttgaaacttagtcgcgttcttcatgtgtatcgttttaattgaaattgttctgatgaagaacataacttcatggtctcacttca

SEQ ID NO: 2708 - DNA, 566 bp, Tamarix hispida
  misc_feature (95)..(95): n is a, c, g, or t
  misc_feature (278)..(278): n is a, c, g, or t
  misc_feature (302)..(302): n is a, c, g, or t
  misc_feature (314)..(314): n is a, c, g, or t
  misc_feature (332)..(332): n is a, c, g, or t
  misc_feature (341)..(341): n is a, c, g, or t
ggggatccacagtcaaaataaaaattcccgtcgaaccaaattcagcacagcaggagcaattatcaatcaagctatcaagaaagatgtcaggaagnggcaaaggaggtaagggattaggaaagggaggggcgaagcgacacaggaaagtactgagagacaacatccaaggaattaccaagcctgcaattcgtcgattggctcgtagaggaggagtgaagcgcataagtggtttgatttatgaagaaacaagaggcgtgctcaagattttcttggagaangtcatacgcgatgctgttacatanaccgagcatgcncgtcgtaagacggttacngctatggangtggtttatgcactcaagagacaggggcgtactctttatggatttggtggttagttagtcttgcttattagtttaatttcgatgaggtcattatctcagattcgtagctgtttatgttgcttgttcgggttgtgagctgctagagcatctggttcttgcgaaaactcgtattgtagtcccagatctggatatgaatcttgagcctgtatccatggcgatagtatg

SEQ ID NO: 2709 - DNA, 528 bp, Tamarix hispida
  misc_feature (16)..(19): n is a, c, g, or t
  misc_feature (355)..(355): n is a, c, g, or t
  misc_feature (455)..(455): n is a, c, g, or t
  misc_feature (458)..(458): n is a, c, g, or t
gggggatccggatctnnnnatcaacacaaaggctctctcttctctatcttgaatcaagttctctaatcacacacagaaaaacaagatgtcaggccgtggaaagggaggcaagggtctgggcaaaggaggagccaagcgtcacagaaaggttcttcgtgacaacatccaaggtatcaccaagcctgcaatcaggcgtctggccagaagaggtggcgtgaagcgtatcagtgggttgatttatgaagaaacccggggtgtgttgaagatcttcctagagaatgttattcgtgatgctgtgacttacaccgagcatgctagaaggaagacagttacggctatggatgtcgtatatgcnttgaagaggcaaggaaggactctgtatggttttggtggttaagtaatgctgaattagggttccgaaatctgtggtaggagtgaagtgatttcgttctaanttngggattatgttggtagtagctgtttgatatgttagactctttactgtaattgttggtctctatgctaatg

SEQ ID NO: 2710 - DNA, 735 bp, Camellia sinensis
ccatacgccgggggaccatttctcaaatcaaaaccctaaccctagatctacaattctctcttccgaactctctgaaaatgtctggtcgcggcaagggaggcaagggattgggcaaaggaggcgcaaagaggcacaggaaggtcctgagggataacattcagggcatcacaaagcctgcgattcggaggcttgcgaggagaggtggcgtgaagaggatttcaggtctcatctatgaggagacccgtggagttctgaagattttcctcgaaaatgtgattcgcgatgctgtgacctacacggagcatgctaggaggaaaacggtgaccgccatggatgtggtctatgccctcaagaggcagggtaggactctctatggcttcggcggttagattgtttcttaggcgtgtagattagtagtctcttttatctctattgataactttctctgttgccaatcaagctttttctagcattgttctgatggtgtttccaagttttttgtaattcttagttcaatatcagaagtaatagagcttatgtttcgttgctaagcattggatttcgtttgtgtttctttgtttcttcaaattaaactctgtttggattgtgagaaaatggtcgagaggagaatgcataagtccagtccatcttatggacacagcatccagttgggcttgtggccaattatggttgggggtgataaatgaatttaatgagttgaatggttaactgttt

SEQ ID NO: 2711 - DNA, 742 bp, Camellia sinensis
tatcggccattacggccggggaccatttctcaaatcaaaaccctaaccctagatctacaattctctcttccgaactctctgaaaatgtctggtcgcggcaagggaggcaagggattgggcaaaggaggcgcaaagaggcacaggaaggtcctgagggataacattcagggcatcacaaagcctgcgattcggaggcttgcgaggagaggtggcgtgaagaggatttcaggtctcatctatgaggagacccgtggagttctgaagattttcctcgaaaatgtgattcgcgatgctgtgacctacacggagcatgctaggaggaaaacggtgaccgccatggatgtggtctatgccctcaagaggcagggtaggactctctatggcttcggcggttagattgtttcttaggcgtgtagattagtagtctcttttatctctattgataactttctctgttgccaatcaagctttttctagcattgttctgatggtgtttccaagttttttgtaattcttagttcaatatcagaagtaatagagcttatgtttcgttgctaagcattggatttcgtttgtgtttctttgtttcttcaaattaaactctgtttggattgtgagaaaatggtcgagaggagaatgcataagtccagtccatcttatggacacagcatccagttgggcttgtggccaattatggttgggggtgataaatgaatttaatgagttgaatggttaactgttt

SEQ ID NO: 2712 - DNA, 702 bp, Camellia sinensis
tatcggccattacggccggggattgcaaactcatctttctcgttagctcaagcccttgaagtttccactctgtgtaactttctctctctagaaaaatgtctggtcgtggcaagggcggcaagggtttgggcaaaggaggagccaagcgtcacaggaaggtcctacgggacaacatccagggtatcactaagcctgcgattcgtcgtctggctcgcagaggcggagtcaagaggatcagtgggctcatctatgaggagactcgcggtgttctcaagatcttccttgagaatgttattcgtgatgctgtgacctacactgagcacgctcggaggaagactgtgactgccatggatgtcgtctatgctttgaagaggcaggggaggactctctatgggtttggcggttgagttgtcgctggtgtctttgttagggtttggtaaaggtaggtttgggggttgtaaattgtgttgttttaggatcaggttcttgtgttttgaattagtttaatctactgaaaatgttaatttggattggagatctgtttgttcttcaatgaattatgtttgattttgaatctagtattttgatgtgttaatttggtgtttgtttttaagttagtttgatttcactaacttggcatgttttcaaacgtggatttgaattttatgactgaattttatacagctgaatttactttatgtg

SEQ ID NO: 2713 - DNA, 587 bp, Camellia sinensis
cctcatctcatcatcactaagatttcgaaattatctctctcctctgaaaccctagaaatcttctctctctaaaaatgtctggcagaggaaagggtggtaagggattgggcaagggaggagcaaagaggcacaggaaggtccttcgagacaacatccagggaatcaccaagcctgcgattcggcgtctggctcggagagggggggtcaagaggatcagcggactcatctacgaggagactcgtggtgttctcaagatcttcctagagaacgtgattcgtgatgctgtcacctacactgagcatgctcggaggaagactgtgaccgccatggatgtggtctatgctctgaagaggcagggaaggactttgtatgggtttgggggttgagtttttagggtttcgtttggtttggcgtttttggggggttattagggtttgttggctgtaaatggtggtttaggggttagtttcatgtgtttttgaaattgggttttagtgtttttaaatgtttctaagttgaatgtactgtagtcttatttggattggaaatgtgtttgttcttcaatgatattccttgatttcggatcc

SEQ ID NO: 2714 - DNA, 610 bp, Camellia sinensis
tatcggccattacggccggggatctcatcatcactaagatttcgaaattatctctctcctctgaaaccctagaaatcttctctctctaaaaatgtctggcagaggaaagggtggtaagggattgggcaagggaggagcaaagaggcacaggaaggtccttcgagacaacatccagggaatcaccaagcctgcgattcggcgtctggctcggagagggggggtcaagaggatcagcggactcatctacgaggagactcgtggtgttctcaagatcttcctagagaacgtgattcgtgatgctgtcacctacactgagcatgctcggaggaagactgtgaccgccatggatgtggtctatgctctgaagaggcagggaaggactttgtatgggtttgggggttgagtttttagggtttcgtttggtttggcgtttttggggggttattagggtttgttggctgtaaatggtggtttaggggttagtttcatgtgtttttgaaattgggttttagtgtttttaaatgtttctaagttgaatgtactgtagtcttatttggattggaaatgtgtttgttcttcaatgatattccttgatttcggatgaaaaaaa

SEQ ID NO: 2715 - DNA, 628 bp, Camellia sinensis
tatcggccattacggccggggactccaaaaccaatctttctcatcatcttcgaatcattcagttgaatttcactagaaatgtcgggaagaggaaagggaggaaagggtttgggaaagggaggagcgaagaggcacaggaaagtcctcagagacaacatccagggaatcaccaagcccgcgatcaggaggctggctcggaggggaggagtgaagcgtatcagcggtctgatctacgaggagacacgtggagtgctcaagatcttcctagagaacgtgattcgtgatgctgtcacatacactgagcatgctcgccgcaagactgtcacggccatggacgttgtttatgccctcaagaggcaggggagaactctctatgggtttgggggttagggtttttggtcacaaaagtcttgctgtcaagaaagagaggtcatggggatgtttagggttctgggtttgttagggttagttacgagtattggggtttgttttacattcgtgtaattataagttgtttctgatttcttgcatttcgtcttctactactactactacttgtagtgttcttgttaaggcattgttatgaaacttcaatttcagaattactcttctctttcttcttgtgcag

SEQ ID NO: 2716 - DNA, 645 bp, Camellia sinensis
ggggccaccaaaaaaactcaaatcaagcattcaaattcatttcactttcatttcaaaaccctagatttcagaaaatgtctggtcgtggaaaaggaggcaagggcctgggaaagggaggtgcgaagaggcacaggaaagtcctcagagacaacattcaaggcatcacgaagcctgcgattcgcagacttgcgaggagaggtggtgtgaagagaatttcggggctgatctatgaggagactcgcggtgttctcaagattttcctggaaaatgtgattcgtgatgctgtgacttacacggagcatgctaggaggaagacggtgacggccatggatgtggtctatgctctcaagaggcaaggaaggactctctatggatttggtggttagattgtctgttgcaagcgaaccgattgtagatgttatttcttcttcctcactcgatcaatcttatgtaattctgttttttttttgaatctcaagtaatggagctttattttgttgcaaagtttggattttgttttggtattgggtttgcaatattggattctatttgggtgcaaaaaaaaagagctttgaattataggttagcagtatttgaatgttggtctttatagaaatgtatttcagtgcttgaacatgtactctg

SEQ ID NO: 2717 - DNA, 694 bp, Camellia sinensis
tatcggccattacggccggggccaccaaaaaaactcaaatcaagcattcaaattcatttcactttcatttcaaaaccctagatttcagaaaatgtctggtcgtggaaaaggaggcaagggcctgggaaagggaggtgcgaagaggcacaggaaagtcctcagagacaacattcaaggcatcacgaagcctgcgattcgcagacttgcgaggagaggtggtgtgaagagaatttcggggctgatctatgaggagactcgcggtgttctcaagattttcctggaaaatgtgattcgtgatgctgtgacttacacggagcatgctaggaggaagacggtgacggccatggatgtggtctatgctctcaagaggcaaggaaggactctctatggatttggtggttagattgtctgttgcaagcgaaccgattgtagatgttatttcttcttcctcactcgatcaatcttatgtaattctgttttttttttgaatctcaagtaatggagctttattttgttgcaaagtttggattttgttttggtattgggtttgcaatattggattctatttgggtgcaagaaaaagagctttgaattataggttagcagtatttgaatgttggtctttatagaaatgtatttcagtgcttgaacatgtactctgtttcatctggatcggagctcctgtattttggag

SEQ ID NO: 2718 - DNA, 532 bp, Camellia sinensis
aatcaatctctctctcttcatatttcacttaactcatcaatctttgtcactccattcgacaataatgtctggtcgtggaaagggaggcaagggtttgggcaagggcggagcaaagcggcaccgcaaggtcctccgagacaacatccaggggatcacgaagccggcgattcggaggctggccaggagaggaggtgttaagagaatcagtgggctgatctatgaggagactcgaggagtgttgaagatcttcttggagaatgtgattcgcgatgctgtgacctacacagagcacgctaggaggaagactgtgactgccatggatgttgtctatgctctcaagaggcaggggaggactctgtacggttttggaggttgatgcttgggtttgggattctgtttttgttgggggttttggccttaaaatgtcgatttatgcaatggataattgtttggtctgtggttatgtaatagaatgactccacatttcaatataatgcatttctggtttcggtacaaaaaaaaaaaaaaaaaa

SEQ ID NO: 2719 - DNA, 545 bp, Camellia sinensis
tatcggccattacggccggggatcaaattcaaatcaatctctctctcttcatatttcacttaactcatcaatctttgtcactccattcgacaataatgtctggtcgtggaaagggaggcaagggtttgggcaagggcggagcaaagcggcaccgcaaggtcctccgagacaacatccaggggatcacgaagccggcgattcggaggctggccaggagaggaggtgttaagagaatcagtgggctgatctatgaggagactcgaggagtgttgaagatcttcttggagaatgtgattcgcgatgctgtgacctacacagagcacgctaggaggaagactgtgactgccatggatgttgtctatgctctcaagaggcaggggaggactctgtacggttttggaggttgatgcttgggtttgggattctgtttttgttgggggttttggccttaaaatgtcgatttatgcaatggataattgtttggtctgtggttatgtaatagaatgactccacatttcaatataatgcatttctggtttcggtac

SEQ ID NO: 2720 - DNA, 532 bp, Camellia sinensis
tatcggccattacggccggggatcaaaatctctgtctatttgagttgactcatcaatcaatctttgacgcaatgtctggtcgtggaaagggtggtaagggtttaggcaagggtggagcaaagcggcaccgcaaggtcctccgagacaacatccaggggatcacgaagccggcgattcggagactggcgagaagaggaggtgttaagaggattagcggtctgatctatgaggagactcgaggagtgttgaagatcttcttggagaatgtgattcgtgatgctgtcacctacacagagcacgctaggaggaagactgtcaccgccatggatgttgtctatgctctcaagaggcaagggaggactctgtacggttttggaggttgaggctttgggttttgtttaggtctgtgcttatgtaatagaattaatgactctacatttcaatataatgcatttctggttttgctacgacatttctctctgtgtatgttgttgttgtgtgtgtctctaatctaatactatgattttcgtct

SEQ ID NO: 2721 - DNA, 567 bp, Thellungiella halophila
ggctctaattgagattcttcttcatcatttaattttcacgagcaaatccaatttacatcggaaaaaatgtcgggtcgtggaaagggaggaaagggtttggggaaaggaggagcgaagcgtcacaggaaggttctgagagacaacatccaaggaatcaccaagccggcgattcggaggctggctcgtagaggtggagtcaagcgtatcagtggtctgatctacgaggagacacgtggcgtcctcaagatctttttggagaacgttatccgtgacgccgtcacatacaccgagcacgccaggaggaagacggtgactgccatggacgtcgtttacgcgctcaagaggcaaggcaggactctctacggtttcggcggttaagaatctgttctgcttcgagtttgtgtttctccttttctgggttctctgaattaggcgtattattctagaaatttctgatcaaatcatgttctacttagcgttttcgttatatgtaattacgccttatcttttgttttagtgatttgttgtcattgtaatccacgattaagtacaagtttctggagaagt

SEQ ID NO: 2722 - DNA, 542 bp, Thellungiella halophila
ggctatcttctccgatcgtttaacaggtctttgatatctactgaaactgtgaagagatgtcaggaagaggaaagggaggaaaggggttgggaaagggaggagcgaagaggcacaggaaggtgctgagggataacattcaaggtatcaccaagcctgcgattcgtcgtcttgctcgtagaggaggcgtcaagcgtattagcggtctgatctacgaggagaccagaggagtgctcaagatctttctcgagaatgtcatccgcgacgccgtcacctacacagagcacgcccggaggaagacggtgactgccatggacgttgtctatgctctgaagaggcaaggtcgtactctctacggtttcggcggttaatcgactcgacgacagttttaggaaatgggattttagggttctgaaaatcttgtttctgaaatcttcgtgttttcatttgattacccaaagtaaatccaggaagtagctatcgttttcatttgccaatatgatattgtattacgctgagaatttccaaatagtaagttgagatgg

SEQ ID NO: 2723 - DNA, 956 bp, Nicotiana tabacum
agaggagcaatggtaggaaaaggaagttttggttgtgtttatttggctactttaaagaaccccagattgaaaaatagctactttccagcagttatggctgtgaaatctgccgaggtttcagtttcgggttcaattcaaaaggaaagggaggttttgaacaacatcaagggttgtccttatataattcgatgctttggtgacgagactaccacaggtcaaaatggtgcaatggtttataacttgttgttggagtatggttcaggtggaaccctagctgagaggatcaagaaatcaggaatcaaaggattatctctcacaatctttcatattaaggaacttttaatttcagagaaattaaaggctgattgaaaatgtctggacgtggaaaaggaggaaaaggattaggaaagggaggagcaaaacgacaccgtaaagtccttcgtgataacatccaaggtatcacaaaaccagcaattaggcgtttggctcgtagaggaggagtgaagcgtatcagtggactcatctatgaggagacacgtggcgtgctgaagatctttttggaaaatgtgattcgtgatgctgttacatacactgagcacgctcgcagaaagactgtgactgctatggatgttgtttatgctctcaagagacagggaaggactttgtatggatttggaggttaattgggagatttggtttttgacttttgttttgtctgcaaaagtcttgctgtcaagaaaagaactagaatgattactatatgtggtatatggggtttgttttgctattgattaggtatctgttttggtgtaattagtatgattacctgttggtgatagggttcttttgcagtagtattggtcgtttttgtaagctgaatttggttgatgcttgattcagtacttctgaaatttgctttattgcaatgaatattagtgactgattcagtttcacca

SEQ ID NO: 2724 - DNA, 468 bp, Nicotiana tabacum
  misc_feature (259)..(259): n is a, c, g, or t
  misc_feature (272)..(272): n is a, c, g, or t
ccggggaccatcaattcaatctcaaaatcttctaaaaaaaggcttaaaaatgtcaggccgtggaaagggaggcaagggattaggaaagggaggagcgaaacgacaccgtaaggtattacgtgacaatattcagggaattacaaagcctgctattaggaggctagctagaagaggtggagtgaagagaattagcggattgatttacgaagagacacgtggagtgttgaagatctttctggaaaatgtgattcgtgatgcntgtgacttacacntgagcacgctaggagaaagactgttactgctatggatgttgtttatgcgcttaagagacagggtaggactctttatggatttggtggttaagtttttggatctgggttttgggtattttgtttagtttacttttgttgatgtaattcactggctttttaaatcaatgaaatatcttgtttcagtttcaaaaaaaaa

SEQ ID NO: 2725 - DNA, 581 bp, Nicotiana tabacum
ggccattacggccgggggccgaatacatttcaattcaaatccaaaaccctagaagcttcttttatcttcaaatttctgtgtaaaaatgtctggtcgtggaaagggaggcaagggattgggcaagggaggagcgaagaggcacaggaaggtgctgagggataacatccagggaattacgaagcccgcaattcggcgattggctcgtaggggaggtgtgaagcgtattagtgggttgatctacgaggagacacgtggcgtgttgaagatctttctagagaacgtgattcgtgatgctgttacctacactgagcacgccaggagaaaaactgttactgctatggatgttgtttacgcactcaagaggcagggcaggactctctatggatttggtggttaggttgtttagtttgtgattttaggttagtgtaatggtagtaattgtagattttctggaaatttctgttggtttctcagcagctttgttctagttcttcttcttaaggtcttgatattgtaatttctcattgcagattcaaggaacaaagttcatttctagaaattacgatggttatattctggct

SEQ ID NO: 2726 - DNA, 519 bp, Nicotiana tabacum
ccggggatcataatccgaagcaacaacagatcttcccatattaagttcaaatttcaaaatccccaaaatcttttctcaatatgtcaggaagaggcaagggaggtaaaggattgggcaaaggaggagcaaagaggcacagaaaagtattaagggacaacattcagggaatcactaagcctgcaattcggcgtttggctcgtagaggaggagtaaagcgtatttctggtttaatttatgaggagacacgtggggtgttgaagatatttttggagaatgttattcgtgatgctgtgacgtacactgaacacgctaggagaaagactgttactgctatggatgttgtttatgcgctcaaaaggcagggcaggactctttacggatttgggggttagatttgtcaaattagggtttttgtgggtaattattatagatttgtacttttgctgccgttgtgttttagggttgcttagttttggtaaggttgatgatgtaattcaccgttacatagtcaaggaatag

SEQ ID NO: 2727 - DNA, 312 bp, Nicotiana tabacum
  misc_feature (195)..(195): n is a, c, g, or t
atgtcaggccgtggaaagggaggcaagggattaggaaagggaggagcaaaacgacaccgtaaggtattacgtgacaatattcagggaattacaaagcctgctattaggaggctagctagaagaggcggagtgaagagaattagcggattgatttacgaagagacacgtggagtgttgaagatctttctagagaangtgattcgtgatgctgtgacctacactgagcatgccaggagaaagactgttactgctatggatgttgtttatgcactcaagaggcagggtaggactctctatggatttggtggttaa

SEQ ID NO: 2728 - DNA, 691 bp, Nicotiana tabacum
ggccattacggccggggatcaaaatccgaatcaagaatatttcttcccatatcaagttcaaatttcaaaacccccaaaatctttactcgaaatgtcaggaagaggcaaaggaggcaaaggattgggcaaaggaggagcaaagaggcacagaaaagtattaagggacaacattcagggtatcactaagcctgcaattcggcgtttggctcgtaggggaggagtaaagcgtatttctggtttgatttacgaggagacacgtggggtgttgaagatatttttggagaatgtgattcgtgatgctgtaacttacacagaacacgctaggagaaagactgttactgctatggatgttgtttatgcgctcaagaggcagggtaggactctttacggatttgggggttagatttgtcaaattaggggttttgtgggtaattattatagatttgtacttttgctgtctttctgttttaggggtgcttagcttttggtaaggttgatgatgttattctcccttacatattcaaggaatagtaattgcttggtccttatttctgtcttctttattatctaaactatttgtattaattttgcttttcaagtgtatttggtagaaagtatagctaattatgaattgggtatgtcgtgaaagttgtttaattgataatctaatcttttctgctcaggatatttc

SEQ ID NO: 2729 - DNA, 586 bp, Nicotiana tabacum
gcggggacaaacaatcaaagttcacttctctcttttaaattcaaaaccctagaaattaaatttcaatttcctctctctgaagcttctgaaaaatgtctggacgtggaaagggaggcaagggattgggcaaaggaggagcaaagaggcacaggaaggtgctgagagataacattcagggaattacaaagccagctattcgtaggcttgctcgtaggggtggtgtcaagcgtatttctgggttgatttatgaggagacacgtggagtgcttaagatctttttggagaatgtgattcgtgatgctgttacctacactgagcacgctaggagaaagactgttactgctatggatgttgtgtacgctctcaagaggcagggaaggaccttgtacggatttggaggttaaatattgggggttagggtttatagtgttttgttgttagtgattgtagatttcatgtttgtgctttctgtttgtgttagtggtcggtttaagctagggtactttaatttctgttgctaaggtctggatattgtaattcctcgttatacaatcaagtaaaacagaccatttcagcggccgcatga

SEQ ID NO: 2730 - DNA, 554 bp, Nicotiana tabacum
aaacaatcaaagctcatatcgctcttttaaattcaaaaccctagaaattcaatttctattttctctctctcaagctttcgaaaaatgtctggacgtggaaagggaggcaagggattgggcaaaggaggagcaaagaggcacaggaaagtgttgagagataacatccaggggattacaaagccagctattcgtaggcttgctcgtaggggtggtgtcaagcgtatttctgggttgatttacgaggagacacgtggagtgcttaagatctttttggagaatgtgattcgtgatgctgtgacctacactgagcacgctaggagaaagactgttactgctatggatgttgtgtacgctctcaagaggcagggaaggaccttgtacggatttggaggttaaattttgggggttagggtttatagtgtttttgttgttagtgattgtagatttcatgtttgttttagcggtcagtttaagctagggtactttaagtttctgttgttaaggtctggatattgtaattcctcgttataaaatcaagtaatagagaccatttc

SEQ ID NO: 2731 - DNA, 517 bp, Solanum lycopersicum
atcatctcttcaattcaattttccaaaaattaaatttcaaaaccctgaaaaatgtcaggccgtggtaagggaggcaaaggattaggcaaaggaggagctaagaggcacaggaaggtgttaagagataacattcaaggtattaccaagccagctattcgtaggcttgctcgtagaggtggggtgaagcgtatttctggattgatttatgaggaaactcgtggggttcttaagatctttcttgaaaatgtgattcgtgatgctgttacatatactgaacatgctaggagaaagactgtgacggctatggatgttgtttatgctcttaagaggcaaggaaggaccctttacggatttggaggttagggtgttggttagtggttgtagatttggttttagtgaagttgggttagtttttttttgtttgattgtatgatcttgatattgtaattccttgttacacaaacaattaatggaaggagatcatatgtccagtaataattgcatttgttatgatttt

SEQ ID NO: 2732 - DNA, 485 bp, Solanum lycopersicum
ttcaattcaattttccaaaaattaaatttcaaaaccctgaaaaatgtcaggccgtggtaagggaggcaaaggattaggcaaaggaggagctaagaggcacaggaaggtgttaagagataacattcaaggtattaccaagccagctattcgtaggcttgctcgtagaggtggggtgaagcgtatttctggattgatttatgaggaaactcgtggggttcttaagatctttcttgaaaatgtgattcgtgatgctgttacatatactgaacatgctaggagaaagactgtgacggctatggatgttgtttatgctcttaagaggcaaggaaggaccctttacggatttggaggttagggtgttggttagtggttgtagatttggttttagtgaagttgggttagtttttttttgtttgattgtatgatcttgatattgtaattccttgttacacaaacaattaatggaaggagatcatatgtccagt

SEQ ID NO: 2733 - DNA, 498 bp, Triphysaria pusilla
tttccaatctcaatccctaacttatcagctgaaacaaaaaagaggttaaaatcaaatgtcgggaagaggaaagggaggtaagggattgggcaagggtggcgcaaagcgtcatcgcaaggtgttgagagataacatccagggcattaccaagccggccattcgccgtcttgctcgccgtggtggcgtgaagcgcatcagtggcctgatttacgaagagacacgtggcgtcctcaagatctttctcgagaatgtcatacgagacgcagtgacctacactgagcacgcccgccggaaaactgtgacggcgatggatgtcgtctatgctctcaagaggcagggtcgtactctctacggctttggcggttaagttctttggtttagggttttattgattgtatatttagggtacttcgattttctttatgtatggttatgtaatccttgtctcagatttcggaatgtcttgagtttcttattaatggaatttgaaactgggtt

SEQ ID NO: 2734 - DNA, 529 bp, Triphysaria pusilla
ccaaaattcaccaaatacaaaccaataatcacctcgaatttcattgatttgtcttgataatcacttctctgctataaaaatgtctggccgtggaaagggaggcaaggggctgggaaagggtggagcaaaacgacaccgtaaagttctccgagataacatccagggcataacaaagccggcgatccggcgtctggcgaggagaggtggagtgaagagaatcagtggtctgatatacgaagagacaaggggagttttgaagatattcctcgagaatgttattagagatgccgtgacctacaccgagcatgccaggaggaagacggtcactgccatggatgttgtctatgctttgaagagacagggccgtacactttacggatttgggggttaattattgtatttctccctaattttatatttctgctgttcctttgttgtttaatggagtgaatttaagtattgaaatttgttaatctggtaatgttaatgatttatctcctttgctactttgaatcttgttagttggttc

SEQ ID NO: 2735 - DNA, 515 bp, Triphysaria pusilla
agtccaaaattcaccaaatacaaaccaataatcacctcgaatttcattgatttgtcttgataatcacttctctgctataaaaatgtctggccgtggaaagggaggcaaggggctgggaaagggtggagcaaaacggcaccgtaaagttctccgagataacatccagggcataacaaagccggcgatccggcgtctagcgaggagaggtggagtgaagagaatcagtggtctgatatacgaagagacaaggggagttttgaagatattcctcgagaatgttattagagatgccgtgacctacaccgagcatgccaggaggaagacggtcactgccatggatgttgtctatgctttgaagagacagggccgtacactttacggatttgggggttaattattgtatttctccctaattttatatttctggtgttcctttgttgtttaatggagtgaatttaagtattgaaatttgttaatctggtaatgttaatgatttatctcctttgctacttgga

SEQ ID NO: 2736 - DNA, 621 bp, Triphysaria pusilla
caataatcaacaaaaatatctcatcacaagaacaagagtcttttctcatttccaattacagctaccgaaaaaattagggttaagtgaaatgtcgggaagaggtaagggcggcaagggattgggaaagggtggcgcaaagcgtcatcgcaaggtgttgagggacaacatccagggcatcacaaagccggctatccggcgattggctcgccgtggtggagtcaagcgtatcagcgggctgatttacgaggagacacgtggcgtcctcaagatattcctcgaaaatgtcatccgtgacgccgtcacctacactgagcacgctcgccggaagactgtgacggcgatggatgttgtctacgcgctcaagaggcagggccgtacgctttatggcttcggcggttaggttcatagtgttacggtttcattagattagctttagacttctgttattgtgtttgattgatttttataccgatttatctttgatctatgtatgtgcttattttgttatgtggaatgaaatttcagtgtttgtaagaatcatatgctttctaagactgctaacatcattattgtatctaggctggtatctcttctgctcgaaaggctttatgttgactatgg

SEQ ID NO: 2737 - DNA, 486 bp, Triphysaria pusilla
aatcacagctaacaagtttcagaagaaataaaaaatgtcaggacgaggcaaaggcggcaagggtttgggaaagggcggtgccaagcgccatcgcaaagtcctccgcgacaacatccaaggcatcaccaagccagccattcgccggttagctcgccgtggcggagttaaacgaatcagcggtttgatctacgaagagactcgcggcgtcctcaagatcttcctagagaacgtcatccgtgacgccgttacctacactgagcacgctcgccgtaagaccgtcactgccatggacgtcgtatatgctcttaagaggcagggccgtactctgtacggttttggcggctgaggtcgtctctagggttagggcttttgttaaatcgaaatgtatgatgtttaattcgttcaatgcagtgtgttctgttctaatattcgatcttgtgttggttaatttgaaacaatcattttagattatgcattctgtgtttc

SEQ ID NO: 2738 - DNA, 606 bp, Triphysaria pusilla
tcttgctcctctatattaaccctaaaaaatctccccattttcaccactcacaaatcaacaatcaactcagttttcatttcttcattctgataaccttctctctgtgataaaaatgtcgggccgtggaaagggaggcaaggggcttggcaagggcggagcaaagcgacatcgcaaggttctccgagataacatccagggcataacgaagccggcgatccgccgtctggcgaggagaggtggagtgaagagaatcagtggtctgatatacgaggagacaagaggagttttgaagatatttcttgagaatgttatcagagacgctgtgacctacaccgagcacgctaggaggaagacggtgactgccatggatgttgtctatgctttgaagaggcagggccgtacgctttacggattcggcggttaattttagtgtttctcccctctttcttatttctattggtcctttttttttcctttttctagccttgaatttgaacctcagatggttggtgatttgtggatcttggcttatgtcagtgtaattgatcgattttataagtaatggcaaatgttagttttaatatcctctgttcacttgattcttct

SEQ ID NO: 2739 - DNA, 591 bp, Triphysaria pusilla
ccaaaattcaccaaatacaaaccaataatcacctcgaatttcattgatttgtcttgataatcacttctctgctataaaaatgtctggccgtggaaagggaggcaaggggctgggaaagggtggagcaaaacggcaccgtaaagttctccgagataacatccagggcataacgaagccggcgatccgccgtctggcgaggagaggtggagtgaagagaatcagtggtctgatatacgaggagacaagaggagttttgaagatatttcttgagaatgttatcagagacgctgtgacctacaccgagcacgctaggaggaagacggtgactgccatggatgttgtctatgctttgaagaggcagggccgtacgctttacggattcggcggttaattttagtgtttctcccctttttctatttccattggtccttttttctttctggccttgattgtgaagctcagtttgttggtgatttgtggatcttggcttatggcaatgtaattgaacgattttacaagtaatggcaattgttagttttaaatatcctctgttaatttgaatcttcttatttggttcgtgtgttaaaagaa

SEQ ID NO: 2740 - DNA, 556 bp, Triphysaria pusilla
accgaaaaaattagggttaagtgaaatgtcgggaagaggtaagggcggcaagggattgggaaaaggtggcgcaaagcgtcatcgcaaggtgttgagggacaacatccagggcatcacaaagccggctatccgccgattggctcgccgtggtggagtcaagcgtatcagcgggctgatctatgaggagacacgtggcgtcctcaaaatattcctcgagaatgtcatccgtgatgctgtcacctacactgagcatgctcgccggaagactgtgacggcgatggatgttgtctacgcgctcaaaagacagggccgtacgctttatggcttcggcggttaggttcatagtgttacggtttcatcagattagctttagatttctattattgtgtttgaattgagtgttataccgatttatcttagatccatgtatgtgcttcttttgttatgtggaatgaattttcagtgtttgtaagtttcatgtcttttagtttaacatcactctttcaatatttagttctattgaatagcttgattgttttttgagctcaattgcagc

SEQ ID NO: 2741 - DNA, 400 bp, Triphysaria pusilla
ttatttttttaaattcaatcagctaaaaatgtcgggccgtggcaagggaggcaagggcttggggaagggtggagcaaaacgacatcgtaaggtgctgagggacaacatccaggggatcacaaagcccgctattcgccgtttggcccgcagaggtggcgtcaagcgtatcagtgggctcatctatgaggagactcgtggtgttttgaagatctttttggagaatgtcattcgcgacgctgttacctacactgaacacgctcgccggaaaactgtcactgccatggatgttgtttatgcattgaagaggcaaggccgcactctctacgggttcggtggttaggatctagggtttggtgctatttgtataaattgaatgcttatgaaatcggatcttatggta

SEQ ID NO: 2742 - DNA, 496 bp, Triphysaria pusilla
aaaatcatcatctcaattacagtttcctaatctcaaacagcaaaacccgaaaatgtcaggccgcggcaaaggaggcaagggcttaggaaagggaggagcaaaacgtcatcgtaaggtgctgagggacaatatccagggcatcaccaagcccgcaattcgtcgtctggcccgcagaggtggtgtcaagcgtatcagcgggcttatctatgaggaaacccgtggtgtgttgaagatctttttggagaatgtcatccgtgacgcagtcacctacactgagcacgctcgccggaaaactgtgactgcaatggacgttgtctatgctttgaagaggcagggccgcactctgtacgggttcggtggttaagattctagggtttatatgatttgtaaaaaatgcgtgctttatgattctagaatattggtcaatttgcttagtttggaaattagggtttggttttgatctatcttagatcttgtgttcttttcaattgaaatg

SEQ ID NO: 2743 - DNA, 505 bp, Triphysaria pusilla
aaaatcatctctcaattccagtttccgaatctcaaacagcaaaatctgaaaaatgtcaggccgcggcaaaggaggcaagggcttaggaaagggaggagcaaaacgtcatcgtaaggtgctgagggacaacattcagggcatcaccaagcccgcaattcgtcgtctggcccgcagaggtggagtcaagcgtatcagcgggctcatctatgaggaaacccgtggtgtgttgaagatctttttggagaatgtcatccgtgatgctgtcacctacactgagcatgctcgccggaaaactgttactgcaatggacgttgtttatgctttgaagaggcagggccgcactctgtacgggttcggtggttaagcaatttagggtttgataagatttgtaaaaatgtttgctttatggttcaggaatattggtgaatttgcttagtagcttagtttggaaattagggtttggtattgatctatcttggatcttttgttattttcaattgaaatg

SEQ ID NO: 2744 - DNA, 476 bp, Triphysaria pusilla
aatctcaaacagcaaaatctgaaaaatgtcaggccgcggcaaaggaggcaagggcttgggaaagggaggagcaaagcgtcatcgtaaggtgctgagggacaacattcagggtatcaccaagcccgcaattcgtcgtctggcccgcagaggtggagtcaagcgtatcagcgggctcatctatgaggagacccgtggtgtgttgaagatctttttggagaatgtcatccgtgacgccgtcacctacactgagcacgctcgccggaaaactgtcaccgcaatggatgttgtctatgctttgaagaggcagggccgcactctgtacgggttcggtggttaagaattttagcgtttgatatgatttgtaaaaattgttgctttatggttcaggaatattgatgaatttgcttagtagcttaaaatggaaattagggcttgtttttatctatcttggatttgtgttcttttcaattgaaatg

SEQ ID NO: 2745 - DNA, 725 bp, Juglans hindsii x Juglans regia
  misc_feature (22)..(22): n is a, c, g, or t
  misc_feature (29)..(29): n is a, c, g, or t
  misc_feature (601)..(601): n is a, c, g, or t
ggggacgatattctacacaaancaaaganatcccaaattcgaaaccctagatctctctctctcagctgaaatgtcgggtcgtggtaagggtggcaagggattgggcaaaggaggagctaagaggcacaggaaggtgcttcgggacaacattcagggcatcaccaagcctgcgattcggcgtctggcaaggagaggcggtgtcaagaggatcagcggtcttatatacgaggagacccgcggcgttctcaagatcttccttgagaacgttatccgcgacgccgtgacctacacggagcacgcccggaggaagacggtgaccgctatggatgtggtctacgcgcttaagagacagggcaggaccttgtatggattcggtggttgagttacgttcttgtttaatctgccagagctgtaaattcgttaatcatccctgtagtagtcgtgatgcctgttgcagttgtagttgtagagtttcatgactctaggctattccttttcgcatgtgatttggattttgtttgaaatgaaggctggatggatcgtaactgaacgttttgcgaaatttttttatcaaactgttaagtgaattagccatatccantttcctatatcgtggtttgttgccggatatttatgattttctcactcaaaatacttgtgaaatttcaatcgtgtactgttagctatatggaattaagtgattagattgagttatgatcaggtcc

SEQ ID NO: 2746 - DNA, 614 bp, Juglans hindsii x Juglans regia
  misc_feature (529)..(530): n is a, c, g, or t
  misc_feature (589)..(589): n is a, c, g, or t
ttttcaccaaagcaaaagtaaaagtaatcccaattcaaaaccctagatctatctgagtgtggaaatgtcgggtcgtggaaagggaggcaagggtctgggtaagggaggagccaagaggcacaggaaggtgctccgcgataacatccagggcatcaccaagcctgctattcgccgtctggctcggaggggcggcgtcaagaggatcagcggcctcatctacgaggagacgcgtggtgtactgaagatatttctcgagaacgttatccgcgacgcggtgacatatacggagcatgctcgtaggaaaacggtgaccgccatggatgtggtttatgcgctcaagaggcaagggaggaccttgtatggtttcggtggttgatttggtttgctattatgctcttttagacctgtaaatcagttaattgccattgctgtagtcgtagtttctggtctagagttcgtggttatgtaggttggattgcttgtagcgaaaacttcttagcccttggttcaacttatgctgaatttctcnngaactattatttgaactttctatgttacgtcctatgatttccaggtaatttccctgatngcacaaggtttttgtgtagcttgag

SEQ ID NO: 2747 - DNA, 435 bp, Juglans hindsii x Juglans regia
tattttccggaaaaatgtcgggacgtggtaagggtggtaagggtttgggcaagggaggagcaaagcgtcaccgtaaggtcctccgggacaacatccaaggcatcaccaagcctgcgatacgccgtctggctcgtaggggtggtgtgaagcgtatcagcggattgatctacgaggagactagaggtgtcctcaagatcttcttggagaacgtcattcgtgatgccgtgacgtacaccgagcacgcaaggagaaagactgtgacagccatggacgtggtttacgctttgaagaggcagggaaggactctctatggatttggtggttagactgtataatttgggccttaaaatgttaagttcgtactagtggtagtagatcttggctatagatctggtttgtgttcgtttttgttatttccttgtgtttctgcagact

SEQ ID NO: 2748 - DNA, 698 bp, Triticum aestivum
  misc_feature (16)..(16): n is a, c, g, or t
  misc_feature (684)..(684): n is a, c, g, or t
  misc_feature (687)..(687): n is a, c, g, or t
cgctcatagttccttngaggtggcctctcagaatcatcaccaaactcgccttcacgatacccaccacgacggcctcccccctggtagggttgccgaggggccctctctctgtcctgggcgccttcctcacctccagttctggcaccataacctcccctgtagccatttggccgccaccatttccatctcagtcagctccaagccatcaaccatgtccggccgcggcaagggagggaagggcctcggcaagggcggtgccaagcgccaccggaaggttctccgcgacaacatccagggcatcaccaagccggccatccgccgtctggcgcgcaggggcggcgtgaagcgcatctcggggctcatctacgaggagacccgtggcgtgctcaagatcttccttgagaacgtcatccgcgacgccgtcacctacacggagcacgcccgccgcaagaccgtcaccgccatggacgtcgtctacgcgctcaagcgacagggccgcaccctctacggattcggcggctgacctgcatcttcagagtcgactctgccagctgctgcagctgtcccggtgctatggtttcgtttccgagtgcgtgtgttgctgttccatgggtctgtgtagttagtggaattgcgatggatctgaatgtaatggagttgctggttcttgcaagaaacgaatcnaanaaatcgaaatt

SEQ ID NO: 2749 - DNA, 556 bp, Triticum aestivum
tataaataagcattttttttccagccaccaccagaccagcagcgcacacacacaccagccaagccaagggaaggtcgccggagagagaagcgtggaagatgtccgggcgcggcaagggagggaaggggctgggcaagggcggcgccaagcgccaccggaaggtgctgcgcgacaacatccagggcatcaccaagccggcgatcaggcggctggcgcggcggggcggcgtgaagcgcatctcggggctcatctacgaggagacccgcggcgtgctcaagatcttcctggagaacgtcatccgcgacgccgtcacctacaccgaagcacgcccgccgcaagaccgtcaccgccatggacgtcgtctacgcgctcaagcgccagggccgcaccctctacggcttcggcggctaggtccagtcgaatccacctcgcgccgccagattcctactagtatatagctagctatggttgttacagtgttcattctcgctggctgttgttacagtgttccagtgtttggatgtagtatgatagaatggaaatcgcagcattttac

SEQ ID NO: 2750 - DNA, 603 bp, Triticum aestivum
ccaccagcagccgccagcaccaccgctcctcctccacctcgatccaaatcacacatcagctcaaaggaaggaagccgtcagccatgtccggccgcggcaagggagggaagggcctcggcaagggcggcgccaagcgccaccggaaggtgctgcgcgacaacatccagggcatcaccaagccggcgatccgccgtctggcgcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtatacgcgctcaagcgacagggccgcaccctctacgggttcggcggctaggccgcgccggtccgggcaagaaggacccgtctcgcaccaccggatttgtgctagtagctacgcgttgtctgatggtggtgttcatgtcctcggtgtaatggccgcatctcgctgctgtttgccctggatttgtttgttgtttggatgtactaggatggaatggaaatcgcagcattttacccctgaattcgtacgtaatctgtgggtc

SEQ ID NO: 2751 - DNA, 570 bp, Triticum aestivum
gcgactcccattatcccctgttagactgcttccatctcatctccggcgatgtctgggcgtggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgtcgcaagaccgtcaccgccatggacgtcgtgtacgccctcaagcgccagggccgcaccctctacggctttggcggctgagcgccatcagctcgctggctgaccctgctgtttcctgcgttgctctgtagtcgtatcccccctgtcgtgaatctagtgcgctggctatgcttgtttctgtagtttgtctagtgaaatccaacttctagttgtaactcctatcgtttcctttcgttgcaatgacaagttaattccaatctcagaaaaaccatcatgtctgattctgctttt

SEQ ID NO: 2752 - DNA, 552 bp, Triticum aestivum
gcgactccaagtttccctcggtaggcagcttccatctcatctccggcgatgtctgggcgcggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctgagcgccgtgagctcgccggctgaccctgctgtttcctgcgtggctgcgttgctctgtagtcgtaccccccccctgtcgtgaatccagtttgctggctatgtctgtttctgtagtttgtctagtgagatccaacttctagttgtaactcctatcgtttcgtttcgctgcaatgacaagttaattccaatctgag

SEQ ID NO: 2753 - DNA, 682 bp, Triticum aestivum
actcatcgcttccagccaccaaaccccgctccaaaatccccaaatcccctctcttcctaaagctactcggagcggcagccatgtcggggcgtggcaagggcggcaaggggctcggcaagggaggcgcgaagcgccaccgcaaggtcctccgcgacaacatccagggcatcaccaagccggcgatccggaggcttgcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggcggctgaagagtcgcggcgctgtctggccggccgtggcgcacaagccctggctcgcggtcaagaaagtggaggagaggagaaagctgtagttgatttgggttccatgccttctatgattagtagtaatatctgtagtagcagtagctggttgttcaatggttgcttcagtgttctgaatttctgatgggcaaacactgtgtttgccgagtaatatgaatccagagttatcaaaaattgtcctaaaactatgaattattgttaatgacgatgctgttctgtgtttgccaaaaaaaaaa

SEQ ID NO: 2754 - DNA, 601 bp, Triticum aestivum
acaccacacggccgcaacagccaccaccagaccagcagcgcacacacacacaccagccaagccaagggaaggtcgccggagagagaagcgccagagatgtccggccgcggcaagggagggaaggggctgggcaagggcggcgccaagcgccaccggaaggtgctgcgcgacaacatccagggcatcaccaagccggccatccggcggctggcgcggcggggcggcgtgaagcgcatctcggggctcatctacgaggagacccgcggcgtgctcaagatcttcctggagaacgtcatccgcgacgccgtcacctacaccgagcatgcccgccgcaagaccgtcaccgccatggacgtcgtctacgcgctcaagcgccagggccgcaccctctacggcttcggcggctaggccgcgccggtcaactcgaattcaccttgtgccgccagccagattcgtagcatagctagctatggctgtccagtgttcattgtcttcagtgtaatggccgcatctcgccgttcttgttcagtgttcagcgttcagtgtttggatgccatacgatagaatggaaatcgcagcattttaccctcgaaaaaaaaaa

SEQ ID NO: 2755 - DNA, 613 bp, Triticum aestivum
gtgcattcgaaagacacattttatagataaagaagttctcataaagctgcaaatatcatttccaacccaccaccaaacacaatccaagccaatcccaccggagagaagagaagatgtcgggccgcggcaagggaggcaaggggctgggcaagggcggcgccaagcgccaccggaaggtgctgcgcgacaacatccagggcatcaccaagccggcgatccgccgtcttgcgcggcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggccgagggcccagccagctcgcgacgccgccgtccggcagagtagtggtatctatctagttgctgtctagggttcgtggttctccttgtatgtcgctggtgtttgtctgctcccgtcttgtgagctgatgttgtactggaagaaatttggaatggaaattgcagtagcttacccccgaaaaaaaaaaa

SEQ ID NO: 2756 - DNA, 655 bp, Triticum aestivum
gagagagagagagagagagagagagagagagagagagagagccaccaccgctcctcctccatttccatctcagtcagctccaagccgtcagccatgtccggccgcggcaagggagggaagggcctcggcaagggcggcgccaagcgccaccgtaaggtgctccgcgacaacatccagggcatcaccaagccggccatccggcgtctggcgcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgttgtctacgcgctcaagcgacagggacgcactctctacggtttcggcggctaggcctgcgcccgctgctgctccatcgagtcgactctgctggatgctgctgttcctctgctatggtttcgtttctgagtgcgtgtcctgctgttccataggtctgtgtagttagtagaaggcgatggatctgaatgtactggagttgttggttcttgcaagaaatgaatctgaatgaaatggaagttgtacttcatctctcgatatgattgtacctcctggcttgttcctgtaaattctaaaatttctcagc

SEQ ID NO: 2757 - DNA, 555 bp, Triticum aestivum
tcatcgctgtctggaacagcgagatcagcaccgcagcagccacctcccaaagacaagtcaacctcaccgaggagaagcagagagaagggagaagatgtcggggcgcggtaagggaggaaaggggctcggcaagggcggggccaagcgccaccggaaggtgctccgggacaacatccagggcatcaccaagccggcgatccgtcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcactgccatggacgtcgtctacgcgctcaagcgccagggccgcaccctctacggcttcggcggctaggccaccgccagattagctagcctgtgtctagggttcgttgtccatgatgtaattgcagcatctcgctgttgtttgctatcttctgtagaatcgaatggaatggaaattgaactagtttatcattggaatctgttgcgtccaaaaaaaaa

SEQ ID NO: 2758 - DNA, 598 bp, Triticum aestivum
atcagccaccgcagccaccacctacctcacaaagaaagacaggtcaacctcacccaggagaagaagagagagaagcgagaagatgtcggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggtttcgggggctaggctccggcgaggcgaatccagcttgcaccacttgatcagattagcagtagctaggcgttgtcagtgttcatggtaattgatgtaatttatgatgtgtggtgcctgttcgctggaatggattaaatcgctgttatttacccttaactcgccttcaatctcttggctgatcaacttgtgtgctcttccgtctgtttccaaattttc

SEQ ID NO: 2759 - DNA, 1027 bp, Triticum aestivum
gacatcaaatccccaatccccaatccccaatcccctccaatcccaccttcgggacagcagccagcaagcgtcgccagccatgtcaggccgaggcaagggaggcaagggcctgggaaagggcggcgcgaagcggcacaggaaggtgctgcgcgacaacatccaggggatcacgaagccggcgatccggcggctggcgcggcggggcggcgtgaagcgcatctccgggctgatctacgaggagacccgtggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggctttggcggctgagccagggtcgtgcctcgcgtgggatttagatgtggttaggcgggtcgtcgttctgtggtgtgtgcttgtcctgtgtgtgcgtgtgcagctgcgtgctggtggttgtaatgagttccagattataatatgggtgttcatctcgcattggattgaaaaaaaaaatcgggcggccgatctatagtatccctcgatgggcccaatcttagacgtacccaggtttgttgtacagagtggtccctatactgagtcgtatcataagttaggcaaaggccgacgtttgacacctgtgttgaatgggaaaaccgccacctgggcaactttgtaaagcgaccttagtactgggcccggacatacttgggcaagttaccaacgggtgtttgggctctcaggggaatttaaaagttcaaagggaaaatgggttaaactagaccccaaaccgtgcaggccgaacagctcagtcttctcgatagggattattaaaacctattaccgggagctccggatgctatggtgcgggattataacaccacgaccccaagggtctttaaaggcccccacccccaaggcatgcgaatatccataccagcatccacgttagaacggtttccatgtgttaaaaacccccaaacccccccc

SEQ ID NO: 2760 - DNA, 565 bp, Triticum aestivum
caaactccacagcgactccaaatctctcgtggtagacagcttccatctcatctccggcgatgtctgggcgtggcaagggcggcaaggggctcggcaagggcggcgccaagcgccaccggaaggtgctccgggacaacatccagggcatcaccaagccggcgatccggaggctggccaggaggggcggtgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtgtacgccctcaagcgccagggccgcaccctctacggcttcggcggctgagcgccatcagcgcgctgccgctggctgacactgctgtttcctgctttgctctgtagtcttactcccccccgtcgtgaatccagtgcgctggctatgcttgtttctgtagtttgtctagtgagatccaacttctagttgtaactcctatcgtttcgtttcgctgcaatgaaaagttaattccaatctgagaaaaa

SEQ ID NO: 2761 - DNA, 636 bp, Triticum aestivum
gcacgaggcctggtgtcttatttcaagaatgccgtgattgtgccccttgaaataagacaccaggatttacttcactgcaacagaaaacaaaatccccaaatccatcttcgtgcccgggaaaggaagagagagagcggcggagatgtctgggcgcggcaagggcggcaaggggctgggcaagggcggcgcgaagcggcacaggaaggtgctgcgcgacaacatccagggcatcacgaagccggcgatccggcggctggcgcgccggggcggcgtgaagcgcatctcggggctcatctacgaggagacccgcggcgtgctcaagatcttcctcgagaacgtcatccgcgacgccgtcacctacacggagcacgcgcgccgcaagaccgtcaccgccatggacgtcgtctacgcgctcaagcgccagggccgcaccctctacggcttcggcggctaggctttcctttcctcgtggcggcttgtttacggagggagtgcctgttcatcctgttggtgttggtagtttggtgccgaatgttgtgttcctgatgtaaccgtgccctgttgcagtgaagtaaatcctggtgtcttatttcaagaatgccgtgattgtgccccttttaatccaaaaaaaaaaaa

SEQ ID NO: 2762 - DNA, 590 bp, Triticum aestivum
ctcgccacaccgccgccacaaccaccaccagcaacacacacacagcagcccagccaatctcgccggagaaagaagagtcgacgatgtcgggccgcggcaagggagggaaggggctgggcaagggaggcgccaagcgccaccggaaggtgctgcgcgacaacatccagggcatcaccaagccggccatccgccgtctggctcgccggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggattcggcggctaggtcacgccggtcctgtcgaatccacctcgcgccgccagattcgtagctagctagccatggtttgttcagtgttcatggtcttcggtgtaatggaatggccgcatctcgctgctgtctgttgtttcggtgtatcgctagcgtggaatggaaatctcagcattttatccccgaattcgtctgcaatctcttgctctg

SEQ ID NO: 2763 - DNA, 748 bp, Triticum aestivum
acaacaccaaaccaccaaccaccaccgctactccaaccccacattcgcttgccagcagctcgaagaggatcgtcggcgaccatgtccgggcgcggcaagggaggcaaggggctcggcaagggcggcgccaagcgccaccggaaggtgctgcgcgacaacatccagggcatcaccaagccggcgatccggaggctcgctcggaggggtggcgtgaagcgcatctcggggctcatctacgaggaaacccgcggcgtgctgaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggcgcttcctcgcccctcccctgcagatcccaaaagcttgatgataccgcgacttgtgtggtttgctacttcctctgtagttccaagtgaatcgtgaaacaaagctactcgcatctggagttggaaatcaatatacaccgtgtttctgaattttgtctcgctggttggcctgctatatctctgtttgtgtgcgattgctgtttcttctgtaatgcaaaattgtgtgcgctctggagtaagtagattttatcagtagacgccgacaaatcgtacttggttgtgcaacactgggcagaattggtgttccttctgttgtgcaacgctgtaattgagatggattttgtctgcattgcata

SEQ ID NO: 2764 - DNA, 575 bp, Triticum aestivum
caccacaccgctgcaacaaccaccaccagcaacacacacacacacagcagccaagagaagctcgccggagagagaagagtcgacgatgtccggccgcggcaagggagggaagggcctcggcaagggcggcgccaagcgccaccggaaggtgctgcgcgacaacatccagggcatcaccaagccggcaatccggcgtctggctcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctgaagcgccagggacgcaccctctacggattcggaggctaggccgcgcctgcccactcgaatccacctcgcgccaccgcattagtatctagctatgaatgttcagtgttgatggtcttcggtgtaatggaatggccgcatctcgctgctgtctgttgtttcgatgtactgcttgtgtgtaatggaaatctcagcattttacccttgaattcgtctgcaa

SEQ ID NO: 2765 - DNA, 629 bp, Triticum aestivum
  misc_feature (593)..(593): n is a, c, g, or t
tcatcgctgtctggaacagcggaacaaccaccagcagtaaaaacacacacactcagaagccaatctcgccggagagggaagcgtcgaggatgtcgggccgcggcaagggagggaaggggctgggcaagggcggcgccaagcgccaccggaaggtgctgcgggacaacatccagggcatcaccaagccggccatccgccgtctggctcggcgtggcggcgtgaagcgcatctcggggctcatctacgaggagacccgtggcgtgctcaagatcttcctggagaacgtcatccgcgacgccgtcacctacacggagcacgcccgccgcaagaccgtcaccgccatggacgtcgtctacgccctcaagcgacagggccgcaccctctacggattcggcggctaggtcgcgccggtccagtcgagcccacctcgcgccgccatactcgtactactagctagccatggttgtcttcggtgtaatggaatggccgcatctcgctgctgtctgttgtttcgctgtattactagcacggaatggaaatctcagcattttatccctgaattcgtctgcaatctcttgctctgttgttaaatncttgtcagtgtgctttgttaaatcttaaaaaaaaaa

SEQ ID NO: 2766 - DNA, 598 bp, Triticum aestivum
ctcgtcctcgcctccttcgacccgcgcaagcgcaagcacaaccacccaaccaccaaccaccaccgctcctccaatcccacattcgctcatcagcagctcgaagcggatcgtcggcgaccatgtccgggcgcggcaagggaggcaaggggctcggcaagggcggcgccaagcgccacaggaaggtgctgcgcgacaacatccagggcatcaccaagccggccatccggaggctcgctcggaggggcggcgtgaagcgcatctcgggcctcatctatgaggagacccgcggcgtgctcaagatcttcctcgagaacgtcatccgcgacgccgtcacctacaccgagcacgctcgccgcaagaccgtcaccgccatggacgtcgtctacgcgctcaagcgccagggccgcaccctctacggcttcggcggctaggctcgtcctcgccctcctgcatatcccaaaaagtttgatatgaatgcgacttgtttagttccgtacttcctctgtagttcgaagtgaatcgtgaaacaaagctattcgcatccggagttggaaatcaaacctgtgtctgtgcaaaacctgcccgggcggtcgctcga

SEQ ID NO: 2767 - DNA, 661 bp, Triticum aestivum
  misc_feature (2)..(2): n is a, c, g, or t
  misc_feature (4)..(4): n is a, c, g, or t
ananagagagagagagagagagagagagagagagagccgctcctcaacctcctccgtccgctcgcagctcgaaccaaggagagaccgtcagccatgtccggccgcggcaagggaggcaaggggctcggcaagggcggcgccaagcgccaccggaaggtgctgcgcgacaacatccagggcatcaccaagccggcgatccggcgcctcgctcggaggggcggcgtgaagcgcatctccggcctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctaggctcttcctcgccaccccactgcagatcccgaaagtttgatgataccgcgacttgtgtagttcgctagttcctctgtagttcgctatttcctctgtatttcgtactgaatcgtgcagcaaagttattcgcagtttgttagaaatcaaacatgtctctgaaataccttgtctctgactttgttctgctgcatttctgttacgtaaaattgtactatcttctgtgatgcaaaattgtgtgtgcttgggaaaaaaaaaa

SEQ ID NO: 2768 - DNA, 754 bp, Triticum aestivum
  misc_feature (60)..(60): n is a, c, g, or t
  misc_feature (65)..(65): n is a, c, g, or t
  misc_feature (80)..(80): n is a, c, g, or t
  misc_feature (89)..(89): n is a, c, g, or t
  misc_feature (132)..(132): n is a, c, g, or t
tgatagcaaaaaaaaagtaacatgcatgtattgtggcctgtggatagatccattgtcacntaccntaagccttggagatntcagctttngaattcaaaaatgtagggttggaacggcacgaggcctcgtgcngaattcggcacgaggcccaaatccccttttctctcaagctactcggagcaggcagccatgtcggggcggggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggcggctgaagagccgcggcgctggctggccctggcgcaccagccatggctcgcggtcaagaaagtggagaagaggagaaatctgtagttgatctgggttctgtgccttctatgcttagtagtagtatcctatgcttagtagtttgcttccgtgttctgaacctgatgggcaaatactgtgtttgccgagttatatggttcgagagttaacaaaactgttctccagttatgaattatgctaatgacgatgctgttctgcttt

SEQ ID NO: 2769 - DNA, 586 bp, Triticum aestivum
tcgagaaccgacctcaccagcagccaccaccgttcctccgattccacatccgctcgcagctcgagatcgtgagccatgtccgggcgcggcaagggaggcaaggggctcggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggtcctgccgactgtcgcctgtctctgtcgccgcctgcagatccgcaaagcttgatggaactctgactttttcagttcgctgtttactctgtctgtgtagttcgaactgaatcgtggaacaaagttatttgcatatcttgttggaaatgaaacttgcctctgtcagcatgtcgtaaatctgattctgttcgctattgggt

SEQ ID NO: 2770 - DNA, 1107 bp, Triticum aestivum
  misc_feature (338)..(338): n is a, c, g, or t
tcccacattaagctttacgggaaacccgccgaactggccgaaaaggaaggaaaaaccgcaaaggcgcggcccttaggccctggccaagttaccgtcaccctggcggtaccacaccacaccccgcggttaatgccccgctacagggcgctccattcgccaatcaggtgggccaactgttgggaaggccatccggtgcggccctcttcgctaatacgccagctgcgaaaagggggatgtgctgcaagccgattaagttgggtaacgccaggttttcccagtcacgacgttgtaaaacgacgcccagtgaattgtaatacgactcactatagggcgaaatngggcccgacgtcgcatgctcccggccgccatggccgcgggattcgagcgcccgcccgggcaggtgtgccctcggccgagtggcctcgggcgcaacttgcgttcaaagactcgatggttcgcgggattctgcaattcacaccaggtatcgcatttcgctacgttcttcatcgatgcgagagccgagagccaccactcccaacacagctcaatcccaccggagagacaggcagaagcagctgcggcggcggagatgtcgggccgcggcaagggcggcaaggggctggggaagggcggcgccaagcgccaccggaaggtgctccgcgacaacattcagggcatcacgaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccaccaacgccgggctgctccagccagcaacgagataaattatttctataaggctagtagtatttgtctatggttcgtggtctcttcggtgttgtttgctctgctctgttcctgcttgatgttgggatcgatgtactagtaccaagactgaatgaaaatcgaatttggaaattataatgccttctacccttgatcaaaaaaaaaa

SEQ ID NO: 2771 - DNA, 623 bp, Triticum aestivum
tcatcgctgtctggaacagaccaccatcctccacctccaccactcccaacacaaggcaatcccacgcagagacagaaagaagcagcggcggcggcgaagatgtccgggagaggcaagggaggaaaggggctgggcaagggcggcgccaagcgccaccgcaaggtgctccgcgacaacatccaggggatcaccaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccaccaacgccgagctcctccagccggcaacgagataaattgtcactataaagctagcagtatttgtccagggttcgtgtgtgtcttcggtgttgtttgctttgctctgttcctgcttgatgttgggatcgatgtactagtaccaagactgaatggaaatcgaatttgggaattacagcgacgttgtttacccttgagtccaaaaaaaaaa

SEQ ID NO: 2772 - DNA, 742 bp, Triticum aestivum
agtcaactgctctaccaactgagctaacgacccgaagtggtgggtgatgacgggatcgaaccgccgaccccctccttgtaagggaggtgctctcccagctgagctaatcacccacttcggtacttcacatttttacaagaaatttagctggcgagaaagtggtgggtgatgacgggatcgaaccgccgaccaccaccgcaacaaccaagccaatctcgccggagaaagaagcgtcgacgatgtccggccgcggcaagggagggaaggggctgggcaagggcggcgccaagcgccaccggaaggtgctccgcgacaacatccagggcatcaccaagccggcgatccgccgtctggctcgccggggcggcgtgaagcgcatctcggggctcatctacgaggagacccgcggcgtgctcaagatcttcctggagaacgtcatccgcgacgcggtcacctacaccgagcacgcccgccgcaagacggtcaccgccatggacgtcgtctacgccctcaagcgccagggccgcaccctctacggattcggcggctaggccacgcgaatcgatccccccaccaccatatttgtgctcgtagctagctatggctgtgtattgttcatgggcttcggtgtaatggctgcatctcgctgctgtatgtcctggccttgactgttgttgcttggatgtagtagtcctgggatgaaatggaaattgaagtggtctacccttgaattcttctgcaa

SEQ ID NO: 2773 - DNA, 435 bp, Triticum aestivum
tcgacccacgcgtccgcatcaccgcatcaaccacaaccagcaacacacacagggcagccaagcgaagctcgccggagagagaagcgaagatgtcgggccgcggcaagggagggaaggggctgggcaagggcggagccaagcgccaccggaaggtgctccgcgacaacatccagggcatcaccaagccggccatccgccgtctggcgcgcaggggcggcgtgaagcgcatctcggggctcatctacgaggagacccggggcgtgctcaagatcttcttggagaacgtcatccgcgacgccgtcacctacacggagcacgcccgccgcaagaccgtcaccgccatggacgtcgtctacgccctcaagcgccagggacgcaccctctacggcttcggcggctaggccacgcgaatcgacccccccccccccccccacc

SEQ ID NO: 2774 - DNA, 645 bp, Triticum aestivum
gttctgcctgttccatgtatcctcaatcgctgcctcaaaacattgttaaagccctcgtgccgaattcggcacgaggagcacttcctcttctttctaagcgcacacatccctcggagctaggtggatcggcgatgtcggggcgcggcaagggcggcaaggggctggggaagggcggcgccaagcgccaccggaaggtgctccgcgacaacatccagggcatcaccaagccggcgatccggaggctggccaggaggggcggcgtgaagcgcatctcggggctcatctacgaggagacccgcggcgtgctcaagatcttcctcgagaacgtcatccgcgacgccgtcacctacactgagcacgctcgccgcaagaccgtcaccgccatggacgtcgtctacgcgctcaagcgccagggccgcaccctctacggcttcggcggctagattcgtgtcgtgtgtccgtgtgttctgtggaagacgggttttactactgctttggcgtgcgtcgttgtgttccgtcttgtgttcattaggctgtaattccttgttgcggtcaatgaaactagttctgttctgaatcctgacctgaagtgcaattggtttgacttagatgaaatgcaattggatgaacgatttaaaaaaaaaa

SEQ ID NO: 2775 - DNA, 575 bp, Triticum aestivum
  misc_feature (561)..(565): n is a, c, g, or t
atcctccacctccacctccaccactcccaacacaagccaatcccaccggagagacaacagagaagcgaatcagcggcggcgaagatgtccgggaggggcaagggcggcaaggggctggggaagggcggcgccaagcgccaccggaaggtcctccgcgacaacatccaggggatcacgaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgaaccctctacggcttcggcggctaggccaccgacgccgggatcttcaagcaagcaaagagattagcagtatttgtctagggtacgtggtctcttcggtgttgtttgctctgctctgttcctgcttgatgtatcgggaccgatgtactagtaccaagactgaatgaaatggaatttggaaattacggtgcnnnnnaaaaaaaaaa

SEQ ID NO: 2776 - DNA, 634 bp, Triticum aestivum
  misc_feature (588)..(588): n is a, c, g, or t
gcacgaggccgcagcgaccaccaccagcaacacacacacacacagcagccaagcgaagctcgccggagagggaagcgtcgaggatgtcgggccgcggcaagggagggaaggggctcggcaagggcggcgccaagcgccaccggaaggtgctgcgcgacaacatccagggcatcaccaagccggcgatccggcggctggcgcggaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggacgcaccctctacggattcggcggctaggccgcgccggtccagtcgaatccgcctcgcgccgccagattcgtatttagctagccatcggttgttcagtgttcatggtcttcggtgtaatggaatggccgcatctcgctgctgtctgttgtttcgatgtactactagcatggaatggacatctctgcattttacccctgaattcgtctgcaatctcttgctnctgttgttaaatcttatcagtggctctgttaaatcttatcagtgcg

SEQ ID NO: 2777 - DNA, 538 bp, Triticum aestivum
cccttcgcaaacacctgactcccgccaaagcagttcctcttcttcctaatcacactctctcggagcggcgatgtccgggcgcggcaagggcggcaaggggctgggaaagggcggcgccaagcgccaccggaaggtcctccgggacaacatccagggcatcaccaagccggcgatccgcaggctggcgaggagaggcggcgtgaagcgcatctccggcctcatctacgaggagacccgcggcgtcctcaagatcttcctcgagaacgtcatccgtgacgccgtcacctacaccgagcacgcccgccgcaagaccgtcactgccatggacgtcgtctacgcgctcaagcgccagggccgcaccctctacggcttcggaggctagattcgtgtagtggagcaactccctcgtttgctttgtgtgatatgtgctgtggtggattgatttactgatttggcgtgggccgttgtattctgtcttgggttcagtagtctgtgtaataccctgttctgttcaatgcaatcagttcgattctgaatc

SEQ ID NO: 2778 - DNA, 630 bp, Triticum aestivum
  misc_feature (602)..(603): n is a, c, g, or t
taaacgaactgtctacatgtacgcagaataatttgtcggtcattcatgccagaaaagccattattcacttccctcgtgccgaattcgccaccaccgttcctccgattccacatctgctcgcagctcgaagaggatcgtcagccatgtccgggcgcggcaaaggaggcaagggactgggcaagggcggcgccaagcgccaccggaaggtgctgcgcgacaacatccagggcatcaccaagccggcgatccggcgcctggcgcggaggggcggcgtgaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgtaccctctacggcttcggcggctaggtccggccgacggtcctcggtctttgtcgcttccggcagattccaagagcttgatgaaaccctgacttgtctagttcgttgtttcctctgtctatgtagttcgaactgaatcgtggaacaaagttaatcgcacatcttgttggaaannaaacttgtcactgtgcaaaaaaaaaaa

SEQ ID NO: 2779 - DNA, 580 bp, Triticum aestivum
gaaccgaccagcagccgccggcaccaccgctcctcctccatttcgatccaaatcacacatccgctccaaggaaggaagccgtcagccatgtccggccgcggcaagggagggaaggggctgggcaagggcggagccaagcgccaccggaaggtgctgcgggacaacatccagggcatcaccaagccggcgatccggcgtctcgctcggaggggcggcgtgaagcgcatctcggggctcatctatgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggcttcggcggctaggccgcgctcgaactcacctcgtgccgtcaaattagtcgcttagctgtggttgttcagtgttcatcgtcttcagtgtaacggccgcatctcgctgctgttgttcagtgttgtgtgcttggatgcactatgatggaatggaaatcgcagcattttacccctgaattcgcatataaaaaaaaaa

SEQ ID NO: 2780 - DNA, 595 bp, Triticum aestivum
gagagagagagagagagagagagagagagagagagagagagaggctcctcctccgtttccatctcagtcagctccaagccgtcaaccatgtccggccgcggcaagggagggaagggcctcggcaagggcggcgccaagcgccaccggaaggtgctccgggacaacatccagggcatcaccaagccggccatccggcggctggctcgccgtggaggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgacaggggcgaaccctctacggattcggcggctgacctgcgcccgctgctccaatctccatctgctatggtttctctgctatggttttgtttctgagtgcgtgcgtgcgttgctgttccatcggcctgtgtagttagtggatggcgatggatctgaatgtaatggacttgttggttcttgcaagaaatgaatctgaattcaatggaagttgtaccgcataaaaaaaaaaaa

SEQ ID NO: 2781 - DNA, 617 bp, Triticum aestivum
ccccaatcccctccaatcccaccttcggagcagctagctagcatcgccagccatgtcgggccgcggcaagggaggcaagggcctgggaaagggcggggcgaagcggcacaggaaggtgctgcgcgacaacatccaggggatcacgaagccggcgatccggcggctggcgcggcggggcggcgtgaagcgcatctccgggctgatctacgaggagacccgcggcgtgctcaagatcttcctagagaacgtcatccgcgacgccgtcacctacacggagcacgcccgccgcaagaccgtcaccgccatggacgtcgtctacgcgctcaagcgccagggccgcactctctacggctttggcggctgagcccggatcgatttagatgtggttaggcgggtcgtcgttctgtggtgtgctgtcctgtgtgtgcagctgcgtgctggtgcttgtaatgagttccagaatctaatatgggtgttcatctcgcattggattgaatcgtttgttttgctctgaccactggcgatgtctgtccctgcacacttcttacatcaggccgtttgtttgtagtataacttataagtatgttgaaaactgagttttgtaactgttgatgaac

SEQ ID NO: 2782 - DNA, 644 bp, Triticum aestivum
agggctccaccccctcccagcgagaaatccccaattccttcgtcttcttcctcgcgagacgcacacagcagagcagagagcgagaagatgtccgggcgcggcaagggcggcaaggggctgggcaagggcggggcgaagcggcacaggaaggtgctgcgggacaacatccaggggatcaccaagccggcgatccggcggctagcgcggaggggcggggtgaagcgcatctccgggctcatctacgaggagactcgcggcgtgctcaagatcttcctcgagaacgtcatccgcgacgcagtcacctacaccgagcacgcgcgccgcaagaccgtcaccgccatggacgtcgtgtacgcgctcaagcgccagggccgcaccctgtacggcttcggcggttaggcgatagctagctaggcttcaatgtgtctatcaggtcgctggtctgcgaatgcttgtgcctgtggtttgatttaatgcttgttatgaggaaatgctgcctggatgtgtttctctgttcatatcatcagtccagtcacagcttctgatttgccaccgtttgagtttgtgaaattcttttcattcggtcctgcaaagctaacttggcaaatttgtcatctggatttatctaccattggcatttttgc

SEQ ID NO: 2783 - DNA, 666 bp, Zamia vazquezii
  misc_feature (519)..(519): n is a, c, g, or t
  misc_feature (569)..(570): n is a, c, g, or t
  misc_feature (579)..(579): n is a, c, g, or t
atccccgggctgcagaatcggctaccggctgataatttggcggagggaaagggtcgcaggagattagattacaagaggagaggaagaatgtcaggacgcggaaagggagggaaagggctgggcaaaggaggagccaagaggcacaggaaggtgctcagggataacattcagggtattaccaagcctgctattcgtcgccttgcccgccgtggtggtgtcaagcgaatcagcggtctgatttatgaggaaaccaggggcgtattgaagatttttctggaaaatgtaattagagatgcggttacctacaccgagcatgctcgccgtaagacggtgacagcgatggatgttgtgtatgcccttaagaggcagggcaggactctctatggctttggcggttaaattccccttctcttctcatgctacttgttgttttttagcaccgcctttgtcttcggcaactgttttacatgctttgagtacttaaaattggaagggatatggagtaatgatttagcaggntttgcagttctgaacatgattgcgtaatctgtaagatgcagttttgttanntttgtaggnaaatggttatatttgtgtatggttacggcagtagcattatgtgaatgttaagaacattaatgttgaaatgttctgatggaatatacg

SEQ ID NO: 2784 - DNA, 716 bp, Zamia vazquezii
tggcggggtaatatatgacccattttgcctgcatcctagacagccataagaaggcacacaccagcaatagaaatataagaaaggaagtgatcaaggacgtagcaaacgaagtcagatccactcttggcagcttggcggggagcaatttggggtttccaggattttgtttaaagaagtttcaagatgtctggccgcggaaagggtggaaagggtttgggaaaggggggcgctaagcgtcacaggaaggtcttgcgggataatattcaggggattacaaaacccgccattaggcgtctggctaggaggggcggagtgaagcgtatcagtgggttgatctacgaagaaacaaggggtgtgctcaagatttttctggaaaatgtgattcgagatgcagttacatatacggaacatgccaggcgtaagactgtcactgccatggacgttgtgtatgccctgaagaggcagggaaggacactctatggtttcggtggttaattttcagactcaagtcttgctgtcaagaaatggtgtctttcgacaccacctctttgatgtagagatttgaagtactcaatcgcggattataattggtatgctgtgaggattctttaaagtggcttttgaaagtcttggcctttatatgtaaaggcttgtgtacatgttacattggacattgtagtctttattttaacagtgtttaatttgatagcattgat

SEQ ID NO: 2785 - DNA, 706 bp, Zamia vazquezii
  misc_feature (584)..(584): n is a, c, g, or t
tttgtttggcgacttttcatcgggtcggcggttcgagtcctggaagggaacctgtttgaattgcagtagtccatttattgccagcagggatgtcaggccgcggtaagggaggcaagggtctggggaagggaggagctaagcgccacaggaaggttctgagggacaatatccagggcatcaccaagcctgccattcgacgccttgcccgtcgaggtggtgttaagcgtatcagcggtttgatctatgaagaaacccgcggagttctgaagatatttctggagaatgtgataagagatgcggtcacatacacagagcatgcccgccgtaagactgttacagccatggatgttgtttatgccctaaagaggcagggtcgcaccctctacggatttggcggttaatttggaattggagtttggctgttttcggctcgttttatgctggtgttttagaataacctcaatttgtacttcaatgaaatatgcgctctttctgtgtacatttacatgctaggtaacttagggcttaactgcagttccctaaacatctgctcatttctttttgcagctttaatttttacatangagcacatatttggcattggtaaatgttcagatgaatagcaatgaaaatgttcagactggaaaaaaacagtggtatggctctgggaactagtactgctacttccggcagtcaatctttacat

SEQ ID NO: 2786 - DNA, 728 bp, Camellia sinensis
ggggattgcaaactcatctttctcgttagctcaagcccttgaagtttccactctgtgtaactttctctctctagaaaaatgtctggtcgtggcaagggcggcaagggtttgggcaaaggaggagccaagcgtcacaggaaggtcctacgggacaacatccagggtatcactaagcctgcgattcgtcgtctggctcgcagaggcggagtcaagaggatcagtgggctcatctatgaggagactcgcggtgttctcaagatcttccttgagaatgttattcgtgatgctgtgacctacactgagcacgctcggaggaagactgtgactgccatggatgtcgtctatgctttgaagaggcaggggaggactctctatgggtttggcggttgagttgtcgctggtgtctttgttagggtttggtaaaggtaggtttgggggttgtaaattgtgttgttttaggatcaggttcttgtgttttgaattagtttaatctactgaaaatgttaatttggattggagatctgtttgttcttcaatgaattatgtttgattttgaatctagtattttgatgtgttaatttggtgtttgtttttaagttagtttgatttcactaacttggcatgttttcaaacgtggatttgaattttatgactgaattttatacagctgaatttactttatgtgtttgtatgtactgggagtctggaaattctttcctttgattgac

SEQ ID NO: 2787 - DNA, 514 bp, Triphysaria pusilla
agttttcacaatttttgcagaacaaaaatgtcaggacgtggcaagggcggtaagggtttgggaaagggcggtgccaagcgccaccgaaaagtcctccgtgacaacatccaaggtatcaccaagccggccattcgccggttggctcgtcgtggtggagttaagcgaatcagcggtttgatctacgaggaaacacgaggcgtcctcaagatatttttggagaatgtcatccgtgacgctgtcacctacactgagcacgctcgccgcaagactgtcactgccatggacgttgtctatgctctcaagaggcagggtcgtactctctatggctttggtggttgaggtcgtctctagggttagggcttttgtgtacatttcctgtaattccgtgtttcccttttcagtttaatgtttgtggattgaatctgaatgtatgatgtttaatatcctcaatacattgttgttttgctttgataacttagatttgctctatgctaattcagttggaatgttggca

SEQ ID NO: 2788 - DNA, 742 bp, Hordeum vulgare
cggcagaggcaccgctcctccaacttccacaatcccctacagctcgaagaggatcgtcagccatgtccgggcgcggcaagggaggcaagggtctcggcaagggcggcgccaagcgccaccggaaggtgctgcgcgacaacatccagggcatcaccaagccggccatccgtcgcctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggcccctcgtcgtcgtcagtcttcctcgccgcctgcagattccgaatcttagttgaatctgccttgtttagttcgctccctctctctgtatgttgaaatgtatcgtggagcaaagtcattacaatgtggagttgggaatcagacttgtctctccaaatgcagcgcttctcattcggtttcgcgagttggtctgctatatcttgggttacgattgttgcttcttgtgtctttaaaattttggttcgaccgagttggtgatgaccatgcctttgggacggtggatcttgcaaacctataatctgaaagaatgccagtgcctgaatcggtgtgtataactgaaatcgggacgacattttgaactgcttctgc

SEQ ID NO: 2789 - DNA, 650 bp, Hordeum vulgare
acgggatcaaagctgaggcgccatgtatatttcggatcggaggcatgaggaaggacacactggtcgaacgctacacgcagggcatacagaactaacgaacacgacggcggttttattttattcagcgcgcgcgcatgcagcgggcaaccacctcacaaagacaaagtcaacctcaccggagagagaagcgagaagatgtcgggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccggggcgtgctcaagatcttcctcgagaacgtcatccgcgacgcagtcacctacaccgagcacgcccgccgcaagaccgtcaccgccatggacgtcgtctacgcactcaagcgccagggacgcaccctctacggcttcggaggctaggccgtcaaccagatttagattgttctagggtcgactggtcgttgatgtaaccgcagcatctcgctgttgtttgctgtcttttgtggaatcgaatggactgcaatggaaatttaactagttcgttgttggaaaaaaaaaaaaaa

SEQ ID NO: 2790 - DNA, 622 bp, Hordeum vulgare
tccatctccatctcagtcagctccaagggaggaagccgtcaaccatgtccggtcgcggcaagggagggaaggggttgggcaagggcggcgccaagcgccaccggaaggtgctccgggacaacatccagggcatcaccaagccggccatccggcggcttgcacggcgtggcggcgtgaagcgtatctcggggctcatctacgaggagacccgcggcgtgctcaagatcttcctcgagaacgtcatccgcgacgccgtcacctacaccgagcacgcccgccgcaaaaccgtcaccgctatggacgtcgtctacgccctcaagcgccagggccgcaccctctacggcttcggcggctgacctgcacccgccgctgctccaccgagtcaaccctggtagctgctgctgctgttccggtgctatggtttcgtttctgaattccgtatgcatgcgttgctgttccgtcggtctgtgtagttagcgggaaggcgatggatctgaatgtaatggaattgttggttcttgcaagaaatgaatctgaatgcaatggaatttgtactgcatctcatgatacgactgtacctcctggcttgtttctgtacattttagtaaaatttctcagcaag

SEQ ID NO: 2791 - DNA, 603 bp, Hordeum vulgare
accgctcctcatccattcccatctcagtcagctccaaggaaggaagccgacaaccatgtccggccgcggcaagggcgggaagggcctgggcaagggcggcgcgaagcgccaccggaaggtgctgcgggacaacatccagggcatcaccaagccggccatccgtcggctggcgcggcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggattcggcggctgatctgcacctgctgccccgtcgagtgaactccgctagctgctgctgctgttcttgtgatatggtttcgtttctgagtgcgtgcgttgttgttccatgtgcctgtgtagttagtggaaggcaatggatctgaatgcagtcagttcgttagagtgcgtgtgtctgtctctgtactctgtagccagttcttcaatggaatgtgatgaatatgaatgcaatggaattgttggttctctcta

SEQ ID NO: 2792 - DNA, 568 bp, Brassica napus
atcaacgcagagtacgcggggacatcgcagtctcctacacacgtgtgagaaacaactctctttttttctctgatttttaaaccttttcgaggaaaagaaaatgtctgggagaggaaagggtggaaagggacttggaaagggaggagccaagaggcacaggaaggtcctccgtgacaacatccagggcatcacgaagccggcgattcgtcgtttagcgagaagaggcggtgtgaaacgtatcagcggtttgatctacgaggagactcgcggcgttctcaagatcttcctcgagaatgtgatccgtgacgctgtgacttacactgagcacgcgaggaggaagactgtgacggcgatggatgttgtgtacgcgttgaagaggcaggggaggactctgtacgggttcggcggctgaggggattgaattagggttttgtaaatcgcgtctgggttgtttttagggcttgttaaggcctttaagctgttgtgatggtttcgtttcgaatgtttcgatgatttgaattgaatgaaaacgcttttattacaaaaaaaaaaaaaaaaaacgccgcct

SEQ ID NO: 2793 - DNA, 619 bp, Brassica napus
gacaataagaaaataaatcgaacggccacgattgattatctaagatagtcgtcttctttataactcaccatctgaatctaaaaccctcaaatcatctaaattttcctagaaagaacaaaaaaaatgtcaggaagaggaaaaggaggaaagggattgggaaaaggaggagcgaagagacacaggaaagttctcagagacaacatccaagggatcacgaagcctgcgattaggcgactggctcgcagaggaggcgtgaagcggatcagcggcttgatctacgaagagacgagaggagttttgaagatctttctcgagaatgtgatcagagacgccgtgacttacactgagcacgcgaggaggaagacggttacggcgatggatgttgtttatgctctgaagaggcaaggtcgcactctctatggattcggtggttaaaatcggttgttttcggtttggtttctgggtggtgctgttgctgctgattaagtcggtttacttttttgttggttcgtttcttggtttgttattagcgtttgggtaattgcactatcttatatattaaaatagaagtcacaaccttgattcatgtgtgatttttttaaaaatggacctaatagac

SEQ ID NO: 2794 - DNA, 512 bp, Lactuca sativa
cattcatcctccatctcttcctcagaaacttgaaattcaagaacttgtttcatttgacaatgtctggccgtggaaagggtggaaaagggttgggtaagggaggagcaaagcgtcatcggaaagttctcagggataacatccagggaatcactaagccagcgatcaggagactggcgaggagaggaggagtgaagaggatcagcggtctgatctatgaagagacacgaggtgttttgaagatctttttggagaatgttattcgtgatgctgtcacctacactgaacacgctcgtaggaagactgtgacagctatggatgttgtgtatgctttgaagaggcagggaagaactttgtatggattcggaggttaatagatctaagaagtgggtagtgaatattttgcttaagttggtgtaatgaatcatgtctgtttttgggacaatttggttacatgatatcaatgttttgttgtttgggatgtgtaattgaatggaaatcttttatgatttgac

SEQ ID NO: 2795 - DNA, 520 bp, Lactuca sativa
aatcaatttcatttctagagacaaaaaaaaaatgtcaggaagaggaaagggaggcaagggattgggaaagggaggagctaaacgacatcgtaaggttctccgggacaacatccaaggtatcaccaagccggcgatccgccgtctggccagacgaggaggtgttaagcgtatcagtgggctaatctacgaggagacccgtggagttttgaagatctttcttgagaacgtcatccgtgacgccgtcacatacaccgaacatgctcgccggaaaactgttaccgccatggatgtcgtatatgctttgaagcgccaaggccgtactctctacggatttggtggttaatagaattttagggtttctagggttcttgtttgacaccggagtttaatctgaagtgatattacttgtaattgaagttcttaatataatatcagatagcaagtcaatttatggtttaaatttcttctttctcgaatgatttacctttatccagcatatggaatttagttttgtccttga

SEQ ID NO: 2796 - DNA, 459 bp, Lactuca sativa
ttcaagttcaacccaattcaattttatctctctccctgtgaaaatgtctggccgtggaaagggtggaaaaggactgggaaagggcggagcaaaacgtcaccggaaagtactccgtgacaacattcagggaataacaaagccggcgattcggaggttggctagaagaggcggagtcaagagaatcagcggattgatttatgaagagactcgaggtgttctcaagatctttttggagaatgtgattcgtgatgcggtgacttacacggaacatgctcgccggaaaacggttactgccatggatgtcgtatatgctctcaagagacaaggccgaactctttatggatttggaggctaagtttgtttatcctgttgaatgatatatcaatagaattaatcgattccaatgtgtacttggtttacggggtattgaatgttaatgaaatgctaattttcttcaca

SEQ ID NO: 2797 - DNA, 553 bp, Lactuca sativa
ggaaactgtaatcaaagactttcgtgatggggatcagtacatctctcaattcaaaacttttcaaatccgttcctacagagagagttgcagacatgtctggaagaggcaagggaggaaaggggctaggaaagggaggagcaaagcgtcatcgaaaggttctccgggacaacatccagggaattaccaaaccggcgatccgtcgtttggccagacgtggcggcgttaagcgtatcagcggtctgatctacgaagaaactcgtggtgttctcaagatctttctagaaaatgtcatccgtgatgctgttacctacaccgagcatgctcgccggaagactgtcaccgccatggatgtcgtctatgctttgaaacgtcaaggacgtaccctttacggtttcggtggttagggtttttatttggtttaggtatttcttgccttttatgcaccgatttagatctctagtgtttagatttcagttcaccttgttgatgcttagttatgtatgtcattcaatgcaatcgaaaccttatcgattcaatattaatcaagatctta

SEQ ID NO: 2798 - DNA, 536 bp, Lactuca sativa
cgcggggaagcttctctacttttcttcgattttcaaatttcagatttcggagcaatttgaagaagtctgaagatgtcaggacgtggaaagggaggaaagggattgggaaagggaggtgcgaagcgtcatcgtaaggttctgcgagacaacatccagggaatcacaaaaccggcgatccgccgtcttgcgagaagaggaggtgtgaaacgtatcagcgggttgatctacgaggaaactcgcggagttttgaagatctttcttgaaaatgtcatcagagatgctgttacatacacggaacacgcccgccggaaaactgtcaccgccatggatgtggtgtacgctctcaagagacaaggccgaactctctacggattcggtggttagggttttactagtgttgttgttatgttacggatttctactactcgttgaaatcgactgttagtttttgttatgctctatcttaaaccaaaccagaagcaatagactgtttccgtattttgacttcgccaaatcaaattcaaattggttgcttt

SEQ ID NO: 2799 - DNA, 492 bp, Lactuca sativa
gcgggaacatcatcacttcaatcgtttcagagagaaaaagcaaaaaccagagaaaaaaatgtcaggaagaggaaagggaggcaagggattgggaaagggcggagcaaagcgtcaccggaaagttctccgagacaacatccaaggtatcacgaagccggcgattcgccgattggcgaggagaggtggagttaagcgtatcagtgggcttatctatgaagaaacacgtggtgtgcttaagatctttctagagaatgtcatccgtgacgccgtgacttacaccgagcacgctcgccggaaaactgtcaccgccatggatgtggtttatgctttgaaacggcagggacgtactctttatggatttggaggttaaggtcgtagtgatatgtgttttcattgctatttcagtttccagatctacattgtttgttaacgtggtaatagtgataggctatgtatcattgacttatttctcgtaatgcaatgatcggttta

SEQ ID NO: 2800 - DNA, 576 bp, Lactuca sativa
aactcatttctagagagagaaagcgagagaaaaaaaatgtcagggagaggaaaaggaggcaagggattgggaaagggaggagccaaacgacatcgtaaggttctccgggacaacatccaaggtatcaccaagccggcgatccgccgtctggccagacgaggaggtgttaagcgtatcagtgggttaatctacgaggagacccgtggagttttgaagatctttcttgagaacgtcatccgtgacgccgtcacatataccgagcatgctcgccggaaaactgttactgccatggatgtcgtttatgctttgaagcgccaaggtcgtactctctacggatttggtggttgatagaaatttgctatcttttcgtttctgggtgtaggctttttattagttagattatgtaatctgaattgatatgatgtgtaattgatgcctcttaatacaaattcagttactttttatcaatttcttgtcgaattcttcatctcgaatgattctcttaatacaaattcgtcggatatcacgtgtatcagatgtgtaattgatgctcacgaattgattagtttttatcaa

SEQ ID NO: 2801 - DNA, 523 bp, Lactuca sativa
aaatcaattcatttctaacgaaagaaaagtagagagaaaacatgtcaggaagaggaaaaggaggcaagggattgggaaagggtggagccaaacgtcatcgtaaggttctccgggacaacatccaaggtatcaccaagccggcgattcgccgtctggccagacgaggaggtgtcaagcgtatcagtgggttaatctacgaggagacccgtggagttttgaagatctttcttgagaacgtcatccgtgacgccgtcacatacaccgaacatgctcgccggaaaactgtcaccgccatggatgttgtttatgctttgaagcgccaaggccgtactctctacggatttggtggttaagagaattttacggtttctactttccagggttcttgtttggcatcgaggttttcattgatttgttatctgtaatcggaagtggtattacctgtaattgaagctattaatacaatatcacttatccaattcatcttttctgtatgattatatgcttatgcaatacatgatat

SEQ ID NO: 2802 - DNA, 590 bp, Lactuca sativa
cgcggggaccattctaacaaatctcttctcttttatcctctctccttgtgaaaatgtctggtcgtggaaagggtggaaaaggacttggaaagggcggagcaaaacgtcaccggaaagtactccgtgataacattcagggaatcacaaagccggcgattcggaggttggctagaagaggcggagtcaagagaatcagcggattgatttatgaagagactcgaggtgttctcaagatctttttggagaatgtgattcgtgatgcggtgacttacacggagcatgctcgccggaaaacggtgactgccatggatgttgtatacgctctcaagagacaaggccgaactctttatggatttgggggctaagtttgtttctcctttccagttgatatatgtaattgaatcgatggatttaaatgtttacttggtgaatgaggtattgaatcttaatgaaatgctaattttcttcacaaaaaaaaaaaaaaagaataaaaattatctagtgttgaagaaagtaacatcaagttgtggaggtcatggtgggctgacccggccctactcattctaaatccaactaacttgttgtctgtg

SEQ ID NO: 2803 - DNA, 570 bp, Lactuca sativa
cggcggggatctcactcctcactcaatcacaactcaaattcagcatctaaccttgagcttgtttcaacaatgtcgggacgtggaaagggaggcaagggactcggaaagggaggagcaaagcgacacaggaaggttctccgtgataacatccagggaatcaccaaacccgccatccgaagattggctcgtcgaggaggtgtcaagcgtatcagtggcttgatctatgaagagactcgtggtgttctcaagatctttcttgagaatgtcatcagagatgctgtaacctacaccgagcacgctcgccgcaaaactgttactgcaatggatgtcgtctatgctttgaaacgacagggccgtaccctatatgggtttggtggttaggtctagggttttggttgtgtggtagtgtgtattcactgtagatcgtatctaatttccccttcgttgtatcctgtttcaatatcgttgacataccccatctcggggtttgaatttatgttatgaaatccctctattttctataatcgtctgagtttcatcatctgaatctataagctttgaattattacc

SEQ ID NO: 2804 - DNA, 574 bp, Lactuca sativa
ctataaaaccgcccaccacaatccaccatctcattcattaacaaaacaccaaaccctaatttgaattcagatcttctcttcttcaaaaatgtcaggccgtggaaagggaggcaaaggattgggaaagggaggagcaaagcgtcatcgcaaggttcttcgcgataacattcagggaatcaccaagcctgctatcagaaggctcgctcgtaggggaggtgtgaagcgtatcagtggtttgatctatgaagaaactcgtggtgttctcaagatctttctagagaatgtcatcagagacgctgtgacatacaccgagcacgctcgccggaaaactgttaccgccatggatgtggtttatgctttgaagagacaaggccgtaccctttacgggttcggtggctagatttagtgttaggttagctattttcgtagattattatttgtaagatgtatcgtttgtgttcaatttcaattaaagccgatgtactccatctcggagtttatggtgttttcttgctatgaaatctctgtgttcatcaatatcctttgtttttatctctgaaatgcatttgatttg

SEQ ID NO: 2805 - DNA, 617 bp, Populus trichocarpa
tataaataccaggccagacctctctatgcaaatcacctttcaagcccataaaaaaagagaaaaaactctcccctctttgattttccgagaaaatactcaagttttgcaggaaagtttgcgaggatgtcgggaagaggaaagggcggaaaggggctgggaaagggaggtgcaaagaggcacaggaaggtgttgagagataacatccaaggaatcacaaagccagcaattagaaggctagcaagaagaggaggcgtgaagagaattagtgggctgatctacgaggaaactagaggggttttgaagatcttccttgagaacgtgattcgtgatgctgttacttatacagagcatgctaggagaaagactgtcactgccatggatgttgtctatgctcttaagaggcaaggtcgtactttgtatgggtttgggggttaggatttgtcgggtcttctattttggttgtattgatttcatttgcgtaggaatttagatcttctatgggctggaattgaaaaataggatctgtaattgaaacaatttctcaatcctgattcagctgttgccattttaggccaaaattatttgcttcattttaattctttttggacttgatgcta

SEQ ID NO: 2806 - DNA, 621 bp, Populus trichocarpa
acacaaaatcccacgtatctttctttctccatctcgattccatcctggagattcaattccaagtctgctctatcgctagataaacatgtctggacgtggaaagggaggcaagggcctgggaaagggaggagccaagcgtcatcgcaaggtccttcgtgataacattcaaggtatcacaaagcctgcaatccgccgtcttgctcggaggggtggggtcaagcgtatcagtggcttgatctatgaagagactcgtggtgtgctcaagatcttcctggagaatgtcatcagagatgccgtgacctacactgagcatgctcgccgcaagaccgtcactgccatggatgtggtgtatgccctcaagaggcagggaaggactctgtatgggttcggtggttagggcttttaattttaaaataaaagtcttgctgtcaagaaaagggcttttgagggatcgggtttagatttgctaatcaggtttttttaggtactgttttgtaagtataagtgcgtgatgggttaatgttgaattttttttttttaatttttggaatggaaatggttctgtttcgaattcaacttttgatgggctcgtgttttttatttttcgggctcgactttctt

SEQ ID NO: 2807 - DNA, 614 bp, Rosa hybrid cultivar
gatccattcgcaaaagcaaccaatatctctctctctcttaagcaaatccaatttctgatttgagctgagcaacgatgtccggccgcggcaagggaggcaagggtctgggcaaaggaggagccaagcgtcacaggaaggtcctccgcgataacatccagggcatcaccaagcccgccattcgccgtctggctcgccgtggcggcgtcaagcgtatctccggcctgatctacgaggagacacgtggcgtgctcaagatctttctcgagaacgtcatccgtgacgccgtcacttacactgagcacgctcggaggaagaccgtcaccgccatggatgtggtgtatgcgctcaagaggcaaggaaggactctttacgggttcgggggttagggtttctggggatcaaagtcttgccgtcaagaatagattgtgttggttggtaatggaagaagtagtggtactagggtttaggtttgtatggtcttctattttgtaattactagtctggtttaggcttctgggaatctgaatgggtttctcctagtttgtaatttgcaattccttctctgaattgcggtttctgaagaaattgaaaagcctgttccttttgttagtaaa

SEQ ID NO: 2808 - DNA, 498 bp, Rosa hybrid cultivar
caaattcagagtttctctccttcaaattttccggtgaaaatgtcaggccgcggcaagggaggcaaggggttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgtcacctacactgagcacgcccggaggaagaccgtcaccgccatggatgtcgtctatgctctcaagaggcagggaaggaccctttatggatttgggggttaaatggttgggtattagtgtagggttggttccaaaatttggatttagatctgggtgtaacgaatactctgtggttaagtttgctgttcatgtaatttggacgtatttagaagtaatagaactttgatttcccaacagaaaaaaaaaaaa

SEQ ID NO: 2809 - DNA, 658 bp, Saccharum officinarum
aagctggtcgcctgcagtaccggtgcagaattcccggatcgaccgactcatccacgcgtccgcccacccacgaaatccccaattcccaacctcacctccgagttcgagcgaccatgtcggggcgcggcaagggcggcaaggggctgggcaagggcggcgcgaagcgccaccgcaaggtcctccgcgacaacatccagggcatcacgaagccggcgatccggaggctggcgaggaggggcggcgtgaagcgcatctcggggctcatctacgaggagacccgcggcgtgctcaagatcttcctcgagaacgttatccgcgacgccgtcacctacacggagcacgcccgccgcaagaccgtcaccgccatggacgtcgtctacgcgctcaagcgccagggccgcaccctctacggattcggcggctgaggggtgccccccgccgctggtggccgtggcaaaagtcttgggtcgcggtcaagaaatcgagggaggcgagggtattctggcccatatgcttagtttcgtagtcttatcggtagtgcttattgttacggttgttgggttcgatcactctagagccatggtcaagtagtagtatatgagttgtaccgcatttccttgtcttatgaacttcccatgtatgaaatgtggattcactt

SEQ ID NO: 2810 - DNA, 577 bp, Saccharum officinarum
tccccttcacacgagcgcaaacacaaccacccacccacaacttccaagcaggggaggcgaccggcggcggagatgtcgggcaggggcaagggcggcaaggggctcgggaagggcggcgcgaagcgtcaccggaaggtgctgcgcgacaacatccagggcataacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctaggttaggtcagggtagttgcctgtcgaggcgtctcggatcggtgatactagtttggttaccttcctgtgttcgtctggtagttgctgtagtggttgtaactggttgatttgtccgtcatgttgtgtgcgtctgtaagcaccgctggttcgatggaattggaatggatgacgaagtaggaaagttatccagtttg

SEQ ID NO: 2811 - DNA, 713 bp, Saccharum officinarum
agctcagtcaccccaccaccactccaacagcaagcgaaaaatccccaatcccctcgtctccgtgtcccttgcgaagatgtcgggtcgcggcaagggcggcaagggcctgggcaagggcggcgcgaagcgtcaccggaaggtgctccgcgacaacatccaggggatcaccaagccggcgatccggaggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggcttcggcggctaggccggccgcgcctcgcccctctccttcgtccgcctgtgttgccgtcgctgtggttgtagtgttgctgcaattcgctagttgtgcctgggtgaggaaaaaaaatgctactgtggcaagcatgttgcatatgttgtctgtttctgattgagtcttattctgaagaaatatgccaatgatgacttgctcaagattcaagcatgctcaatttgttcacacattaactctcttggctgcgtgtgttactgcttttctttgtgcaagtacgaaccatttcaattcttttggccttcagaccttgaatttcaatcctagaatgcatctctgt

SEQ ID NO: 2812 - DNA, 592 bp, Saccharum officinarum
gcggcgaattcgaatcccacaatttttgtagcacacaccaccgtcactcgagtcttctttcctcttcggcggcgatgtctgggcgcggcaagggcggcaaggggctgggcaagggcggcgcgaagcgccaccgcaaggtcctccgcgacaacatccaggggatcacgaagccggcgatccggaggctggcgaggaggggcggcgtgaagcgcatctccgggctcatctacgaggagacccgcggcgttctcaagatcttcctcgagaacgtcatccgcgacgccgtcacctacaccgagcacgcgcgccgcaagaccgtcaccgccatggacgtcgtctacgcgctcaagcgccagggccgcaccctctacgggttcggcggctgagcgcgtgcgcgtctcctccgtcctctgctgctgctgctcgttccgccttacgtactcctttcggatccctgttccgtgctttccttgatgtagacagttatcggattcttaggtctctgccgtgtctcgttattaggtggaatcatgtgtccctagtagcactgaaagttcaacacccagttgtatcttcctttgcagcaatgaaa

SEQ ID NO: 2813 - DNA, 601 bp, Saccharum officinarum
cgcaggtacgggtccggaatcccgggtcgcaccacgcgtccgctcctcttcctcgcttcctcctgatccgcattccaagttccagcagcgaagctctcggtttcggcgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtcattcctcatccggtggcgaactgcatgtggtggcggaggtggtcgtgttgtgtgccgtgtctagtgtagtctgtgctctctgtatcggtgctgtgttctgtggtggttgtgctctatctacgctttgggtgttgctgtaatatctagttgtcattatcaatggaaaaccctcggttct

SEQ ID NO: 2814 - DNA, 280 bp, Brassica napus
ctagtagttacgtcggggaggaagacggtgacggcgatggatgttgtttatgctttgaagaggcaagggcgcactctctatggattcggtggttaaaaccggtttaagatttcgatttggtttctgggtgctacttattaagtcttgctgtcaagaaatctagtaggttttaggctttatcactactttgctggtttgtttctttgtttgtgtaatttctcttttggggatttataaaaatcaattattcagtacagaaaaaaaaaaaaaaaaagaccga

SEQ ID NO: 2815 - DNA, 799 bp, Cichorium intybus
ggcgggggaggagcgagtttcacacgtattgggggtacatcgttctcgcgattttgccctaattttgcacacgattttctggattcgttcaactccatcaaccaaactccaattggtgaactcctcataggtgattcacaagattaacctctgaaaatcgagaatcggttcgtggttggagaattcgtggattatatatatccagattcgcgactaccggaaggaaactagtttatctgaaagtagatctgagaaattggaagcgaatctatcggcgtatcggaagaatcaagctccggaagagttcggcggcgaatagaaggatcagggtaactccttatcatcggagagaatcggttcttttggagtccctagctcgtgagatccttcgatttgttcatcaacatcgaagatcaagttttcctgtggagttgtatctgatcgtaagaatctggcgaactgaagagtctatgcaaatcgttcgaaacatcgaaggattgcgcgcgtgaagatgctccaaggatttgattgaagccttttgcagatttgcagtttgaagccgttcctgagtcggtttgatcttttttcagagttactgaagagtggaaaacaaaaaaaaaatagagaatcttggctgtggatttttgtactgttattatatctttttgtttcggtgttcaattcaggcgtttgataattttcttctatatgaacgcctttattgatactagtattgcattttgtgcttgttcttgatatctttttttgagggaaaagaaaaagaatttatactaaaaaa

SEQ ID NO: 2816 - DNA, 674 bp, Zea mays
aaggggatttgaattagacaggaagaattacagtgcaccccaattgaaaataaattgagagatcaaattagaggcaacgctacgttggagaaaagtctaacatgccaacattcctacttcaccgtccaatccaatcccatcgaaccagcggttcttacagacccaaagaagcacgactacaggacgacaaagcaaccagctaccacaactactacaatacgaacacaggaaggcagccaaactagtaccacagatccgagacacctggacaggcaattacccacacctaacctagccgccgaagccatagagagtgcggccctggcgtttgagggcgtacacgacgtccatagcggtgacggttttgcgacgggcgtgctccgtgtaggtcacagcgtcgcggatgacattctcgagaaagatcttgagcacgccgcgggtctcctcgtagatcagcccggagatgcgcttcacgccacccctcctcgccaacctccggatcgccggcttcgtgatcccctggatattgtcgcgcagcaccttccggtgacgcttcgcgccgcccttcccgagccccttgccgcccttgcccctgcctgacatctccgccgcaggttgccggtcgcctccgcttcgaactggtgggtggatggtgttgcgctcgtgcgaagagg

SEQ ID NO: 2817 - DNA, 773 bp, Arachis hypogaea
attaatagttaatacattgcaatgagtaattactgattacattccagaataattgacatcgaaacttagatagataacttgctgaacatagtcacaaactttctaacccctaaaccagagtaaaaccctcttagtcctaaccaccaaatccataaagagtccttccctgtctcttgagggcatacacaacgtccatggccgtaactgtcttcctcctagcgtgctccgtgtatgtaacggcgtcacgaatcacgttctccaaaaagatcttgagcactccacgtgtctcctcatagatgagaccactgatacgcttcactccacccctacgagccaaacgacgaatcgccggcttcgtaataccctgaatattatcgcgcagaaccttacggtgacgttttgctcctcccttccccaatcccttgccaccctttccacgaccagacatcttgctgtctcagaaaccaattagcacaaacaaaatcgagtaagagaggaagagtaagctacgcaatggacgttgtgtatgccctcaagagacagggaaggactctttatggatttggtggttaggactaagagggctttactctggtttaggggttagaaagtttatgagtatgttcagcaagttatctatctaagtttcaatgtcaattattctggaatgtaatcagtaactactcattgcaatgtattagcatgcgttttcctttactaagttaggggaattgaatgcggaattattgaaacaagtaagccctttttatcta

SEQ ID NO: 2818 - DNA, 926 bp, Populus trichocarpa
caacaaaacaaatatccctttaaccaccgaacccgtatagtgtgcggccctgcctcttcaaagcatacacaacatccatagcagtcactgtcttgcggcgagcgtgttcagtgtatgtcacggcatcacgaatcacattctccaggaagatcttgagaacgcctctggtctcctcgtagataagaccactgatacgcttgactccaccacgcctagccagacgacgtatggcaggcttggtgatgccctgaatgttatcacgaagaaccttgcgatgcctcttggctcctccctttcccaatcccttccctccctttcctctccctgacattttctctcaaagaattccctcggtttgattttttcttttctttttttatttttgcaagattgcagaggaggaatttggagggctggttttataagaggagaggatttttggtggccgttggatgaggcgtggatctgtgtgagggctgggaaagttcttcgtgataatatccagggtatcacgaagcctgcgattcgtcgtctggctaggcgtgggggagtcaagcgtatcagtggtctcatctacgaggagaccagaggagttctcaagatcttcctggagaacgtgattcgtgatgctgtgacatacaccgagcacgctcgccgcaagactgtgactgctatggatgttgtgtatgctttgaagaggcagggacgcactctctatgggttcggtggttaaggggatctggggattttctgggctagtggtcgatttagggtttttatgtgtttcttgggtatgtggtttgataggcattaggcttcagctttacaaatagtggtagatatctgattcctctacttgcaaaacgtcatgtatctctctctcttgatacttgttctatatgaaaagctcttagtacttcgtattc

SEQ ID NO: 2819 - DNA, 518 bp, Artemisia annua
tactccgacggggatcaaaaacccaattaactttcattcaatcaattaaaaaactaaaaaaatagtcaggacgtgggaagggaggaaaggggctaggcaaaggcggagcgaagcgtcacaggaaagtgttgagagacaacattcaaggaatcacaaagcctgctattcgtcgtttagctcgtagaggtggagtcaagaggatcagcggcttgatttacgaagagaccagaggtgttttgaagatctttttggagaatgtcatccgtgacgctgtcacctacaccgagcacgctcgccgtaaaactgtcactgctatggatgttgtttatgctctcaagagacaaggcaggactttgtatggtttcgggggttaggtggattagtattatgtcgtcgttacgatgttctttgtacggttttacggatctattttgtaattgaaagttcatcaatgaaatgaatctgaatttagcgaacaaaaaaaaaaaaaacatgtcggatctagaatacgcactcgt

SEQ ID NO: 2820 - DNA, 596 bp, Artemisia annua
aagcagtggttatcaacgcagtactccgacggggatcaaaaacccaattaactttcattcaatcaattaaaaaactaaaaaaaaatagtcaggacgtgggaagggaggaaaggggctaggcaaagggggagcgaagcgtcacaggaaagtgttgagagacaacatccaaggaatcacaaagccggctatccgtcgtttagctcgtagaggtggagtcaagaggatcagcgggttgatttacgaagagacaagaggtgttttgaagatctttttggagaatgtcatccgtgacgctgtcacctacactgagcacgctcgtcgtaaaactgtcactgctatggatgttgtttatgctctcaagagacaaggcaggactttgtatggtttcggcggttagaaagggaattagtattatgtcgtcacgatgttctttgtatggttttatggttgtattgtgtgattgaaagttcatcaatccaatgaatctgaatttagctattagctattaatttaaaagacttgaaaaaccaatgaatctgaatttagctattagctattaatttatagactaaaaaaaaaaaaaaagtcggactaag

SEQ ID NO: 2821 - DNA, 430 bp, Artemisia annua
ttcaaaaagaaaatcaataatgtcaggacgtgggaagggaggaaagggactaggcaaaggcggagcgaagcgtcacaggaaagtgttacgagacaacattcaaggaatcacaaaacccgcgattagacggttggcgagacgaggaggagtgaagaggatcagcgggttgatttacgaagagacgagaggtgttttgaagatctttttggagaatgtgatacgtgatgctgttacgtacactgagcatgcgagaaggaagactgttactgctatggatgttgtttatgctttgaaagcaaggcaggactttgtatggcttcgggggttagaaagtcaattagtattgtgttgtcgcaatgctctttgtatggttttttatggatgtattgtgtaattgaaactttgtcaagcaaatggatctcactttagc

SEQ ID NO: 2822 - DNA, 569 bp, Lactuca sativa
  misc_feature (567)..(568): n is a, c, g, or t
accatattcatatctctacagaaatccgaaacattttcagtttgcgtagtgattattccaacaatgtcaggacgtggaaagggtggaaagggtcttggaaagggaggagcaaagcgtcatcggaaagttctccgtgataacatccagggaatcactaagccggcgatccggagactggcgaggagaggaggtgtgaagaggatcagcggtctgatctatgaagaaaccagaggtgtactgaaaattttttggaaaatgtgattcgtgatgcagttacatacactgagcatgctcgaaggaagactgtaactgcaatggatgttgtgtacgctctcaagaggcaaggaaggactctgtacggatttggaggctgagatccataatgggttcttgataccttcactgttctattttctcccctttgccttttgtagtgttttcgttcatgaaagtatgattgtggatctatctactaaattttcatgtttcagatctggtagctctatgtaaattgaatgcttcaatccttaaaaatactattaatttgatctaccggctttcttttcnna

SEQ ID NO: 2823 - DNA, 1481 bp, Tropaeolum majus
tctacgataatatgaaagctttcatcaggtacatgatctcctccaacattggtgaggttgcatcaatctttttaacagctgctttgggcataccagaaggcatgattcctgttcaacttctctgggttaatctcgttactgacggaccaccagcaacagctttgggattcaatcccccggataatgatataatgaagaaacctcccagaagaagcgacgattcactgatcacagcttggatcttatttcgatacctggtgatcgggctctacgttgggatcgccacagtcgggatattcgtcatatggtacacacacgatacattcatgggcatcgacctaagcgaagacggacacactctcgtcacctactcccagctcgctcactggggtcaatgcacttcatggaaaggattcacagtctcaccattcaaagcaggcactcaagtattcaaattcgattctaacccatgcgactacttccaatcaggaaaaatcaaagcctcgacactctccctctcggttttagtatcgatcgaaatgttcaactcactcaacgccttatcagaagacgggagcttagtcaccatgcctccatgggttaacccatggttattattagccatgtctatctcattcgggttacacggtttaatactctacgtaccgttcctagctcatatattcggaatcgtcccgctaagcttgaacgaatggctcttggtgttggctgtttccttgccagttatcttaatcgatgaggttttgaaatttattggcaggtgtaggagaacagctcgttatgctgattccaagaagcgttcgaagcacaaagccgaatgaaatcgcaaacgaagtaagtacttttctaagaaaactatataattattatataaggataattgtagtgaattccaactctgattatataatttatttctcaatcttaaattactgaattcgatataaagtagcaaatagaaataagacagtgaattcatttagtgattccagttcaaattacagaatttcacaaacataaaccctagttgaacgtaatcccctaaccgccgaatccgtagagggttcttccttgtctcttgagagcgtaaacaacatccatggcggtaacggtcttccttctggcgtgctcggtgtatgtaacggaatcacgtatgacattctccaagaagatcttcaaaactcctctggtttcttcatatatcagtccgctgatacgctttacgccacctctacgagcaagacgacgtatggcaggttttgtgattccttgaatgttatcccttaggaccttcctgtgccttttggctcctcctttacccaatcctttgcctccctttccacggccggacatgtttgaatgagctggttgttatagaaatcagtaatgaaaatgggtgagaaactgagttcaggatattatactaagatgtttagtacgtgtagacgatacttatttat

SEQ ID NO: 2824 - DNA, 373 bp, Antirrhinum majus
  misc_feature (102)..(102): n is a, c, g, or t
aacacatctttaacaacttgccgagtcaaaatgtctgggaggggaaagggcggcaagggattgggcaagggaggagcaaaacgacaccgtaaggtgcttagngacaacatccaggggatacaaagccggctattcgccgtttggctcgtcgtggtggagtgaagcgtatcagcgggctcatctacgaggagacacgtggcgtcctcaagatcttcctcgagaacgtgatccgtgatgctgtgacttacacggagcacgctcgccggaaaactgtgactgcgatggatgttgtgtatgctcttaagaggcagggacgtactctgtatggatttggtggttaggtttttaggattagggttagggtttctttaga

SEQ ID NO: 2825 - DNA, 1106 bp, Malus domestica
ttcactaacaaatcaaacttatattacttcaaacaagggtccaaattacatcactactataattgttatcgacagatctaaagaccagatctgaagaaccctaaccctaattcccaaaataaaggcataaaattcccaatttaacccccgaaaccgtagagggtccttccctgcctcttcagagcatacaccacgtccatggcggtcacggtcttcctcctggcgtgctcggtgtaggtcacggcatcacgaatcacgttctccaaaaagatcttgagaacccctctggtctcctcgtagatcagaccgctgatacgcttcacgccacctctgcgagcaagacggcgaatcgcaggcttggtgatgccctggatgttgtccctcagcaccttacgatgtcgtttcgctcctcccttgcccaagcccttgcctccctttccacggcctgtcatttcctcggaaaatttttgggcgaagaagttttattcttacgcacccgaaaaaaaaccactgaaaagatgatgctcggagaaccacaccgtcctaatccaacggttcacgtcccaccgtggcttcagctggacgatcctacggccgagatgtactccccgtacccgctcagcggcgtctccgttaactccgacggcaatgcaagcggcgccgacttcaacagcccgtactacctcgacgatgccctaacgacgctccagcgcttcttgccgtccaacgagaccgacctggattccgactccgacatttctggccgcgaatccgacgcgccggtcgacgcctactcctgcgaccacttcaggatgttcgatttcaaggtcaggaggtgcgcacgtggaaggtcacatgactggaccgagtgtccgtacgcccacccgggtgagaaggcccggaggcgcgacccgaggaagtatcactattcgggtacggcctgccccgatttccgaaaaggtcattgcaagaagggcgacacgtgtgagttcgcgcacggggttttcgagtgctggctccacccggctcgctaccgcactcagccgtgcaaggacggcaccagctgcaagcggagggtttgtttctttgctcacacgccggagcag

SEQ ID NO: 2826 - DNA, 523 bp, Brassica rapa
  misc_feature (116)..(116): n is a, c, g, or t
  misc_feature (118)..(118): n is a, c, g, or t
acacatcgcactctcctccacacgtgtgaaaaaacaacttcctttttttttctctgattttaaaaactttcccgagaaaaagaaaatgtctgggcgtggtaagggaggaaagggantnggaaagggaggagccaagaggcacaggaaggttctccgcgacaacatccagggcatcaccaagccggcgattcgccgtttagcgagaagaggcggcgtgaagcgtatcagcgggttgatctacgaggagactcgcggcgttctcaagatctttctcgagaatgtgattcgcgacgctgtgacttacactgagcacgcgaggaggaagactgtgacggcgatggatgttgtgtacgcgttgaagaggcaggggaggactctgtatgggttcggcggctgaggggattggattagggtttttgtaaatctcgtcttggttgtttttagggtttgttaagagctttaagctgttgttatggtttcttttcgaatgtttcggtgatctgaagttaatgaaaacgctttt

SEQ ID NO: 2827 - DNA, 514 bp, Hordeum vulgare
gcaaccacctcacaaagacaaagtcaacctcaccggagagaagaagagagaagcgagaagatgtctggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccggggcgtgctcaagatctttctcgagaacgtcatccgcgacgcagtcacctacaccgagcacgctcgccgcaagaccgtcactgccatggacgtcgtctacacaactcaagcgccagggacgcaccctctacggattcggaggctaggccgacaaccagatttagatagttctagggtcgacctggtcgttgatgtaaccggaacaatctcactgttgcttgctgtcttttgtggaatcgaatggactgcaatggaaatttaactagttaacaagagaaaaaaaaaaa

SEQ ID NO: 2828 - DNA, 528 bp, Lactuca sativa
atcatccccttcaatcgtttcagagagaaaaagtaaaaaaccagagaaaagaatgtcaggaagaggaaagggaggcagggattgggaaagggcggagcaaaacgtcaccggaaagttctccgagacaacatccaaggaatcacgaagccggcaattcgccgattggcgaggagaggtggagttaagcgtatcagtggcctcatctatgaagaaacacgtggtgtgcttaagatctttctagagaacgtcatccgtgacgccgtgacttacaccgagcacgctcgccggaaaactgtcaccgccatggatgtggtttatgctttgaaacgacagggacgtactctttatggatttggaggttaatctcgtagtgatagacgttttcattgctattttagtttccagatctacattatctgttaacattgtaatagtagtagggtttgtatcattgacttattgctcgtaatgcaatgatcgatttatctaaatttgatgtcaacttttttttttttgttctttgacgaa

SEQ ID NO: 2829 - DNA, 653 bp, Nicotiana benthamiana
aaataggcttaggatgtcaggccgtggaaagggaggcaagggattaggaaagggaggagcaaaacgtcaccgtaaggtattacgtgacaatattcagggaattacaaagcctgctattaggaggttggcgagaagaggtggagtgaagagaattagtggattgatttacgaagagacacgtggagtgttgaagatctttctagaaaatgttattcctgatgctgtgacttacactgagcatgccaggagaaagactgttactgctatggatgttgtttatgcgcttaagagacaggggaggactctttatggatttggtggttcacaaaatggatctgcgtttttcgcccgctcggccagttacctccccttttttgaaaaaccatggggcgcttctctccccccgcccgcaactaaattataggccacccccaccacagcccccccacaccacacctcacgatagtgcgggcgcccccctttcttctctctctacgcagacgagcgagcatacctttccttcctcttgacatacaggcgagcgtgcgacactcatcacaccaccccccccctcccaccctctaccatcatacctgacgacgaggcatcgcgaaaacgctacccccccaacaccaccctccttccacgttatc

SEQ ID NO: 2830 - DNA, 544 bp, Selaginella moellendorffii
gggcaacagagtctagggttcttcgatttggtgttccgccttccatctcttcaggtaatcttctcgtcgcggcggcaatgtctggaaggggaaagggaggaaagggattgggcaagggcggtgccaagcgccaccgcaagcatctccgcgacaacatccagggcatcaccaagccggcaatccggcgcctggctcgcaggggcggcgtgaagcgtatcagcggtctcatctacgaggaaaccaggggggttctcaagatcttcctggagaatgtgatcagggacgccgttacatacaccgagcacgcgcggcgcaagacggtcaccgccatggatgtggtgtacgcgctcaaacggcagggaaggacgctctacggatttgggggctagagcctggaagaaatctctggaaaatttctcgtttcctctccttttctagctagtaggaagaagaagattctttccttgtccactgtaatatgctctctctcgatcgctatatgatccttcgatcaatctaaaccttttcatagttgatggttcga

SEQ ID NO: 2831 - DNA, 788 bp, Picea glauca
cgtacatactatatgttctcctcagtaccatccattccacgcatctcagtcattatccgtttaccgttttagttgggagatcgagaaatcggaagaattctcaaagatgtctgggcgtggaaagggaggcaagggtttggggaagggaggtgccaagaggcacaggaaagttctcagagataacattcagggcatcaccaagcccgccatcaggcgtctcgccagaagaggaggcgtcaagcgcatcagtggtctcatctatgaagagaccagaggtgttctcaagatcttcttggagaatgtcatcagggatgccgtgacatacacagaacacgccaggaggaagactgtgacagccatggacgttgtctactccctaaagaggcagggccgaaccctctacggtttcggaggctgagagatctcgctttgactaaatttatccaatggtgtctcttgacaccaccattttgtttctcagaagttttaacctacttatgattgcaggctgtcgaatgtgttgcttcccttgcggggttgcaagggtttgttttgcctgttaactgctacttagctgtgtgtttctgggggttttgtatttcctattttatgagaaatgatgtttcaagggtttgaaagaatcctgtaatcgggaggcggcagggatttatgaggagttttatgaaaattttggaaagttttgtattatatttgtggtaattttgaatctttttgattggttcttggactgtagcaatctttaatatggttggatttgagctaaaaaa

SEQ ID NO: 2832 - DNA, 638 bp, Triticum aestivum
gcacgagggagagagagagagagagagagagagagagagagagagagagagagagagagagagacacgagcagactccctacaaagcagctcctcttcttcctcccaatcacactccctcggagaggagcggccatgtccgggcgcggcaagggcggcaaggggctgggaaagggcggcaccaagcgccaccggaaggtcctccgcgacaacatccagggcatcaccaagccggcgatccggaggctggccaggaggggcggcgtgaagcgcatctccggcctcatctacgaggagacccgcggcgtcctcaagatcttcctcgagaacgtcatacgcgacgccgtcacctacaccgagcacgcccgccgcaagaccgtcaccgccatggacgtcgtctacgcgctcaagcgccagggccgcaccctctacggcttcggaggctagatgcgtggtgtgctgtgctggtggcggccgtgtttctctgtgtgattgtgccgtggtggatgggatgtactccctgtcgtgcgtttgtgttcagtagtctgtaataccatcatgcgttcaatgaaactgttctgatcctgaattctgaccaaatgcttcagggacaaaatcggttatataagacatactgat

SEQ ID NO: 2833 - DNA, 764 bp, Triticum aestivum
  misc_feature (743)..(743): n is a, c, g, or t
  misc_feature (758)..(758): n is a, c, g, or t
aaaccaattcggctgcatccctcccagagaaaaatccccaattccttcgtcctcctcctcgcgagacgcgcacagcagagccgagagggagaagatgtccgggcgcgtcaagggcggcaaggggctgggcaagggtggggcgaagcgccaccggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccgtcacctacaccgagcacgcgcgccgcaagaccgtcacggccatggacgtcgtgtacgcgctcaagcgccagggccgcaccctgtacggcttcggcggttaggggatggctagcttggcttcagtgtgtctatcaggtcgccgctctgcgaatgctcgtgcttgtggtttaatttaaaatgcttgttatgagaaaatgctacctggatttgtttctctgttcaatatcgtcagtgcggtcacaacttctgatttgctaccgtttgagtttgactataaaaaaaaaaaaaaaaaaaaaaccaaaaaaaaaagagggaaacctgcccgggcggccgctcgaatcacaagcccgcccgcctgcaggtcgaccataaggtagagctcccgacgcataggataaatagcttgagtattctatacaaccattcaataggcgggcntacaagatagcagtncgggaa

SEQ ID NO: 2834 - DNA, 414 bp, Eschscholzia californica
tcctcggtaatcaaattttcccaatttcagaattagttttgagcatttgtgaatcaaaatgtctggtcgtggaaagggaggaaagggttaggaaagggaggagcaaaacgtcatcgtaaagttcttcgtgataacattcaaggtataacaaaaccagcaattagaagattagcaagaaggggaggtgtgaaacgaatcagtggtttgatctatgaagaaaccagaggtgttcttaagatctttttggaaaatgttattcgtgatgctgtaacttacactgaacacgctaggaggaagactgttaccgccatggatgttgtttatgctttgaagagacaaggaaggactttatatgggtttggaggttagggtttttttttgtttgtccaaagtcttgctgtcaagaaaaaaaaa

SEQ ID NO: 2835 - DNA, 610 bp, Orobanche aegyptiaca
cctaaaatctctctcgctttctatatactcttcattatcagatagcaataagaacaaaatgtctggacgcggcaaaggaggcaagggtttggaaaggcggagccaaacgacaccgtaaggtgttgagggacaacattcagggaatcacgaagcctgccattcgtcgtttggctcgtaggggtggggtcaagcgtatcagtggactcatctacgaggagactcgcggcgtcttgaagatcttcttggagaacgtcatccgtgacgcagtcacctacaccgagcacgctcgccggaaaactgtcaccgccatggacgttgtttacgctttgaagaggcaggggcgtactctgtacggcttcggaggttagggacctagggtttttacggtttgtgtaattcgaatggttattgatggagatggtttggggttttgtttagtgctgtaatttggatattgttgtttagtgtgatttatctcagatcttcgttttttaccttgatttcgaatgaaaatacatcggtttattattttaagtagaattattttgttttggttatgttttgagaattctcaattggtgacttcgtagtaattggctggaaagaacaa

SEQ ID NO: 2836 - DNA, 572 bp, Triphysaria pusilla
caaatcgcgaaaattcgagttttatccctctatttattaatcctagtgttatcaccatttcatcatccacatacaatctaaaacaagtactaattaaatttaaatctaacttctaagtgaaaatgtccggccgtggaagggaggcaaaggtctaggcaagggcggagcaaaacgacaccgtaaggtgctccgtgacaacatccagggtatcacaaagccggcgatccggcgtctggcgagaagaggcggagtgaagaggatcagcggtctgatatatgaggagaccagaggtgttctgaagatctttctcgagaacgtgattagagatgcggtaacttacactgagcacgctcggaggaaaaccgttactgccatggatgtggtttatgctctgaagaggcagggccgcactttgtacggattcggtggttgatttttgtcaattattcttcttgattatactgcttggatctgtcttctttagctggattttctgttttagtatttgcagatctgagtttatcattatgcttctgtaattcaattggctacagatgagtaatatatgtttt

SEQ ID NO: 2837 - DNA, 478 bp, Ocimum basilicum
gcagctttttatacttgctaaattaaaatttcaatttcatcaaaacgtctgggcgcggcaaaggaggtaaggggctggggaagggcggagctaagcgtcaccgcaaagtgcttagggataacattcaaggaatcaccaagccagccattcgtcgtttggctcgtcgtggcggtgtcaagcgtattagcggtcttatctacgaggagactcgcggagttctcaagatctttttggagaatgtcattcgtgatgcggtcacctatactgagcacgctcgccggaaaaccgtcactgccatggatgttgtgtatgcgttgaagaggcaggggcgtactctgtatggttttggtggttgagtgattagactggggcgtaaatgacctgctcttgtagaatttagggctgtttattgagctttgttaggttgtatcttcagatgctgactttctgcagtggtctatatgagatctcattttac

SEQ ID NO: 2838 - DNA, 367 bp, Arabidopsis lyrata
aaaaaatgtcaggaagaggaaaaggaggcaaaggattaggcaaaggaggagcgaagagacacagaaaagttcttcgtgacaacattcaaggaatcacaaagccagcgattcgtcgtcttgctcgaagaggaggtgtgaagagaatcagtggattgatctatgaagaaacgagaggtgtgttgaagatctttctcgagaatgtgattagagatgctgttacttatacagagcatgcgaggaggaagacagtgactgcaatggatgttgtttatgctttgaagagacaaggaagaactctttatggatttggtggttcttgataatgatttaagtcttgcgatcaagaaattttagggtttggttaatt

SEQ ID NO: 2839 - DNA, 426 bp, Artemisia annua
tactccgacggggacacacaaacacaccaaatccaattctaaaaaatgtcaggaagagggaaaggaggaaagggattaggcaaaggaggagcaaaacgacatcgtaaagtgctccgcgacaacatccaggggatcacaaagcctgctataagtcggttagcaagaagaggaggagtgaagaggataagcgggttgatttacgaagagacacgtggcgtgctgaagatatttctagagaatgttatccgtgacgctgtcacctacactgagcacgctcgacgtaagacagtgactgcgatggatgttgtttatgctttgaaaagacaaggccggactctttacggtttcggtggttagattaaattagctgctggttggttacatggatttagatctggtgtttactatagtaggttttattattat

SEQ ID NO: 2840 - DNA, 422 bp, Artemisia annua
gtcaggaagagggaaaggaggaaaaggattaggcaaaggaggagcaaaacgacatcgtaaggtgcttcgtgataatattcaaggaatcactaagccagcgataaggaggttagcgagaagaggcggagtgaagaggataagcgggttgatttacgaggagacacgtggcgtgttgaagatatttttggagaatgtgattagagatgcggtgacttacactgagcatgcgagaaggaagacagtgactgctatggatgttgtttatgctttgaagagacaaggaaggactctttatggtttcggtggttagatgaatttggtggtgtttggttacatggattagatctggtttattattgtgttaggttttattttggttgtgtagttgtgttaaatgaatgaatttgaaatatatgtttcgg

SEQ ID NO: 2841 - DNA, 536 bp, Artemisia annua
gtcaggaagagggaaaggaggaaaaggattaggcaaaggaggagcaaaacgacatcgtaaggtgcttcgtgataatattcagggaatcaccaagcctgctatcaggaggttagcgagaagagggggagtgaagaggataagcgggttgatttacgaggagacacgtggcgttctgaagatatttttggagaatgtgattagagatgcggtgacgtacactgagcatgcgagaaggaagacagtgactgctatggatgttgtttatgctttgaagagacaaggaaggactctttatggttttggtggttagatgaattaggtggtgtttggttacatggattagatctggtttattgtgttagcttttgttgtggttgtgtagttgaattgaagatgtgttaagtgaatgaaattgaaactatgtttcagttaatttttgttgatttattttctgacctttgtggcttggtgtattgtgttgattgacaaattggataagcttatatgtgagcttacgagcttatttgatattggct

SEQ ID NO: 2842 - DNA, 509 bp, Artemisia annua
tactccgacgggacacacacaaataacaatcaattaaaccaaacatccccaaattcattcaaaatcaaaaaaatgtcaggaagaggaaagggaggaaagggtttggtcaaaggaggagcaaagcgtcatcgcaaggttcttcgcgataacatccaaggtatcaccaagcccgccatccgccgtcttgctcgtcgtggtggagtcaagcgtatcagtgggcttatctacgaagagacacgtggcgtgttgaagatctttttggagaatgtgattcgtgatgctgtgacctacactgagcatgcgaggaggaagactgtgactgctatggatgttgtctatgctctcaagaggcaaggccgtaccctctacggtttcggcggttaagtttgttggatctagggtttctagggttagggtttcgaagttggggtttattgtaatgtttaatgattaatatctgattaatcattcagttgtatttcgtattttatgttttaatgaaatgaaat

SEQ ID NO: 2843 - DNA, 357 bp, Artemisia annua
tgtcaggaagagggaaaggagggaaggggttgggcaaaggaggagcaaaacgacatcgtaaggtgctccgtgacaacatccagggtatcaccaagcctgctattcgtcgtttagcacgtagaggaggtgtgaagaggattagcgggttgatttacgaggagacacgtggcgttctcaagatatttttggagaatgttatccgtgatgctgtcacctacaccgagcacgctcgaaggaagacagtgactgcgatggatgttgtttatgctttgaagagacaaggcaggaccctctacggtttcggtggttagattaaattagcttctgtttggttagatggattagatctggtgttta

SEQ ID NO: 2844 - DNA, 548 bp, Brassica napus
ttacagcctgaatctattactctagttatcttctttgattccagagaaagtttccaaagaaaaatgtcaggaagaggaaagggaggaaagggattgggaaaaggaggagcgaagagacacaggaaagttctgagagacaacatccaaggaattaccaagcctgcgatcaggcgtcttgctcgcagaggaggcgttaagcgaatcagcggtttgatctacgaagaaacgagaggagttctgaagatctttctcgagaatgtgatcagagacgccgtcacttacaccgagcacgcggggaggaagacggtgacggcaatggatgtggtttatgctttgaagagacaaggacgtactctctacggattcggtggttgaatcgttttcgatttgttgtgttgttgctactattattaagtcttgcggtctagaaatttagctttaattgcagtgttgtaacgaagttcttctctttatcggttaatggaaatatgattaatcaaaaaaaaaaaaaaaaaaaaaaaaaaacgaccgacctcggcctctagaat

SEQ ID NO: 2845 - DNA, 535 bp, Cicer arietinum
gattcactcaccaaacacaacaatattaactctaaaaaatccattctaacaaacagatttaagcaatcatgtctggaagaggaaaaggaggaaagggtttgggaaagggaggcgcaaagcgtcatcgcaaagttctgagagataacattcaaggaataacgaaacctgcgattcgtcgtcttgcaaggcgtggtggtgtgaagcgtataagtggtttgatctatgaggaaactcgcggtgttcccaagatattccttgaaaacgttattcgtgatgctgtcacttacacagaacatgctcgccgtaaaacagttactgctatggatgttgtttatgcacttaagaggcagggcagaactctttacggtttcggtggttaggcaattagtataattactagtatcttgttgaattttataagtattgtaccggttcttagtcttggctatgtataatttgtgcttaattattgtccctggcttatctgtctttatttgcttcaacctctgcttcaatacaaatcagttaatcccag

SEQ ID NO: 2846 - DNA, 583 bp, Solanum melongena
gatcagtaattgcatccaatttcaaaaccctagaagtttcattttcgtcaagtttctctgtgaaaatgtctggtcgtggaaagggaggcaagggattgggcaagggaggagccaagaggcacaggaaggttctaagagacaacatccagggtatcactaagccagctattcgcaggcttgctcgtaggggtggtgtgaagcgtatctccggtctcatctatgaggagacccgtggagtgctgaagatctttttggagaatgtgattcgtgattccgtcacctacaccgagcatgccaggagaaagactgtcactgctatggatgttgtttatgccctcaagagacagggaaggactctctatggatttggtggttagattgtgcttgttaggttgttgtcatagttgtaactgtaggtttcgtttgtggctgtgttggttctgtttagttttgttcttgtgctctagatgttgtaatttcttgttacactatcaatgaacagaggtcgtttctagtaattttgtttgttgtcttctagatgatgatttattaggtttagttgattgatcttcatgaattgtgg

SEQ ID NO: 2847 - DNA, 569 bp, Solanum melongena
ggggatccaaagagagttcaacttcacccaaattcaaaaccctagaacttcatcttcttcaaatttctctgtgaaaatgtctggacgtggaaagggcggcaagggattgggcaagggaggagccaagcggcacaggaaggttctaagagacaacatccaaggtatcactaagccagctattcgcaggcttgctcgtaggggtggtgtgaaacgtatctccggtctcatctatgaggagacccgtggagtgctgaagatcttcttggagaatgtgattcgtgactctgtcacctacaccgagcatgccaggagaaagactgtcactgctatggatgttgtctatgcccttaagagacagggaaggactctctatggatttgggggttagattggggtttttaggttggtgtagtggaagtaacagcaggttttagcttacaattatgttactggctggtgtaactgtaggttttaattctctgtagattgttgtgggtcatgtttttaagctctagattttgtaactattcaaggaatgaatttcaggaaattacatcttttttagcagc

SEQ ID NO: 2848 - DNA, 644 bp, Jatropha curcas
ttatttacggatttcagtgttaaatttcgatcggtagaggatgtcaggccgtggaaagggcggaaaggggctgggcaaaggaggagcaaagcttcatcggaaagttctccgtgataacattcagggaatcacgaagccggcgattcgtcgattggctcgaagaggtggggtgaagagaatcagtggattgatctacgaagaaactcgtggagtactcaagatcttcttggagaatgtgattcgtgatgctgtgacatacactgagcatgctaggagaaagacggtgactgccatggatgtggtttatgctttgaagaggcaaggaaggactctttatggatttggaggttaagaaggtgattttggtttgttcgttggagatcggacaagtcttgctgtcaagaattaaagaagtgatgatagcgatagcggtggcggtggagacgaaggttgttaaactgttttagggttagggttaggtgttaggcttatcaaattgttaatttgaatggtgttatctgtaattagattggtttgggaatctgagtttattttagagataccgagaagtatctgtctttgtaattcattctgtgaattgcattttttaatgacatttggctcccctctctctctcaccacaa

SEQ ID NO: 2849 - DNA, 630 bp, Lotus japonicus
atcactcaaatttaccctctcttctctctgcatcttcaaactctctttatctcttcgtagctagcttcaaggttcaccatgtctgggcgtggaaaaggaggtaaaggattgggcaagggaggagccaaacggcaccgtaaggtcctccgcgacaacatccagggaatcacgaagccagcgattcggcgtttggctcgcaggggtggcgtgaagcgtatcagtggcttgatctatgaggagactcgtggtgttctcaagatctttcttgagaatgtgattcgtcatgctgttacctacactgagcatgctaggaggaagactgttactgccatggatgtggtgtatgctctcaagagacagggaaggacactctatggatttgggggttagggtttccctgttttctattaatctggtcagttgatgtgtttggtttaatttgtgggtgagtaaaagtcttgctgtcaagaaacaaaacatggcaagaattgggggtgatgagtttgatagattgttggtagtgtttttaggatagagaaagagattagctgcaattttatgtattggattatatgaagcacttttctttttgatctgcaatgtaactacttgttaatagagtgttaagct

SEQ ID NO: 2850 - DNA, 681 bp, Lotus japonicus
ggatctcacaatctccatcactcgaatttaccctctcttctctctgcatcttcaaactctctctctcttcacagctagtttcaaggttcaccatgtctgggcgtggaaaaggaggcaagggattgggaaagggaggagcgaaacgacaccgtaaggttctccgcgacaacattcagggaatcacgaagccagcgattcggcgtttggctcgcaggggtggcgtgaagcgtatcagtggctcgatctatgaggagactcgtggtgttctgaagatctttcttgagaatgtgattcgtgatgctgttacctacactgagcatgctaggaggaagactgttactgctatggatgttgtgtatgctctcaagaggcagggaagaaccctctatggatttgggggttagggtttcactgttttctattaatttggtcaattgatatgtttggtttaatttgtgggtgagtaaaagtcttgctgtcaagaaacaaaacatggcaagaattgggggtgctgggtttgatttgatagattgttggtggtgtttttaggatagagaaagagattagctgcagttttatgtattgggttataagaagtacttttctttttgatctgcaatgtaactacttgttgcgatgtgtaacaatttatgttattagttcacttttctgttcaaaaga

SEQ ID NO: 2851 - DNA, 563 bp, Medicago truncatula
ggggacacatttcttcatctcaattcttttcttcttagttgaatttttgttgcgaatcaagatgtctggacgtggaaaaggtggaaagggattgggaaagggaggagcaaaacgacaccgtaaggtgcttcgtgataacattcaaggaataacgaaacccgctattcgtcgtttggcacgaagaggaggagtgaagcgtatcagcggtttgatctacgaagagacacgtggcgtgttgaagatctttttggaaaatgttattcgtgatgcggttacttacacagagcacgctaggagaaagactgttactgctatggttgttgtttatgctttgaagagacaaggaaggactctttatggatttgggggttagggtttgtgatttcataatgtttcgtagttgttttttttataattaaaagtgattatgggttgggaaaagtcttgctgtcaagaaattttggcaaggtttgtggttgaatttaggtggtgtttttttagggtaaggatttaggagtaatatcttttgtggtaggtagttaactgtttcatggtttgaatct

SEQ ID NO: 2852 - DNA, 494 bp, Medicago truncatula
acactccaaaatcaatcttcttcaattcttctaatttcatattcataatctattttcttcattctctgcaaaaatgtctggccgcggaaaaggaggaaagggattgggaaagggaggagcaaaaaggcacagaaaggttcttcgcgataacatccaaggcataacaaaacctgctattcgtcgtcttgcaaggcgtggtggtgtgaaaagaatcagtggtctcatctatgaagagactcgcggtgttctcaagatctccttggagaacgtgattcgtgatgccgttacttacactgagcacgctaggaggaagactgttaccgccatggatgttgtttatgctttgaagagacagggaaggactctctacgggttcggtggttaaatttagggtttatttagttctaaatctggttaatataaatttagtattcgtagatctggttgaattgtactcgaatgattagtcctatgattctagtatctggacttgt

SEQ ID NO: 2853 - DNA, 392 bp, Mimulus guttatus
atattcattccattaattaatcaattagaaatttatctcaccgcccaccacctgtttgataaaaatccacactgagaaaaaaaaaatgtctggaagaggcaaaggaggaaaggggctgggcaagggcggagcaaagaggcacagaaaggtgctccgcgacaacatccaagggatcaccaagcccgccatccgccgcctggccagaaggggcggcgtcaagcgaatctccgggctgatctacgaggagacacgtggcgtcctcaagatctttttggagaacgtgatccgtgatgctgttacgtacaccgagcacgctaggaggaagactgttactgccatggatgtggtttatgctctgaagagacaggggagaaccttgtacggatttggcg

SEQ ID NO: 2854 - DNA, 508 bp, Tropaeolum majus
ataaatcaatcaaaaaccagattctaatcgtttccatttgcttgttggatttctaattctccgacgaaaatgtcaggacgtggtaagggaggcaagggattaggtaaaggaggagccaagaggcacaggaaggttcttcgcgataatatccagggcatcaccaaaccggctatccgaagattggcaaggagaggcggcgtgaagaggattagcggattgatttacgaggaaactcgtggtgtactcaagatctttctagagaatgttatccgtgattctgttacttatacagagcatgctagacgcaagacagttacagccatggatgtggtgtatgcactcaagagacagggtaggactctctacggctttggaggttaagcctgatttcatctacctaggttgtgattagtcgatgatcctggttaggatagttgaaatttgtaagctgtgatatttggtgctgttctaatgcaatgtaatttctgttgaaatgaaacatattatt

SEQ ID NO: 2855 - DNA, 581 bp, Tropaeolum majus
ggggacgcaacttgcgattacttcttgagaaatttcaatttgcaccagcttcaagcgaatcgaaatgtcaggaagaggaaagggagggaaagggcttggtaagggaggagccaagaggcacaggaaagtgttgcgtgataacatccagggcatcaccaaacctgctatccgaaggcttgctcgtagaggtggcgtcaagagaatcagtggcctcatctatgaggaaacccgtggagttctcaagatcttcttggagaacgtaatccgtgactcagttacttacaccgagcacgccagaaggaagactgttactgcaatggatgttgtctatgcactcaagaggcagggccgtactctttatggtttcggtggttaagatctcatatattgtacattttcctagggtttttgattttgatgtaatccagatctctattgatggaattatttcttttggattgcttgcttaagaaaatcccaatagtattcttttcagctcaagtttgcttccctgtcatatctgtttgttatgtttcgaatcggttgattattaattgacagtggaactctttattcttcaa

SEQ ID NO: 2856 - DNA, 513 bp, Tropaeolum majus
cggccggggttattcaactcaattacaaataatcatttcgctttttttcaattcctaaagagaatcattcagcatgtcaggaagaggaaagggaggaaaaggactcggtaagggaggagcaaagaggcacaggaaggtattgagggataacatccaaggtatcaccaaacctgcaatccgcagacttgctcgtagaggaggtgttaagagaatcagcggtctgatctacgaggagactcgtggtgttctcaagatctttctagagaatgtgatccgtgattcggttacatacactgagcatgctaggaggaagacagttactgctatggatgttgtgtatgctctaaagaggcaaggtcgtactctttacggatttggaggttaaggtcttagatttctgtgttttggtttcagtggtttgagatttgtaatggtgtgttagggatttaagtttctatgtgaatctgtgcttgtattgaactagttctcttataaattttatcttatatgaaa

SEQ ID NO: 2857 - DNA, 617 bp, Tropaeolum majus
accgccaaactgaaattccaatatactcatttgctctttataaaccctaaccgacattcaatttcacacacttcataataacgcagcaaaagaattcttcaggatcgacagaagatattcaacaatccgattctctatcaaaaaaggatgtctggaagaggaaaaggagggaaaggtcttggtaagggaggagccaagagacacaggaaagtgttgagggataacattcaaggtattaccaagcctgcaatccgccggttagctcgcagaggaggcgttaagcgaatcagtggtctgatctatgaagagactcgcggtgtcctcaagattttcctcgaaaatgttattcgtgattcagttacctacaccgagcatgctagaaggaagactgtgacggcaatggacgttgtctacgctctcaagaggcagggccgtactctttatggctttggcggttaagatatgtctatatttgcgcggttagactcgcgtgttgtgatagtttgcttttgtcttgtagtcaatctgttgtagcctatgagtttcattctacttgatattgatcgatctatttttagtttgctctcgatttcaattttacaaatattagatagatg

SEQ ID NO: 2858 - DNA, 550 bp, Orobanche aegyptiaca
tttcttcagcttcagttcatttcaattaaatccacaaattaggacttaatcaaaatgtcgggaagaggcaaaggcggcaagggattgggcaagggcggcgcaaagcgccatcgcaaggtgttgagggataacattcagggcatcacgaagccggctatccgtcgtctggcccgccgtggtggtgtgaagcgtatcagcggtctcatctacgaggagacacgtggcgtcctcaagatatttctcgagaacgtcatccgtgactccgtcacctacactgagcacgctcgccggaagaccgtgacggcgatggatgttgtttacgcccttaagaggcagggaaggacactttatggctttggtggctaaattcgtagtgctagggttttattagatatagatttagggcctttttgtattatgcttaaacaatggcatactgtatcttacatccgtgtgtatgtttgtttcgttatcttatatggaatggaatttctgtgattttactcctaaactttggttcttctagactatgctattgcttcaattacag

SEQ ID NO: 2859 - DNA, 602 bp, Orobanche aegyptiaca
ctcttcatctcattccaaagtaaatcgataaattagttctcaatcaaaatgtcgggaagaggcaaaggcggcaagggattgggcaagggaggtgcaaagcgtcatcgcaaggtgttgagagataacattcagggaatcacgaagccggctatccgtcgtctggctcgccgtggtggagtgaagcgtatcagcggtctcatctacgaggagacacgtggcgtcctaaagatattcctagagaacgtcatccgtgactccgtcacctacactgagcacgctcgccggaagactgtgacggcgatggatgttgtttacgctctcaagaggcagggaaggacactttatggcttcggtggctaaatttcgtaatgttagggtttgactaaatgtagatttaggggtttgttatattatgcttcaagaatggtactgtgaacaatcttagatccttgtatgactgttttgttttcttacatggaaatgaaatgtagtttctgtgattttaaacctaagctggtgtttggatgtttattttattgttctttcatataattggttctttttgattgtgctatgggttcaatctagagttcaattctgac

SEQ ID NO: 2860 - DNA, 458 bp, Orobanche aegyptiaca
caaagtaaatcgataaattagttctcaatcaaaatgtcgggaagaggcaagggcggcaagggattgggcaagggaggcgcaaagcgtcatcgcaaggtgttgagagataacattcagggaatcacgaagccggctatccgccgtctggcccgccgtggtggtgtaaagcgtatcagcggtctcatatacgaggagacacgtggcgtcctcaagatattcctcgagaacgtcatccgtgactccgtcacctacactgaacacgctcgccggaagacagtgacggcgatggatgtcgtttacgcgcttaagaggcagggaaggacactttatggcttcggtggctaaataaagttagggtttcattagatgtagatttaggggtttcctatattatgcttgaacaatggtactgtgatcaatcttaggtccttgtatgtttgttttgttttcttatatgg

SEQ ID NO: 2861 - DNA, 552 bp, Pisum sativum
aatccatttcttcatcattcttcatcaatttgttaattacagtctgaaatcaagatgtctgggcgtggaaaaggtggaaagggtttgggaaagggaggagcaaaacgacaccgtaaggttctccgcgataacattcaaggtattaccaagccggcgattcgccgtcttgctcgcagaggtggagtgaagcgtatcagtggtccgatctacgaagaaacacgcggtgttctcaagatcttcttggagaatgtgattcgtgacgcagttacttacactgaacatgctaggagaaagactgttactgccatggatgttgtttacgctctcaagagacagggaagaactctctacggatttgggggttagggttaggccttctgttttgatctgtttgctgttggtcgtaaaagctgttaattattatgggattgaaatattacagcagtctgggaaaatagtttgtgtaggataggtaagttattattttgctttcaacaattctgtaatctgttaattataattccagtattgcaaccatatatttttgctcta

SEQ ID NO: 2862 - DNA, 323 bp, Physcomitrella patens
tcatgtctggacgcggcaaaggagggaagggcttgggaaagggcggcgccaagcgtcacaggaaggtgttgcgcgacaacatccaaggcatcaccaagcccgcaatccgtcgcttggctaggagaggtggcgtgaagcgtattagtgggctgatttacgaggagactcgtggtgtcctcaagatctttctggagatcgtcatcagggacgccgttacgtacaccgagcacgcgagacgtaagaccgtgaccgccatggacgtggtgtacgctctcaaacggcaaggcagaaccctatacggatttggaggctaattcccctgc

SEQ ID NO: 2863 - DNA, 318 bp, Physcomitrella patens
tcatgtctgggcgtgggaagggaggcaagggtttggggaagggtggcgccaagcgtcaccgaaaggttttgcgtgacaacatccaaggtatcaccaagcctgccatccgccgtttggcccgaagaggcggcgtgaagcgcatcagtggactgatctacgaagagactcgcagcgtgttgaagatcttcctggagaatgtgattagggatgctgtgacttacacggagcacgctaggcgcaagacggtgaccgccatggacgtggtgtacgcgttgaagagacagggtcgaactttgtatggtttcggaggctaagctc

SEQ ID NO: 2864 - DNA, 526 bp, Cajanus cajan
gcggggactcaaatttcaaatcaaaatccccaaatttgtttgtatctcaaattttaccgagaaaaaatgtctggtcgtggaaagggtggtaagggactcggaaagggaggtgcaaagaggcacaggaaggttcttcgcgataatatccaaggaatcacgaagccagctattcgtagattggcgagaagaggtggtgtgaagagaatcagtggtttgatctatgaagaaaccagaggtgtgttgaagatctttttggaaaacgttattcgtgatgctgttacttacactgagcacgcgaggagaaagcccgtgactgctatggatgttgtttatgctcttaaaagacaaggaagaactctctacggtttcggcggttgaagaagcgttttctgttttttgtattgctttaactgtgtaattggaacatgtgattgttctttgaaatggtgtttattatggctgttaattagtcttttgttcttttgtaagatttgactatattgaaatgaaaagagttactctgcca

SEQ ID NO: 2865 - DNA, 1366 bp, Pinus taeda
cggccggggatcgtctgttattcttcatcttcattgttcgagtatcagaggaatttaccttcaggaaagatgtctgggcgtggaaagggaggcaagggtttggggaaaggtggtgccaagaggcacaggaaggtgctgcgagataacattcagggcattaccaagcctgccatcaggcgtcttgccaggagaggaggtgtcaagcgtatcagtgggctcatctatgaagagaccagaggtgttttgaagatcttcttggagaatgtgatcagagatgccgtgacatacacagagcacgccaggagaaagaccgtgacggcaatggatgttgtctactccctaaagaggcagggccgaaccctttacggcttcggaggctgagaagtttcgattcgtgtctctggtttttgatcatttctttaccaatggtgtctgttgacaccacccttttctatttgggaatggtaaccttgataggtccttctatttattgagcagattgtggtttctttttaagggtattaatgagatttacagtaattgttagtaacggggatgttttaagcttttattgctgaaagttgcctgtatttcgtagcctgaaagttgcagtcgattaataaacgttatctttggcttttgtgattagcggtgaaggtatttggtgatttttcaacgttagtggtctctttgcttcggggaaaatggctcagaaagaaagacaagggttttaggcagttgtagcaaggaaaccctaatcctgattgcaggaaagtaaatgacggaacgaaaacctaatctcggtgctttctataatttagttgtcttcgatgcagaacgcctggcatttatttgctgggtttcattgtacatttgtctgtgtttttagcaggatgagtcaactcatcatttctaacaataaccaaatggtaagctactgtattgctacctggttcttttgggtcaattccatttcctcggcagtgcagtttaatggtggatgttaaatcagactcgccccccttataaaatggtagctgaacattagctaggggccttgtaaggattgtggaagaagtcccttctgctatggagatgattcactaaaggggttcgctgcgttcgccaagtgaatgagtcctagctgaggagcctcaacaggtttaaagatatacagaacgcacttatccgatatcttttaaggtattgatactcctttgtggaccgctgtgagctttcagagagaactggatcttgtaaatctatacttgtggaatttgaatattgtaactatagcgaggatgagtttgactttaagaaattgctttaaagcgttgcatgagattgctgctcagcattctactgc

SEQ ID NO: 2866 - DNA, 644 bp, Pinus taeda
gggggtctgtcattcttcatcttcgttgttggtgttacagaaaagtttttgtgaggaaatatgtctgggcgtggaaagggagggaagggtttgggcaaaggaggtgccaagaggcacaggaaggtgctcagggataacatccagggcatcaccaagcctgctatcaggcgtcttgccagaagaggaggtgtcaagcgtatcagtgggctcatctatgaggaaaccagaggtgtcctcaaaatcttcttggagaatgtgattagagatgcggtgacatacacagagcatgcgaggagaaagaccgtaacagccatggatgttgtttactccctgaagagacagggccgaaccctttacggcttcggaggctgagaaggatgaagtaccattcgttcctcctgttgccagccatttattttctcatggtgtctgttgacaccacctttgtctattggggaatggtaaccttgacaattctctctgtgtattgaacggattgtggatgctctgttttagcgtggaaacagaattgtcaattgtcgttggtagcgggaatatttggacttcagttattgaaaattcttacaattcgcagtctgaaaattgcggtcaatattaatgtttctacaaaaaaaaaaaaaaaa

SEQ ID NO: 2867 - DNA, 552 bp, Solanum tuberosum
gaaattcagaaagcttcttattttagataaactcaaggttgattgaaaatgtcgggccgtggaaagggaggaaaaggactgggaaagggaggagcaaagcgtcaccgtaaggtgctccgtgataacattcaaggtatcactaagcctgctattaggcgtttggctcgtagaggaggagtgaagcgtatcagtgggctaatctatgaggagactcgtggagttttgaagatctttttggagaatgtgattcgtgattctgttacctacactgagcatgctaggaggaagacggtcactgctatggatgttgtctatgcactcaagagacaaggaaggactctgtatggttttggaggatgaatgggagtttttgggttccgacttttgtttagtctgcaaaagtcttgctgtcaagaaattattctgctttttgctggggttaatgggttctattctggtgtaattagtatggttcatgtaggagatgtggttgtagcttgtttcaaaacttctgaaaattagcttgaaatcaatggatactattggcagatt

SEQ ID NO: 2868 - DNA, 489 bp, Solanum tuberosum
ccaaattcaaaaccctagaaacttcttcttcatcaaatttctctgtgaaaatgtctggtcgtggaaagggaggcaagggattgggaaagggaggagccaagaggcacaggaaggttctaagagacaacatccaaggtatcactaagccagctattcgcaggcttgctcgtaggggtggtgtgaagcgtatctctggtctgatctatgaggagacccgtggagtgttgaagatatttttggagaatgtgattcgtgattctgtcacctacactgagcacgccaggaggaagactgtcactgctatggatgttgtctatgctttgaagagacagggaaggactctctatggatttggaggttagattgggggttgtatgttggtagtaaatgtaggttttagtttacaattgcgtttatgcctgtgttggatatctgtagtgatgttctcatgctctagaacttgtaatttctcattacagtatcaatgaa

SEQ ID NO: 2869 - DNA, 652 bp, Rhizophora mangle
ggaacattgagatacatctctttccacaattaacctttttaaatttctcgtctatagtgcttttagttacggtgatttggatttgatttgaggatgtcgggccgtgggaaaggaggcaagggattgggaaagggaggagcaaagcgccaccggaaggttctccgcgataacatccaggggataaccaagccggccatccgtcgcctggctcgcagaggtggcgtcaagaggatcagtgggcttatccacgaggagacacgtggggtccttaaaatcttcctggagaacgtgattcgcgatgcggtgacctatacagagcacgctagaaggaagaccgtgacggcaatggacgttgtttatgctctcaagagacaggggaggactctctatgggtttgggggttgaggtttttcgtccggacctttgtgggtgtgtccgtggagaagtcttgctgtcaagaaaatattataaggttgtttgggggagtttttcagggctaggggtttctaatggaaatggtgtgtgtaattaggtcttgtagtgatggtttttcatttctttttgggtagggcttgcaagacatgttttgcttctggaacttcaatgaaattcctattatcatttacagaaaaaaaaagaaaaaaaatcaaaa

SEQ ID NO: 2870 - DNA, 584 bp, Solanum phureja
ctccaccatccacctcattctcatcagtaattacatccaaattcaaaaccctagaaacttcatcttcttcaaatttctctgtgaaaatgtctggccgtggaaagggaggcaagggattgggaaagggaggagccaagaggcacaggaaggttctaagagataacatccagggtatcactaagccagctattcgcaggcttgctcgtaggggtggtgtgaagcgtatctccggtctgatctatgaggagacccgtggagtattgaagatctttttggagaatgtgattcgtgactctgtcacctacaccgagcatgccaggaggaagactgttactgcgatggatgttgtctatgccctcaagagacagggaaggactctctatggatttggcggttagattctggagtttggttggtgtaatggtagtaactgtaggtttagtttacattgcgtttgtggctggtgtagctgtggattttaattctctgtagcttctttttgggtcttgttgttaagctctatattttgttaatattcaagtaatcaagttcacctttccagaaattacattgtgtatttgcag

SEQ ID NO: 2871 - DNA, 537 bp, Solanum phureja
atataaatacccaccacccaaaagagttcacttcacccaaattcaaaaccctagaaacttcttcttcatcaaatttctctgtgaaaatgtctggtcgtggaaagggaggcaagggattgggaaagggaggagccaagaggcacaggaaggttcttagagataacatccaaggtatcactaagccagctattcgcaggcttgctcgtaggggtggtgtgaagcgtatctctggtctcatctatgaggagactcgtggagtgttgaagatctttttggagaatgtgattcgtgattctgtcacctacactgagcacgccaggaggaagactgttactgctatggatgttgtctatgctttgaagagacagggaaggactctctatggatttggtggttaggggggttgtatgttggtgctatggtggtagtaaatgtaggttttagtttacaattgcgtataagtctgtgttggatctctgtagtgttgttcttatgctctagatcttgtaatttctcattacattatcaatgaacaga

SEQ ID NO: 2872 - DNA, 572 bp, Solanum phureja
accatcgtcttcatcattgtctctcttatcactctttgaaattcagaaagcttcctattttagataaactcaatgtcgggccgtggaaagggaggaaaaggattgggaaagggaggagcaaagcgtcaccgtaaggtgctccgtgataacattcaaggtatcactaagcctgctattaggcgtttggctcgtagaggaggagtgaagcgtatcagtgggctaatctatgaggagactcgtggagttttgaagatctttttggagaatgtgattcgtgattctgttacctacactgagcatgctaggaggaagacggtcactgctatggatgttgtctatgcactcaagagacaaggaaggactctgtatggttttggaggatgaatgggattttgtttagtctgcaaaagtcttgctgtcaagaaattattctgctttttgctggggttaatgggttctattctggtgtaattagtatggttcatgtaggagatgtggttgtagcttgtttcaaaacttctgaaaattagcttgaaatcaatggatactattggcagattcagtttcatatc

SEQ ID NO: 2873 - DNA, 449 bp, Solanum phureja
atcatcaaaatccaaatcaagagcatttcttctctaaaatttattcagaaaaatgtcaggcagaggtaaaggaggcaaaggattgggcaaaggaggagccaagaggcacagaaaagtgttgagagacaatatccagggaattacaaagccagctattcgaagactcgctcgtagaggtggtgtgaagcgtatttctgggttgatttacgaagagactcgtggggttctgaagatctttttggaaaatgtgattcgtgattctgtgacttacacagagcacgctaggagaaagacggttactgctatggatgttgtttatgcacttaagaggcaaggaaggaccctttacggatttgggggttagggtttgttggtttttttttatttgtgctttgatggtgtaattctctgttacatattcatggaatagaaatatgctttagttatta

SEQ ID NO: 2874 - DNA, 460 bp, Solanum phureja
ctagaaactttctctgtgaaaatgtctggtcgtggaaagggaggcaagggattgggaaagggaggagccaagaggcacaggaaggttctaagagacaacatccaaggtatcactaagccagctattcgcaggcttgctcgtaggggtggtgtgaagcgtatctctggtctgatctatgaggagacccgtggagtgttgaagatctttttggagaatgtgattcgtgattctgtcacctacactgagcacgccaggaggaagactgttactgctatggatgttgtctatgctttgaagagacagggaaggactctctatggatttggaggttagattgggggttgtatgttggtagtaaatgtaggttttagtttacaattgcgtttatgcctgtgttggatatctgtagtgatgctctcatgctctagaacttgtaatttctcattacagtatcaatgaa

SEQ ID NO: 2875 - DNA, 416 bp, Solanum phureja
atcatcaaatctctcattttctttctgaattatctctcaaaacttctcaaaaatgtctggccgtggaaagggtggcaagggattaggaaagggtggagcaaaacgtcatcgcaaggtgcttcgtgacaacatccaggggattaccaagcctgctattaggaggttggcgagaagaggtggagtgaagagaatcagtgggttgatttatgaagagacaagaggtgttcttaagatctttttggaaaatgtgattcgtgattctgttacctacacagagcatgctaggaggaagactgttactgctatggatgttgtttatgctttgaagagacaaggaaggactctctatggtttcggtggttaagactttagatctgggttattgggtattagtagtattttagttttgttgatgt

SEQ ID NO: 2876 - DNA, 520 bp, Solanum phureja
atcacaaatcaattcagtctcttctaagttcaatttgatctctgaaaaatgtctggccgtggaaagggaggcaagggtttgggaaagggaggagcaaaacgtcatcggaaagttctccgtgataacattcagggaatcacgaagccggcgataaggaggttggcgagaagaggtggagtgaagagaatcagtggattgatctatgaagaaacaagaggtgttttgaagatctttttggagaatgtgattcgtgattctgtgacttacactgaacatgctaggagaaagactgttactgctatggatgttgtttatgctttgaagagacaaggaagaactctttacgggtttggtggttaatttactatatttttgccttttttttttcattgttgttgctgggaaatggaatctagctggtgttctggttatagttttatgtagatgaagattgtgagatcattgtagttgatgaatttgtgttaaatgaaatagatctcattgatatttggataaaaaa

SEQ ID NO: 2877 - DNA, 453 bp, Solanum phureja
aatcatcaaaatccaaatcaagaacatttcttctctaaaatttcatcagaaaaatgtcaggcagaggtaaaggaggcaaaggattgggcaaaggaggagccaagaggcacaggaaagtattgagagacaatatccagggaattacaaagccggctattcgaagactcgctcgtagaggtggtgtgaagcgtatttctgggttgatttacgaagagactcgtggggttctgaagatctttttggaaaatgtgattcgtgattctgtgacttacacagagcacgctaggagaaagacggttactgctatggatgttgtttatgcacttaagaggcaaggaaggaccctttacggatttgggggttagggtttggtagtttttttattttttatttgagctttgatggtgtaattctctgttactaattcaaggaatagaaatttgcttattctct

SEQ ID NO: 2878 - DNA, 382 bp, Solanum phureja
aaaatgtcaggcagaggcaaaggaggcaaaggattgggaaaaggaggagcgaagaggcacaggaaagtgttgagagacaatattcagggaattacaaagccagctattcgtagactcgctcgtagaggtggtgtgaagcgtatatctggattgatttacgaagagactcgtggggttctgaaaatctttttggaaaatgtgattcgtgattctgtaacttacacagagcacgctaggagaaagaccgttactgctatggatgttgtttatgcacttaagaggcaaggaaggaccctttacggatttgggggttagggtttttttttttttgaactttgatatctgttatatattcatgaaatagaaatttgatttacccatt

SEQ ID NO: 2879 - DNA, 400 bp, Solanum phureja
atataaatatccaccacccaaaagagagcatttcacccaaattcaaaaccctagaaacttcttcttcttcaaatttctccgtgaaaatgtctggtcgtggaaagggaggcaagggattgggaaagggaggagccaagaggcacagaaaggtgctaagagacaacatccagggcatcactaagccagctattcgcaggcttgctcgtaggggtggtgtgaagcgtatctctggtctgatctatgaggagacccgtggagtgttgaagatctttttggagaatgtgattcgtgattcggttacttacactgaacatgctcggagaaaaactgttactgctatggatgttgtttatgctttgaagagacaaggaagaactctttacgggtttggtggttaatt

SEQ ID NO: 2880 - DNA, 334 bp, Solanum phureja
atccattcttcaaaaaaaaaatgtctggccgtggaaagggaggcaagggtttaggaaagggcggagcaaaacgtcaccggaaagttctccgtgacaacattcaaggaatcactaagccggcgattcggaggttagcgagaagaggtggagtgaagagaatcagtgggctgatctatgaagaaacaagaggtgtcttgaagatctttttggagaatgtgattcgtgattcggttacttacactgaacatgctcggagaaaaactgttactgctatggatgttgtttatgctttgaagagacaaggaagaactctttatggtttcggtggttaaaa

SEQ ID NO: 2881 - DNA, 312 bp, Saccharum officinarum
ccatgtcgggccgcggcaagggaggcaagggtctgggcaagggcggcgcgaagcgccaccgcaaggtgctccgcgacaacatccagggcatcacgaagccggcgatccggaggctggcgcgcaggggcggcgtgaagcgcatctccgggctcatctacgaggagacccgcggcgtgctcaagatcttcctcgagaacgtcatccgcgacgccgtcacctgcacggagcacgcccgccgcaagaccgtcaccgccatggacgtcgtctacgcgctcaagcgccagggccgcaccctgtacggcttcggcggct

SEQ ID NO: 2882 - DNA, 553 bp, Solanum lycopersicum
atctccattgtcattgttattagtccttcaagctttcaatttcagatacactcaaggttgattgaaaatgtcgggtcgtggaaagggaggaaaaggattgggaaagggaggagcaaagcgtcaccgtaaggtgctccgtgataacatccagggtattactaagcctgctattcggcgtttggctcgtagaggaggagtgaagcgtattagtgggctgatctatgaggagactcgtggtgttttgaagatctttttggagaatgtgattcgtgactctgttacttacactgagcatgctaggaggaagacagtgactgctatggatgttgtgtatgcactcaagagacaaggaaggactttgtatggttttggaggttgaatgtgacttttgtttagtctgcaaaagtcttgctgtcaagaaattgttgttttggttttttgctggggttaatgggttctgttctggtgtaattagtatggttcatgcaggggatgtggttgtagcttgtttaattttgcattaatacaattcacagattcagtttcacatctt

SEQ ID NO: 2883 - DNA, 497 bp, Solanum lycopersicum
atcacaaatcgattcaatctcttctcagttcaatttttcgatctctgtaaaaatgtctggccgtggaaagggaggaaagggtttgggtaagggaggagcaaagcgtcaccggaaagttctccgtgataacattcagggaatcactaaaccggcgataaggaggttagcgagaagaggcggagtgaagagaatcagtgggttgatctatgaagaaacaagaggtgttttgaagatatttttggagaatgtgattcgtgattctgttacttacactgaacatgctaggagaaaaactgttactgctatggatgttgtttatgctttgaagagacaaggaagaactctttacgggttcggtggttgatttcgtatgttttcatcttttttttcattgttgttgatgggtaattgaatttagctggtgttttggttatagaatcattgtaattgatgaatttgtgttgaatgaaatagttctcattactagttcagatata

SEQ ID NO: 2884 - DNA, 584 bp, Solanum lycopersicum
aaaaaatcgccaaattcgaaaatcaaatctctataaaaccctaaccctaaccccaaccccatgtaatttcatcacaaatcaattcaatctcttctcagttcaatctgaccactgaaaaatgtctggccgtggaaagggaggcaagggtttgggaaagggcggagcaaaacgtcaccggaaagttctccgtgataacattcagggaatcactaagccggcgataaggaggttggcgagaagaggtggagtgaagagaatcagtggattaatctatgaagaaacgagaggtgttttgaagatctttttggagaatgtgattcgtgattctgtgacttatactgaacatgctaggagaaagactgttactgctatggatgttgtttatgctttgaagagacaaggaaggactctttatgggtttggtggttgatttcatatgttttcaccttttttttcattgttgttgatggaaaatggaatctagctgttgtttttggttatagttttatttagagaagattgtgagatcattgtaattgatgatttgtgttagatgaaatggatctcattactttttcagttat

SEQ ID NO: 2885 - DNA, 491 bp, Tragopogon dubius
atccgctccacctccatttcttcaaatctacaaggtttcagacttcgaaaaagttcgaagatgtcgggacgtggaaagggaggaaagggattaggaaagggaggagcaaagcgtcaccgtaaagttcttcgtgataacatccagggaatcaccaaaccggcgattcgacgtctggcgagaagaggaggtgtgaaacgtatcagcggtttgatctacgaggaaacccgtggagttctcaagatctttctagaaaatgtcatcagagacgccgttacctacaccgagcacgcacgccgtaagactgtgaccgccatggatgtggtgtatgcgttgaagagacaaggccgaactctgtgcggattcggtggttagggtttttgatttctggaaaagtcttgctgtcaagaaagaaatgagtccgattgtgtttgttggtattgttgttaggttagagatttccacttcttgttgaaatcgaatttagtttagta

SEQ ID NO: 2886 - DNA, 440 bp, Amborella trichopoda
gtcaggaagaggaaagggaggaaagggcctgggaaagggaggagcaaagaggcacaggaaggtcttgagagataacattcaggggatcactaagcctgcaattcggcgtttggctcgaaggggcggagtgaagaggatcagtggtttgatctatgaagaaaccagaggggtcttgaagatttttcttgaaaatgttattcgcgatgctgttacctacaccgagcatgcaaggaggaagactgtgaccgccatggatgtggtctatgctctcaagaggcaggggaggaccctctatggctttgggggttaatgttccaactttcagagagcttcccccgttttgtctctttctctctcgaaaatggtgtctttgtgcaagatatagcccaatttgtatccgtaaaagaaaagggttttggaattgataagaggcggtttct

SEQ ID NO: 2887 - DNA, 375 bp, Antirrhinum majus
atctaattcaattttccctctcaaatttcaaattccgatctcgaaaatatgtccggcagaggcaaaggcggcaaaggattgggcaaaggcggagcaaaacgacaccgtaaggttctaagagacaacattcaaggcatcacaaagcccgcgattcgtcgtttggctcgtagaggcggtgttaagcgtattagcgggctgatctacgaggggacacgtggcgtgctcaagatatttttggagaatgtgatccgtgatgcggttacgtacactgaacacgctaggaggaagactgttaccgctatggatgttgtttatgcgttaaagaggcaggggcgtactttgtatggatttggtggttaagttagggtttgattg

SEQ ID NO: 2888 - DNA, 622 bp, Malus domestica
cctctgcttaaatcttcttgttcaatcgagcacgacttcgtcgaacagtttccgattcagaaatccaagcttgaaacaaaatgactgggcgtggaaagggaggaaaaggtctgggaaagggaggagcaaaacgtcaccgtaaggtcctccgcgacaacatccaggggatcacaaagccggccatccgccgtttggctcgcaggggcggcgtgaagcgtatcagcggtctgatctacgaggagacacgtggagtgctcaagatctttttggagaacgtcatcagagacgccgtgacctacaccgagcacgctcgccgcaagaccgtgacggccatggatgtggtctacgcgctcaaaaggcagggcaggaccctgtacgggttcggtggctagggtttttgggggtcttcaagtcttgctgtcaagaaatgggttaatgggtttggtttagtggttaattacgaattaattagttgtttttactttgtttagatggttaagcaattgttactgttcttgttatgtggctttgtaaagtgattacggactaagtttcctatgtttgtttggaattggaatgaagttgaatgaaacggtggtgttttgatctgaaaaaaaaaaaa

SEQ ID NO: 2889 - DNA, 593 bp, Malus domestica
caaaccattgtctcacttactctgcaactctcagatttttgaaattttcggctcgcaacaatgacgggacgtggaaagggaggcaagggactgggcaagggaggagcgaagcgtcaccgtaaggtcctccgcgacaacatccagggcatcaccaagccggcgattcgccgcctggcccgcagaggcggcgtgaagcgaatcagcggcctgatctacgaagagacccgcggcgtcctcaagatctttctcgagaacgtgattcgggacgccgttacctacacggagcacgccaggaggaagacggtgacggcgatggacgttgtttacgctctcaagaggcaaggcaggactctgtacgggtttgggggttagggttctggtggggaaaagtcttgctgtcaagaaaggactggtgatttggtgtttgtattgttagggtttaggtttcgatggctgatgctgtaattagtgtcgtagttagtggtgtttttcaatgttggttcaatctcaaagttgcaatttgtaattcgttctctggattctaatttctgaagaaattaatagaattttggttttggtatgtgcaaaaaaaa

SEQ ID NO: 2890 - DNA, 556 bp, Malus domestica
ttttatatgctgcaacaaatttgtttgggaagtcagaaaatttaaattttccgggaaaatgacagggagaggaaagggaggaaaggggctgggtaagggcggagccaagaggcacaggaaggtgctgagggacaacatccaggggatcaccaagcccgccatacgaaggctcgctcgcagaggaggtgtgaagcgcataagcggcctcatatatgaagaaaccagaggggttctcaagatcttcttggagaacgtcattcgtgacgctgtgacgtacaccgagcatgccaggaggaagacggtgaccgccatggatgttgtctacgctctaaagaggcagggacgaaccctttatggtttcggaggttaattcaagatgttttgaatcgaatccttctggttaaatttggggctttttgtaaaacttgttatgatctgatgaatttgcttgttaattttgaatgcctaagatcgatttgaatatgtaattccaatcggatcctttccacttccaatgccatcaatgaagatgtattacttagagaaaaaaaaaaaa

SEQ ID NO: 2891 - DNA, 689 bp, Malus domestica
caatctttccactgtcaccaaaatctatccttcgaaacgacaccgtaagacacgacaatgacaggccgcgggaagggaggcaaggggctgggcaagggcggagcgaaacggcaccgtaaggtcctccgcgacaacattcagggaatcaccaagccggcaattcggagactggccagaagaggtggggtgaagagaatcagcggccttatctacgaggagaccagaggcgtcctcaagatcttcttggagaacgtgattcgcgacgctgttacctacaccgagcacgcgcggcggaagacggtgaccgcaatggacgtcgtctacgctctcaagaggcagggcaggaccctgtacggattcgggggttaattttgtaaattgggatatcggggtttcgaatgggtcggaatctcagattcgggttttgtaatttgtcgctaaagtttggaaattggaagtaatccttggtttgtttggacttttgcaagtagcgctccgtggttgttggcttgtagttttcagtcgcgatctgaatcatttctgcttttgaaatgtgtttctacgagtaagtgctgtatgtcggtagagattagagatgttgaactttatattttcttctttcaactttgtgccctctaatcttttaaattggttatttttcatccattacttattctaccgttcactta

SEQ ID NO: 2892 - DNA, 636 bp, Malus domestica
cgcgtccgcggtaactcgctctctcaattcgaataccggatccaaaatcaaaccctaatttcatttccgcggcaatgactggacgcggcaagggaggcaaggggctgggcaaaggaggagccaagaggcacagaaaggtgctgagggacaacatccagggtatcaccaagcccgccatccgccgtctggctcgccgtggcggcgtcaagcgtatcagcggcctcatctacgaggagacccgcggagtgctcaagatcttcttggagaatgtgatccgggatgccgtgacttacaccgagcatgcccggaggaagactgtgacggcgatggacgtcgtctatgcgctcaagaggcagggtaggactctgtacgggttcgggggttaggttgttgtggtatcggactggggatttctgtaaattggtcggtagatttagttaacgaatttcagaaatttaatgtttgtagtttggatattaatggaacgtgaatctgttttcattcgaacttttgaatgaaatttctgttaattttatctattttgtttctattgaaattgtatttcgatgcttttgtgttgggtggttatgttgacaagttgttacaacgttggattaataaagttgattcgtactt

SEQ ID NO: 2893 - DNA, 561 bp, Malus domestica
caagttcaatatcttggcgtgatcctcgtgccgaattcggcacgaggcttcaatttacacaacaaatttgtttgggaggacagaagatttaaaattttcgggaaaatgacagggagaggaaagggaggaaaggggctgggaaagggcggagccaagaggcacaggaaggtattgagggacaacatccaggggatcaccaagcctgccatccgaaggctcgctcgcagaggaggagtcaagcgcataagcggcctcatctatgaagaaaccagaggggttctcaagatcttcttggagaacgtgattcgtgatgctgtgacttacaccgagcatgccaggaggaagacggtgactgccatggatgtggtctatgctctcaagaggcagggtcgaaccctctacggttttggaggttaaatcaagatttgtagaatcaaatccctcgttcaaaatttggggctttttgatttttgagttcccattgaatatgtaattccaattagacttgttctgcttccaattccatcaatgaagatatattattcaaagaaaaaaaaaaaa

SEQ ID NO: 2894 - DNA, 542 bp, Malus domestica
cgttgctgtcgccgttgctgtcaatttcttacccaaaaattttcctgagaaaatgacaggacgaggaaagggcggcaagggattgggcaagggaggagcgaaacgacatcgtaaggttctgagggacaacatccagggcatcaccaagcctgctattcgccgtcttgcccgccgaggtggtgttaagcgaatcagcggtctgatctacgaggagaccagaggagttctgaagatctttttggagaatgttattcgtgatgctgtgacgtacaccgagcacgccaggaggaagactgtgaccgccatggatgtcgtgtatgctttgaagaggcagggaaggaccctatacggtttcgggggttaaattgggaattttatgtcattattttgggaattagggttaggtttgcttaggatctgggctttagatctttgggtttaatttgtattttgttggtaacggttagtgtttatgtaatttgtaatcttattttgaagtaatataagttcgacctgttagtaaatctttgccttaaaaaaaa

SEQ ID NO: 2895 - DNA, 516 bp, Malus domestica
gcttctgctttctttctgtggaagcttcccgaattcgaaaatctgaccccaaatcgaaactccaaattcatttcgcagcaatgacgggacgcggcaagggaggcaaggggctgggaaaggggggagccaagaggcacaggaaggtgctgagggacaacatccagggcatcaccaagcccgccatccgccgtctggctcgccgtggtggcgtcaagcgtatcagtggcctcatctacgaggagacccggggagtgctcaagatcttcttggagaatgtgatccgtgacgctgtgacctacactgagcacgccaggaggaagaccgtgacggcgatggacgtcgtctacgcgctcaagaggcagggcaggactctctacgggtttgggggttaggttattaggatttcggattggggattttgtaaatgggttggttggtgggtagaattaggtatggaagtgcttcaattttatgttttgaatttggatttgaatcgaaaatctacttgttttcaaa

SEQ ID NO: 2896 - DNA, 509 bp, Malus domestica
caaaaatcaaactttctcaaccaaaattttttccgagaaaatgacaggccgagggaagggaggcaagggcttgggcaagggaggggcgaaacgacatcggaaggttctgagggacaacatccagggtatcaccaagcctgcgattcggcgtctcgctcgtagaggtggcgtgaagcgtatcagcggtctgatctacgaggagaccagaggagtgctcaagatctttctggagaacgtgattcgtgatgccgtgacttacaccgagcacgccaggaggaagaccgtgaccgccatggatgtggtgtatgctctgaagaggcaaggaaggaccctctacggtttcgggggttaaattgggaatttcatgtcgatatgttgggaattagggttaattgtctttcatggtagcatttagtattgatgtaatttggacctttactttcaagtaatataagttggatttcttagtaaagctttgtcttcaattctactttatggatcaaaaaaaa

SEQ ID NO: 2897 - DNA, 553 bp, Artemisia annua
  misc_feature (37)..(37): n is a, c, g, or t
  misc_feature (39)..(39): n is a, c, g, or t
  misc_feature (46)..(47): n is a, c, g, or t
  misc_feature (50)..(50): n is a, c, g, or t
  misc_feature (55)..(56): n is a, c, g, or t
  misc_feature (59)..(59): n is a, c, g, or t
  misc_feature (136)..(136): n is a, c, g, or t
  misc_feature (148)..(148): n is a, c, g, or t
  misc_feature (176)..(176): n is a, c, g, or t
  misc_feature (178)..(178): n is a, c, g, or t
  misc_feature (190)..(190): n is a, c, g, or t
  misc_feature (193)..(193): n is a, c, g, or t
  misc_feature (212)..(212): n is a, c, g, or t
  misc_feature (223)..(223): n is a, c, g, or t
  misc_feature (274)..(274): n is a, c, g, or t
  misc_feature (277)..(277): n is a, c, g, or t
  misc_feature (292)..(292): n is a, c, g, or t
  misc_feature (322)..(322): n is a, c, g, or t
  misc_feature (428)..(428): n is a, c, g, or t
  misc_feature (475)..(475): n is a, c, g, or t
  misc_feature (480)..(480): n is a, c, g, or t
  misc_feature (515)..(515): n is a, c, g, or t
gcacaacacacaaacaacaatcaattaatccaaacancnacaaacnncantcaanntgnaaaaaatgtcaggaagaggaaagggaggaaagggattaggcaaaggaggagcaaagcgtcatcgtaaggttcttcgngacaacatccanggtatcaccaagcctgccatccgtcgtntngctcgtcgtggnggngtgaagcgtatcagcggtntgatttacgangagacacgtggcgtcctcaagatctttttggagaatgtgatccgtgatgcngtnacctacactgagcangctcgccgtaagacagtgaccgctatggangtggtttatgctttgaagaggcaaggaaggactctctacgggtttgggggttagagttgaaattagggtttgttagggtttgattatggtgtttgttaatctttcngatgtggttaggtggttgttatgctttagatctggttagttggttangtgtngaggtgttctgttatatcttgtaactggagcttgntttggaattaatatgatgttatcgtttggttagaaaaa

SEQ ID NO: 2898 - DNA, 615 bp, Persea americana
  misc_feature (586)..(586): n is a, c, g, or t
  misc_feature (597)..(597): n is a, c, g, or t
tctgggagagggaaaggagggaagggtcttggaaagggaggagcgaagcggcacaggaaagttctgcgggacaacatccagggcatcacgaagcctgcgatccgaaggctggctcgccgtggaggcgtgaagcgcatcagcggcctcatctacgaggagacgaggggcgtcctcaagatcttcttggagaacgtcatccgtgacgccgttacatacacggagcacgctcgtcgcaagaccgttacggctatggatgtcgtctatgccctcaagcgccagggccgaaccctctatgggtttggtggttagccctctttcagatctcttggctggtgtaggtaggtaggtaggtaggtagtattgtaggtaggtaggtaggtaggtagtattgtaggtaggtaggtaggtagggttttcatcaaatacatgtagtttgatttgcatctattgtgtgaaaccagatccatggagcatagtgtgagaatttgagactttgagattgtggaaatgtaaatagatgttggatctgttgagggttttattctcatctgtattgattgtgtggcctgcccacttgatgatgaanggaaaattacntagtgttttctgattacg

SEQ ID NO: 2899 - DNA, 488 bp, Brassica rapa
  misc_feature (296)..(296): n is a, c, g, or t
gaatacacaaaaccaaaacaaaagatctttgagaaaatctgagatttagcgttgttgaaaaatgtcgggtcgtggaaagggaggcaagggtttggggaaaggaggagccaagcgtcacaggaaggttctcagagacaacatccaaggaatcaccaagcctgcgattcgtcgtttggctcgtagaggaggcgtgaagcgtatcagcggtctgatctacgaggagactcgtggcgtcctcaagatctttttggagaacgttatccgtgacgccgtcacctacaccgagcacgcgcggnggaagacggtgacggccatggatgtggtgtatgctctcaagaggcaagggaggactctctatggattcggcggctagggtttttaaaattgttttcgttaaatcaaatctcagatgtgattctatctttagtcatttcagcttctctttatggttttgtatcatcaaaatatatgaaattcacatttgactg

SEQ ID NO: 2900 - DNA, 655 bp, Hordeum vulgare
atgtaatttggtcttattcactttgctttcctatacacatcacttaatatggtctgtcattgtaaaaaaaaaaaaaaaaaaactcgagactagaagacacaaacacagaggccaatccaagctcgccggagagaagccaagcgtcgaggatgtcgggccgtggcaagggagggaaggggctgggcaagggcggcgccaagcgccaccggaaggtgctgcgcgacaacatccagggcatcaccaagccggccatccggcgcctggctcgccgtggcggcgtgaagcgcatctcggggctgatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggcttcggcagctgacccgcgcccgctgctgccccctcttgtcgaccctgctagcggctgctgctgttcggtgctatggtttcgtttctgtatgcgtgcgttgttgttccatcggtcagtgtagttagtggaaggctatggatctgaatgcaatggaattgttggttcttgcaagaaatgaatttgaatgcattcgaatttgtactgca

SEQ ID NO: 2901 - DNA, 699 bp, Hordeum vulgare
atgtaatttggtcttattcactttgctttcctatacacatcacttaatatggtctgtcattgtaaaaaaaaaaaaaaaaaaactcgagactagaagacacaaacacagaggccaatccaagctcgccggagagaagccaagcgtcgaggatgtcgggccgtggcaagggagggaaggggctgggcaagggcggcgccaagcgccaccggaaggtgctgcgcgacaacatccagggcatcaccaagccggccatccggcgcctggctcgccgtggcggcgtgaagcgcatctcggggctgatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggcttcggcagctaggcccccctgctccgtccagtcgaacccacttcccgccgccagattcgtagctagccatgctcgttgttcattgttcatcgtcttcggcgtaatgtaatggaatggctgcatctcgctgctgtctgttgtttggatgtactgtactactactgctagcatgcaatggagagctctgcatttacccctggattcgtctgcaatgtgttgctctgctgtcaaatcttattagttcgtttcc

SEQ ID NO: 2902 - DNA, 516 bp, Hordeum vulgare
tcctcttttccccaaccacacctctctcggagctaggcggagcggcgatgtctgggcgcggcaagggcggcaaggggctgggcaagggcggcgccaagcgccaccggaaggtcctccgcgacaacatccagggcatcaccaagccggccatccggaggctggccaggagaggcggtgtgaagcgcatctccggcctcatctacgaggagacccgcggcgtcctcaagatcttcctcgagaacgtcatacgcgacgccgtcacctacaccgagcacgcccgccgcaagaccgtcaccgccatggacgtggtctacacgctcaagcgccagggccgcaccctatacggcttcggcggctaggttccccgattccgctggcggcagtagcagtagtacgaatgtatcgggtgtcctctgtggtaggtgggatgtaccactgattacgcgtgcgttgtagcgtaccatgttcaattggctgaaataccttgttgcgggcaatgaaaccagttatggtctg

SEQ ID NO: 2903 - DNA, 449 bp, Ocimum basilicum
tcgggaagaggaaagggcggaaagggattgggcaagggcggtgccaagcgccaccgcaaggtgctgagggataacatccagggcatcacaaagcccgcgatccgccgcctggctcgccgtggcggcgtcaagcgtatcagcggcctcatctacgaggagacgcgtggcgtcctcaagattttccttgagaatgtgatccgtgacgccgttacctacaccgagcacgctcgccggaagactgtgacggcgatggatgtcgtctacgctctcaagaggcagggccgaaccctgtacggcttcggtggttaagcttgtgtagttgttgagatatctgtgctcgatgtatttaatagttactttctatttgctgtgatttggattagactgtagtattcatcaggtacttttcaagctgcaataagggtcatcgatgtgttccgatttcattt

SEQ ID NO: 2904 - DNA, 620 bp, Cenchrus ciliaris
  misc_feature (80)..(80): n is a, c, g, or t
  misc_feature (220)..(220): n is a, c, g, or t
atcccctccccgcccccaaatcccaaaatccccaacccctccttcaagttcgagcgagcgagcgaccatgtctgggcgcngcaagggcggcaagggtctgggcaagggcggcgcgaagcgtcaccgcaaggtcctccgcgacaacatccagggcatcacgaagccggcgatccggaggctggcgaggaggggcggcgtgaagcgcatctcggggctcatntacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggctgaggcccggcgccctgtggccgcggcgtaggtcttgggttgcggtcaagaaattggtggaggcgagggtgttctggtccctgttcagtttcgtaggtttatcactagtgctaattattgtcctgtgtttagagccgtggtcgaggtagtagtatgtggaattgtggaggttgtactgcaaagttcatctgcatttcccagtctgttctgaatttctaatatatatgaatccggtgccttgcca

SEQ ID NO: 2905 - DNA, 560 bp, Cenchrus ciliaris
cgaatcctccaccaaatctctcctagcggcagagtcttcttcctcacctcagcttcggcgatgtctgggcgcggcaagggcggcaaggggctcggcaagggcggcgccaagcgccacctgaaggtgctccgcgacaacatccagggcatcacgaagccggcgatccggaggctggcgaggaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggattcggcggttgatcgcgtctccttccacgtctgcagctgttgttggtggtggtggtgttgctgtgttcttttgcgttccctgtgctgtgcttttcccctggcgatgtacagaggtcatgttcctagatgatagatctgtcgagtgctttattcctaagtggtggatgctatgtaatggtctaattaaagttgaactccca

SEQ ID NO: 2906 - DNA, 699 bp, Cynara scolymus
aaccaaaggtgttcatttcagaagtgatttctgcaacaatgtcaggccgtggtaagggcggaaaggggctcggaaagggaggagcaaagcgtcatcggaaagttctacgtgataacattcagggaatcacaaagccggcgatcaggaggttggcgaggagaggaggagtaaagagaatcagcggtctgatctatgaagaaaccagaggtgtgttgaagatctttttggaaaacgttattcgcgatgcggttacttacaccgagcatgcgcggaggaagaccgtgactgcaatggatgttgtgtacacactgaagagacaaggcaggactctttatggatttggtggatgagatccttaataggttcttaccgttctgttgaaataagttaggttttctcttccgatcatcttttgttttcgtagttatattctacatgaaattgtggttattgatctacgaatttctgatcggtttaaatttggtatgacatggtctatgtaaattgaatctttcgatcttcctcctttgatttcaataaatcagactgttggtacactactttacccttcccttctatgcacattgaaaaaggccgcctcggccccgccgactctgaacccgggcaggctatcgatgcggccgcaattcagcacactggatgggccgtctttttcaaggtcaaatccaacctaaaccg

SEQ ID NO: 2907 - DNA, 460 bp, Cynara scolymus
gcggggaccgattcgataattttagagagagagaaaaaatgtctggaagaggaaaaggaggcaagggattgggaaagggaggagcgaagcgacatcggaaagttctccgtgataacatccagggaatcacgaagccggcgatccggcgtctagcgaggcgtggtggcgttaagcgtattagcggtcttatttatgaggagacacgaggtgtgttgaagatctttctcgagaatgttattcgtgacgctgtaacctacacggagcacgctcgtcggaaaaccgttactgctatggacgttgtttatgctttgaagcgggggggccgtacactgtacggttttggtggttaaggtacgctaggttttctagggttaggttgtggtattttgtgtagagatgtgtgatacatcaatgtaaccgaagctcgtttgcgatttgaaatgaattttagttcaattcc

SEQ ID NO: 2908 - DNA, 572 bp, Zingiber officinale
  misc_feature (13)..(13): n is a, c, g, or t
  misc_feature (57)..(57): n is a, c, g, or t
  misc_feature (102)..(102): n is a, c, g, or t
  misc_feature (194)..(194): n is a, c, g, or t
gtttcttggctcnccaggatttttgattcttgattcgtcggaggcgaggtgatgtcngggcgtgggaagggcggcaagggtttgggcaagggcggggcgaancgccaccgcaaggtactccgcgacaatatccagggtatcaccaagccggcgatccgtcgattggcaagaaggggtggcgtgaagcgcatcancggcctcatctacgaggagactcgcggcgtgctcaagatcttcctggagaacgtcatccgtgacgccgtcacctacaccgagcacgcgcgccggaagactgtcaccgccatggacgttgtgtatgcgctgaagaggcaaggaaggactctatatggtttcggtggttagggttttgcctttgtcaaaagtcttgctgtcaagaaaattggggaaactttgcatctggggcaagttggcaaatttgtgatccagcgttgaaattgcggtattagggtttgtgttataactatgtggtgattttgttgcaattgcagttatcatgtctgcatctcttctgatataagcttgctaattggtactatgcacgatcctcgtgc

SEQ ID NO: 2909 - DNA, 523 bp, Actinidia deliciosa
  misc_feature (510)..(510): n is a, c, g, or t
cttgcttcaacttccccattaacaaatctctctctcaaaagtgaagtaatttctctctctctctgaaaatgtctggtcgaggcaagggaggaaagggccttggcaagggcggagcgaagaggcaccggaaggtgctccgggacaacatccaggggattacgaagccggcgattcggaggctagcgaggcgaggcggcgtgaagcgaatcagcggcctgatctacaaggagactcgcggagtgctcaagattttcttggagaatgttatccgcgacgccgtgacatacacagagcatgccaggaggaagacggtgaccgccatggatgtggtgtacgcgctcaagaggcagggcaggactctgtacggattcggcggctgaggtttggggttaggggtagggtttctgctattttttgggaatccgtggtggttgtgtaaattggggcaatagtgatctgataggtttatagtcgtgtaattgaatgatttcagttcaatataagtatcgntattctctccttt

SEQ ID NO: 2910 - DNA, 392 bp, Actinidia deliciosa
  misc_feature (347)..(347): n is a, c, g, or t
atcaattgccatagcaaaaccctaacaactctctctttctctctctctctctctctctcgaaaatgtctggtagaggcaagggcggcaaggggctgggcaagggcggagcgaagcggcaccggaaggtgttgcgcgacaacatccagggcatcacgaagccggcgatccggcgcctggctcggaggggtggggttaagaggatcagtggcctcatctacgaggagactcgcggcgtcctcaagatcttcctcgagaacgtcattcgcgacgctgtgacctacaccgagcacgcccggaggaagactgtgactgccatggatgtggtctacgctctcaagaggcaggncaggactctctacgggtttggtggttgagtcggtggttggtgtgg

SEQ ID NO: 2911 - DNA, 619 bp, Lactuca sativa
atattcatctctctacagaaatccgaagctttttcagtttgcgaagtgattattccaacaatgtcaggacgtggaaagggtggaaagggtcttggcaagggaggagcaaagcgtcatcggaaagttctccgtgataacattcagggaatcacaaagccagctatcaggaggttagcgaggagaggaggtgtaaagaggatcagtggtctgatctatgaagaaaccagaggtgtactgaaaatctttttggaaaatgtgattcgtgatgcagttacatacactgagcatgctcgaaggaagactgtaactgcaatggatgttgtctacgctctgaagaggcaaggaaagactctttacggatttggaggctgagatccataaatggttcttcgtaccctcactgttctattttcttttcgttcttgtagtggttctatctataaaatttccattttttagatctagtagctttatgtaaatcgattgcttcaatccttaaaaaggatgatattaatttaatctactgcctttgtttaagaaggacgcccaaaaatgtaaccgtcaagtgcaaggatgttggcatcaccgctctccacatcaagctccgtgctaccggtgg

SEQ ID NO: 2912 - DNA, 595 bp, Lactuca sativa
cggcggggacacttccatttgcatttcttccaatcaacaaagtttcagatttcggagtaatttgaagaagtttgaagatgtcaggacgtggaaagggagggaaaggattggggaagggaggagcaaagcgtcatcgtaaggttctgcgagacaatatccagggaatcacaaaaccggcgatccgacgtctggcgagaagaggaggtgtgaaacgtatcagcggtttgatctacgaggaaactcgcgtagttcttaagatctttctagaaaatgtcatcagagatgctgttacctacaccgagcacgcacgccggaaaactgtcaccgccatggatgtggtgtacgcgctcaagagacaaggccgaactctgtatggattcggtggttagggttttcaaggcccgaaaatagtctgtgggtattggtgttaggttattgatttctactgcttgttcaaatcaaatgttgttagtacttagtgtaagcctcggatcattttaacaaaatagaagtactcgactgatttcttatctcgatgtttccaaatcaaaatgctttttggcaaaattagaattgcattcagttgacttttgca

SEQ ID NO: 2913 - DNA, 732 bp, Marchantia polymorpha
  misc_feature (730)..(730): n is a, c, g, or t
ttcgagacccccggcagacacatctcgagcatttggtggcaatccgcttcctttcttgaatctgtcgagaatttccagttcgcagccatgtctggacgcggaaagggaggcaaaggtttgggcaagggaggcgccaagcggcacaggaaggtcttcagagataacatccagggtatcaccaagcccgccatcaggcgtctggcccgaagaggaggtgtcaagcgtatcagcggactgatttacgaggaaactcgcggagttctgaagatctttctggagaatgtgatccgggatgccgtgacttacaccgagcacgcgaggaggaagactgtcactgcgatggacgtggtgtacgcgttgaagaggcagggacgaactctgtacgggttcggaggatagaacgcttatcctcttagcgactcagagcttgacagtcgatgcgtttttgtatagcggatgaattctccctttgacttggatcgatgcgatccagtcgacgacgtcggccgatggggggacgattgatatttcaactcagacttctaggcaatgtcagcttacagattcaaccgctctcattgaattgtatagatcacgctgctcttacagctgacaggtgccctggataaatatcggtggccaagtatgccacaacgttttcgtcatttcagaaatgtctcgggttgacatcccactgtaaaggttaccttgaattcaaattttctctccngc

SEQ ID NO: 2914 - DNA, 788 bp, Marchantia polymorpha
tctgtgttgtccaattcgattgagtttcgttcagctcagagtgtagagtcggcaagacgcagccatgtctggacgcggtaagggaggtaaaggtttgggcaaaggaggcgccaagcgtcacaggaaggtgttcagagataacatccagggaatcaccaagcccgccatcaggcgtctggccagacgtggaggagtgaagcgtatcagtgggctgatttacgaggagactcgcggagttctgaagatctttctggagaatgtgatccgagatgcggtgacgtacacggagcacgcgaggcgcaagactgtgactgctatggatgtggtgtacgcgctgaaaagacagggaagaactctgtacgggtttggaggatagaacatctattttttcgcttttcgcgagagcaaatccactcgctcatatcagtgggaaattctccgacttgatctggaggctgagtactgatcatagtccatggactcgacgacgtccatcgacgcggaagggtgttagcagaaacactgagaactccggacgatgtcagctcttgaattcatgtgcccttgatgaattgtatagaatacgctgcgctgcacatcttacagacgccctctgcggcgaggaagaatctttttagttcaccttaagttaccaaaggatcatatagtcactgaaaagtgcccttgggttgataaccccgtgtaaattcttacttcgaacttcattttttcaatccaacttcaaaacaagaaacgaagcgctcatttttttgggactaaaaaaaaaa

SEQ ID NO: 2915 - DNA, 978 bp, Marchantia polymorpha
ctgataatcccgcccacgctgccttgcttactcgtccctatcgccgaggaacagctcactccctctctctgtctctttagttatttctgtctgccttcgcgactctgttcgttgttagtcctcgaggtttgtttgggtctgcggagacttgcgttaagcaaggacgagttgaacagagccccgaggcctggtcagaacatttgcgtttggagtgccagtgtgaagtggagcagttctgaagtgaacttggttctctctgggcgtgactccgacggacggatttgttgagggggcgaaaagtgtaatcgaggtttgtcgatcgtgttgttgattaggaggcgcaatgtcaggacgaggaaagggaggaaaggggttggggaaaggtggtgccaagcgtcacaggaaggtttttagagataacattcagggtatcaccaagcctgccattcggaggcttgctaggagaggtggagtaaagcgtatcagtggtctgatttatgaggagactcgtggtgtgctgaagatttttctggagaatgtcattcgtgacgcggtgacgtacaccgagcacgctcggcggaaaactgtcactgctatggatgttgtctacgccttgaagaggcagggaagaaccctgtacgggttcggaggctaagaagccaattgcctcgattgtactgaattatacattgtccattcaaaagctggtgtgtggaattcgcgagcgtctgagcgggtgcaccatcaacctcattctcttcgttacagttagggtttcttctacatgtggaccctgtcagataacctcgcccgaggttgtgaatagtcttaagttcatagttacgagatgcaacgatggcccagttgcattgtcctgagcagaagtagcctcacgatgtacagtatgacaatcaatgtgacacaccttcaaagttaacggaatacatcatgttttgttctctaccgtcaaaaaaaaaa

SEQ ID NO: 2916 - DNA, 484 bp, Medicago truncatula
  misc_feature (190)..(190): n is a, c, g, or t
cattatggccggggacacattcaaaatcaaatctcaaaccctaatttcccaaattcttcaatttctcaaattttcattcaaaaatgtctggtcgtggaaagggaggtaaaggattaggaaaggggggtgcaaagagacatcgcaaggttctccgtgacaacatccaaggaatcacaaagccagcgattcntcgattggcgagaagaggaggtgtgaaaagaatcagtggattgatctatgaggaaacaagaggtgtgttgaagatcttcttggagaatgttataagagatgctgttacttacactgagcatgcgaggaggaaaactgtgactgctatggatgttgtttacgcgcttaagagacaaggaagaaccctctatggtttcggtggttgaagatgatgaagttttttgtgtagttgttatgggtttttctttgtaagttttaacaagattgaaattgaatgaaatgctctttcttggtg

SEQ ID NO: 2917 - DNA, 552 bp, Cucumis melo
  misc_feature (319)..(319): n is a, c, g, or t
accaaaatcaaattttgagatcgattccttccccaattttcagttgaaacaatgtctggacgaggtaagggaggtaagggattgggaaaaggaggagcaaagcgtcacaggaaggttttgagagataacattcagggcattaccaagcctgcaattcgtcgtttggctcgtagaggtggtgtgaagcgtatcagtggattgatctacgaggaaaccagaggggttttgaagattttccttgagaatgtgattcgtgatgctgttacctacacggagcacgctaggaggaagacggtgactgccatggatgtggtttatnctttgaaaagacagggaaggaccttgtatggttttggaggctaggttgtaggttgattttacgaatgattgtatatctgggttttggattttaaggtcattgatgttcatgttctgctagaaaaacttggaagtcatttactgttattgcaatgaaattctagttcgtcatgtacttacttttctcagtttcttcttactttatatatgcatatttactaagcattgatcgtt

SEQ ID NO: 2918 - DNA, 506 bp, Elaeis guineensis
gtccggacgcgggaagggaggcaagggtttgggtaagggcggtgcgaagcgtcaccggaaggtccttcgcgacaacatccagggcattacgaagcccgcgatccggcgcctggcgaggcgtggcggtgtgaagcgcatcagcggtctcatctacgaggagacgagaggcgtgctcaagatcttcctggagaacgtcatccgcgacgccgtcacgtacacggagcacgcccgcaggaagaccgtcaccgccatggacgtcgtctacgccctcaagcgtcagggccgcaccctctacggcttcggcggctagagcttagggtttcgggcatggccttaaggtttcattgcaaattttccgcctcaatgctaaagatactcaaatagatttagttttatatgaataattttgggtgtcatgggatcttttgtttggtaaattgttgccggagaacctatgaatttgattttataatgtcgatatgcgtgcattggtagatggcattata

SEQ ID NO: 2919 - DNA, 469 bp, Allium cepa
  misc_feature (91)..(91): n is a, c, g, or t
  misc_feature (211)..(211): n is a, c, g, or t
  misc_feature (229)..(230): n is a, c, g, or t
gcacatccataatccccaaatcaatatctagggttacagaatgtcaggaagaggaaagggcggaaaaggtctcggtaaaggaggcgccaancgtcaccgtaaggtgcttcgcgacaacattcaaggtatcacgaagcctgccatccgtcgccttgccagacgaggaggcgtgaagaggatcagcggtttgatctacgaagaaaccaggggngttctcaaaattttcctnnagaatgttattcgtgatgcggttacctacactgagcacgccaggaggaagaccgtcactgccatggacgtcgtttatgctttgaagaggcagggaagaaccctctatggattcggaggttaaaaagatcagattttgtgattaaaaatagtctgttggtttgtcttgaattgctttaggaacatcatctgttccaaaaaaaggtcaacgatttggtttttccattttctctactaattg

SEQ ID NO: 2920 - DNA, 312 bp, Ostreococcus lucimarinus
atgtccggtcgcggtaaaggtggtaaaggtctcgggaagggtggcgccaagcgtcaccgaaaggtgttgcgcgacaacatccaaggcatcacgaagccggcgatccgccgtctcgctcgccgtggtggtgtcaagcgcatctccggtctcatctacgaagagacccgaggcgtcctcaaggtgttcctcgagaacgtgatccgcgatgcggtcacgtacaccgagcacgcccgcagaaagaccgtcaccgccatggatgtcgtctacgcgctcaagcgccaaggccgcaccttgtacggtttcggcggctaa

SEQ ID NO: 2921 - DNA, 312 bp, Ostreococcus lucimarinus
atgtccggtcgcggtaaaggtggtaaaggtctcgggaagggtggcgccaagcgtcaccgaaaggtgttgcgcgacaacatccaaggcatcacgaagccggcgatccgccgtctcgctcgccgtggtggtgtcaagcgcatctccggtctcatctacgaagagacccgaggcgtcctcaaggtgttcctcgagaacgtgatccgcgatgcggtcacgtacaccgagcacgcccgcagaaagaccgtcaccgccatggatgtcgtctacgcgctcaagcgccaaggccgcaccttgtacggtttcggcggttaa

SEQ ID NO: 2922 - DNA, 555 bp, Capsicum annuum
ctttatcttcttcaaattcgtctctgtgaaaatgtctggccgcggaaagggaggcaagggattgggaaagggaggagccaagaggcacaggaaggttcttagagacaacatccagggaattaccaagccagctattcgtaggcttgctcgcaggggtggtgtgaagcgtatctctggtttgatctatgaggagacccgtggagttcttaagatctttttggagaatgtgattcgtgattcagttacctacactgagcatgctaggaggaagactgttactgctatggatgttgtttatgccctcaagaggcagggaaggactctctacggatttggtggttagatcagttgttagttagtagatgtagatctgatggaaatttctgctgtttctgtgttttagtttctatttagtgttgttctacttcttatgctctctagatattgtaatttctcattacatattcaatgaacagctgctcaatttctagaaattacaatggttgttctccagctgactattattgttgttaattgattgaaattacatatcct

SEQ ID NO: 2923 - DNA, 499 bp, Capsicum annuum
cgaggctagaatctttttcttcttcaaatttctctgtgtgaaaatgtcaggccgtggaaagggaggcaagggattgggaaagggaggagccaagaggcacaggaaggttctaagagacaacatccagggaattaccaagccagctattcgcaggcttgctcgtaggggtggtgtgaagcgtatctccggtctgatctacgaggagacccgtggagttctcaagatctttttggagaacgtgattcgtgattcagttacctacactgagcatgctaggaggaagactgttactgctatggatgttgtttatgccctcaagaggcagggaaggaccctctatggatttggtggttagatcaattgttaggtagtagatgtacatctgctggaaatttctgttgtttctgtgttcttgtttcgatctacttcttgggttccagatattgtaatttctcattacatattcaatgaacagctgctcagtttttagaaattaaaa

SEQ ID NO: 2924 - DNA, 561 bp, Capsicum annuum
ctgtatcttcttcaaatttctcttcgtgaaaatgtctggccgcggaaagggaggcaagggattgggaaagggaggagccaagaggcacaggaaggttctaagagacaacatccagggaattaccaagccagccatccgtaggcttgctcgtaggggtggtgtgaagcgtatctccggtctgatctatgaggagactcgtggtgtgctcaagatctttttggagaacgtgattcgtgattcggttacctacactgagcatgccaggaggaagaccgttactgctatggatgttgtttatgctcttaagaggcagggaaggactctgtacggatttggtggttaaattgcagaagttgtgaattagatcagttgttaggtggttgatgtagatctgatggaaatttctgtgttttggtttctaaaacgttgttctagctcttaagctttggatggtgaatttctcattgcattttcaatgaacaatgttcagtttctagaaatttctattgttattttccatcttactagtattgttgataattggttgaaatgacttttaaa

SEQ ID NO: 2925 - DNA, 813 bp, Capsicum annuum
ataaatggtgcatatctgtcaccagtttgtggtcctaaagcgcttttttggaagattctacaaagaacaaagcaatcctgcacaactccagccttctccaactcttcgtctgcaagcctgtactcatgcattacccaatttgttctcttgccatcaggagctcgaccactatggaaaacaagtgttttcttcattccaatggcctgagacttatggcgaacataacgatccttcccagtagctttccagtagccttggccagtcgctcggttaagtcgagatccattacagatttcacagtcaaaaatcaaagatgtcaggcagaggcaagggaggtaaaggattgggcaaaggaggagccaagaggcacaggaaagtattgagggacaacatccaaggaatcaccaagccagcaattcgtaggctcgctcgtaggggtggtgtgaagcgtatttctgggttgatttacgaggagactcgtggtgttctgaagatctttttggagaatgtgattcgtgattcagtgacatacacagagcacgctaggagaaagactgttactgctatggatgttgtttatgcactcaagaggcaaggaaggactctttatggatttgggggttaggttttgttgaaattaaggtagaatttgtagatttgatctttcgtttgagctccgatgatgtaattctcaattacatattccatgaaaggaaacttgcttagtcattatttctgattctctttgttaatttactattatcagtctgaaaggaaccagaatatactaattcaatttcctattttattttt

SEQ ID NO: 2926 - DNA, 650 bp, Capsicum annuum
gagaatattcatgattttttatttattttttgtgaaagatgaattagttgtgatactacatgcctttgaatagtgtggaggttgatgcatatatataggaggcaggagcttctttttcttcttcttcaaattcccgtgtttgaaaaatgtctggtcgtggaaagggaggcaagggattgggaaagggaggagcaaagaggcacagaaaggttctgagagacaacatccagggaattaccaagccagctattcgtaggcttgctcgtagaggtggtgtgaagcgtatctctggtctgatctatgaggagactcgtggagttctcaagatctttttggagaatgtgattcgtgattcagttacctacactgagcatgccaggaggaagactgttactgcgatggatgttgtttatgctcttaagaggcagggaaggactctgtacggatttggtggttagatttggggtttttagctctggggaaatgggtggtaggtagtaactgtagcatttagtttatgatgcttttgtggttgcgttggttggttctgtttagtgttcttatggtctagacgcatgtaatatctggttacattatctatgaacaaagttatgtttctagtaaaaaaaactaaaaaaaaaccctcgtgc

SEQ ID NO: 2927 - DNA, 502 bp, Capsicum annuum
ggcacgagatttcaagtcaaatttagcaaaaaatgtctggcagaggaaagggaggcaagggcttaggaaagggaggagcaaagcgtcaccgtaaggtgcttcgtgacaacattcagggaatcaccaagccggcgattaggaggctagcgaggagaggtggagtgaagagaatcagtgggctgatttacgaggagacacggggagtgttgaagatctttttggagaatgtgattcgtgattcagtgacttatactgagcatgctaggagaaagactgttactgctatggatgttgtttatgctctcaagagacaggggcggaccctttatgggtttggcggttaatttgggaatctgatgcacaattgtgtttgttatgtgtgggttttagggaggagtttagtgtatgtggtcttattgaaatttatcttttagtttgttgatgatgtagttggatatgtttcatgaatctatgaaatatcttatttcaagttaaaaaaaaa

SEQ ID NO: 2928 - DNA, 551 bp, Capsicum annuum
atcaaagagcactttcctcaatttcaaattcaaaatctctttgagaaaatgtcgggcagaggcaagggaggcaaaggattgggcaaaggaggagccaaaaggcacaggaaggtacttagggacaacatccaaggaatcacaaagccagcaattcgtagactcgctcgtagaggtggtgtgaagcgtatttctggattaatttatgaagagactcgtggtgttctgaagatctttttggagaatgtgattcgtgattcagtgacatacacagagcatgctaggagaaagactgttactgctatggatgttgtttatgccctcaagaggcaaggaaggactctttatggatttgggggttaggctttgatgaaattaaggtagaatttgtagatttgatgatgtaattctcaattacatattcaatgaaattaaagtgctttgctatttaaatttccatcttttttaaagtttggctcattatcagataggattagctagcaatttaatcattccagatctgaaagtttcgtaacaagaagaaatcctcgtgc

SEQ ID NO: 2929 - DNA, 486 bp, Capsicum annuum
atctttttcttcttcaaatttctgtgtgtgaaaatgtctggtcgtggaaagggaggcaaaggattgggaaagggaggagccaagaggcacaggaaggttctgagagacaacatccagggaattaccaagccagctattcgtaggcttgctcgtaggggtggtgtgaagcgtatctccggtctgatctacgaggaaacccgtggagttctcaagatctttttggagaacgtgattcgtgattcagttacctacactgagcatgccaggaggaagactgttactgctatggatgttgtttatgccctcaagaggcagggaagaactctctatggatttggtggttagagcagttgttaggtagtagatgtagatgtgatggaaatttatgctgtttctgtattttagtttctatgaagcgttgttctactttttaagctttggatattgtaatttctcattgcttattcaatgaacaatgttcagttt

SEQ ID NO: 2930 - DNA, 624 bp, Capsicum annuum
ctgagaaaatgtcagggagaggcaagggaggcaaaggattgggcaaaggaggagccaagaggcacaggaaagtattgagggacaacatccaaggaatcacaaagccagctattcgtcggctcgctcgtagaggtggtgtgaagcgtatttctggattaatatacgaggagactcgtggtgttctgaagatctttttggagaatgtgattcgtgattcagtgacatacacagagcatgctaggagaaagactgttactgctatggatgtggtttatgccctcaagaggcaaggaaggactctttacggatttgggggttaggggttgttgaaattaaggttcttgttggtaatgattgtagagttttatctttggtttgctggttatgttttgagcttgatgatgtaattctctgttacaaattcaaggaatagaagtttgctttgtacttatttctgattctccccgtcatctacattcttttctattgcgttttaaaaattcagctaattatcagttggattatgtgataaatgttactgtaagctgactaatgaatctcgtataagaaggattgagtgaacatgtccgtgtcgctgcataaggatttgtactattgttcaat

SEQ ID NO: 2931 - DNA, 615 bp, Capsicum annuum
ttaaaataatttagaagcttccaatttcagggattgaagatgtccgggcgtggaaagggaggaaaaggattgggaaaagggggagcaaaacgtcaccgtaaggttctccgtgataatattcagggtattactaagccagctattaggcgattggcacgtagaggaggtgttaagcgtataagtggactaatctacgaggagacacgtggtgtgttgaagatatttttggagaatgtgatacgtgattctgttacttatactgagcatgctaggaggaaaactgttactgctatggatgttgtttatgcattgaagaggcaaggaaggactctctatggatttggtggttagaaaaagggactcgaaaagtcttgctgtcaagaaagaaagttatgggcttttattttgtctttcgtttgggttggtgtgttctgttttgttgtaattagtatggttttgggtagggatatagcagtagtgttggttgttttgtaagttgttgaaaattgattttaatgaatactactgaacaatttaagtcctgtcatctttgttcttttgttaaatatttgtttatgttgatttgattgtgcaattgtctttgccaaaaaaaaa

SEQ ID NO: 2932 - DNA, 555 bp, Capsicum annuum
actattgacaaatattcttctccttccaatctaggttgtcgcagtccaagatagagggggtcttctagaagcttctgattgttggtaccgacgtcaagcattacagtcagggagtagaagatgtcaggacgtggaaagggaggaaaaggattggggaagggaggagcaaagcgtcaccgtaaggtcctccgtgataacattcagggtattactaagccagcaataaggcgattggcacgtagaggaggtgtgaagcgtataagtggacttatttatgaggagacacgtggtgtgttgaagatatttttggagaatgtgatacgtgattctgttacttatactgagcatgctaggaggaagactgttactgctatggatgttgtttatgccttgaagagacaaggaaggactctgtatggatttggtggttaaagaatgggaaattagaggctgtgggtttcaatttaggtgtagtgttggcttatgtttggtgtatgtatggcagtgtttagtgaatgaagttgattaattaaatgaaattgcactaccttttga

SEQ ID NO: 2933 - DNA, 598 bp, Petunia hybrida
acgcggggatcgaaaacatctccttcaacaaattcaaaaccctagaaatttcatttttcaattagctagtttgaaaatgtcaggaaggggaaagggaggaaagggattgggaaaaggaggagcaaaacgacaccgtaaggtcctccgcgataacatccagggtattaccaagcctgctattaggcgtctggctcgtaggggtggggtcaagcgtatcagtggattgatctacgaggagacacgtggcgtcctgaaaatatttttggagaacgtgattcgtgatgcagttacttacacagaacacgccaggaggaagacggggactgctatggatgttgtttatgcccttaaaagacaaggcaggaccctatacggattcggtggttaaggaatattttgtattttgacttttgtttgcttttgcaaaagtcttgctgtcaagaaaattattaagtagtggttttatgatgttgtaattaaagtgttttctactagttgttagggtcttttttgtattagcatttctcagatgttatggaatttgatgtgcttatattgaatattaatagacggattctctatttcactgtccgattac

SEQ ID NO: 2934 - DNA, 545 bp, Petunia hybrida
caatttccttcaattcaaaaccctagaaatttcatttttcaatttatttgtttagaaaatgtcgggaaggggaaagggaggtaaaggattgggaaaaggaggagcaaaacgacaccgtaaggtcctccgtgataacatccagggtattaccaagcctgctattaggcgtctggcacgtaggggtagggtcaagcgtatcagtggattgatctacgaggagacacgtggcgtcctcaagatatttttggagaacgtgattcgtgatgctgttacttacacggagcacgccaggaggaagacggtgactgctatggatgttgtttacgctctcaagagacaaggcaggaccctctatggtttcggtggttagggaaatttttgttagtttttaaaaagtgaaatgtaatggaggttaattgtagatttttagatttcatttctgttatgttttttaggtagtgttgtttagagcgtgttgtttgttgggattttggtatattgtaatttctcgttacgtattttggtaatagaaattggtttctaaa

SEQ ID NO: 2935 - DNA, 584 bp, Petunia hybrida
caattcgttttttgcaatttcactactgtttccaaaaatgtcaggacgtggtaagggagggaagggactaggaaaaggaggagcaaaacgacaccgtaaagtgctccgtgataacattcagggaattactaaacctgctatcaggcgtttggcacgtaggggtggtgtgaagagaattagcgggttgatatatgaagaaacaagaggggtattgaagatatttttggaaaatgtgatacgtgatgctgttacttacactgagcacgctaggagaaaaactgtgactgctatggatgttgtttattccttgaagagacaaggccgtaccctttatgggtttggcggttaatttgttatgttttaatctgggttcagtaggttggttaattaagggaaatggaatatagttggtgtttactagctagtttttgtaagtgaagtgtaactatgagatctttgtaactgaattgttggtgttaatgaaatggatctcattagtattttggatataattcttgtgtttgtcttgtatttgaggtctaattattttgctgtttcctacttaagagctcatttctcatttt

SEQ ID NO: 2936 - DNA, 808 bp, Pinus taeda
gagggatttcggcccgaggcttttatcttttcggttaagggcagcggcagttagcgggcaacaatgtcggggcgtggaaagggaggaaagggtttggggaagggaggtgctaagaggcacaggaaagttctcagagataacattcagggcatcaccaagcctgccatcaggcgtctcgcaagaagaggaggcgtcaagcgtatcagtgggctcatctatgaagagaccagaggcgtcttgaagatcttcttggagaatgtgatcagggatgcggtgacatacacagagcacgccaggagaaagactgtgacagccatggacgtcgtctactccttaaaacggcagggccgaactttgtatggctttggaggctgagaagtttcactgcttgctgtcatttatggtgtctctagacaccacctttgtatctatgagaagtcttaagcctggcaggtactgcgaagtgtcgaatgtgttgttttagttgaagcttgttggagtttattcagtgtgtgcttaggggagttgtttttgcactatttttactgatcagtctgaacaaaaaaatccttcgaactgatcagtctgttgtttagattgtgtaattatgataatctggatcgattcaaaactcaataattgtgtaattgaaaatatcacaattgagggactattgtcgaatttatatcaaaatcccgactgaaattatgttgaagatgggatgatttagtgttgtctatagattaactaaactgcatcatttcaaactgtttttgccaagattttataggaacttttaatccggttc

SEQ ID NO: 2937 - DNA, 791 bp, Pinus taeda
  misc_feature (12)..(12): n is a, c, g, or t
  misc_feature (671)..(671): n is a, c, g, or t
  misc_feature (745)..(745): n is a, c, g, or t
cacttttatctnttcggttaagggcagcggcagttagcgggcaacaatgtcgggtcgtggaaagggaggaaagggtttggggaagggaggtgctaagaggcacaggaaagttctcagagataacattcagggcatcaccaagcctgccatcaggcgtctcgcaagaagaggaggcgtcaagcgtatcagtgggctcatctatgaagagaccagaggcgtcttgaagatcttcttggagaatgtgatcagggatgcggtgacatacacagagcacgccaggagaaagactgtgacagccatggacgtcgtctactccttaaaacggcagggccgaactttgtatggctttggaggctgagaagtttcactgcttgctgtcatttatggtgtctctagacaccacctttgtatctatgagaagtcttaagcctggcaggtactgcgaagtgtcgaatgtgttgttttagttgaagcttgttggagtttattcagtgtgtgcttaggggagttgtttttgcactatttttactgatcagtctgaacaaaaaaatccttcgaactgatcagtctgttgtttagattgtgtaattatgataatctggatcgattcaaaactcaataattgtgtaattgaaaatatcacaattgagggactattgtcgaatttatancaaaatcccgactgaaattatgttgaagatgggatgatttagtgttgtctatagattaactaaactgcatcatntcaaactgtttttgccaagattttataggaacttttaatccggttc

SEQ ID NO: 2938 - DNA, 547 bp, Pinus taeda
cggccattatggccggggatcacacaggcgttcttcatattatatttttaatagttgtggttgagaacagggcaggagaaaggaaggatgtctggtcgtggaaagggcggtaagggtttgggaaaggggggtgccaaaaggcacagaaaagtgctgagagataacattcagggaatcaccaaaccagctatcaggcgtcttgctaggagaggaggcgttaagcgcatcagcgggctcatctatgaagagaccagaggcgtcttgaagatcttcttggagaatgttattagagatgcagtaacatacacagaacacgccaggagaaagactgtcactgcaatggatgttgtttactcgctcaagaggcagggccgaaccctctacggtttcggaggctgatcattattttcttgtggctatcaatcgcttactcatttatggtgtctgttgacaccacactctgcctcgttgggagattgtaaacttcttttcttactggaaaatgcttagtgtgaaatatattttcaaattgtttgtgtttgcattc

SEQ ID NO: 2939 - DNA, 545 bp, Pinus taeda
  misc_feature (358)..(358): n is a, c, g, or t
cggccattatggccggggaatcacacaggcgttcttcatattatatttttaatagttgtggttgagaacagggcaggagaaaggaaggatgtctggtcgtggaaagggcggtaagggtttgggaaaggggggtgccaaaaggcacagaaaagtgctgagagataacattcagggaatcaccaaaccagctatcaggcgtcttgctaggagaggaggcgttaagcgcatcagcgggctcatctatgaagagaccagaggcgtcttgaagatcttcttggagaatgttattagagatgcagtaacatacacagaacacgccaggagaaagactgtcactgcaatggatgttgtttactcnctcaagaggcagggccgaaccctctacggtttcggaggctgatcattattttcttgtggctatcaatcgcttactcatttatggtgtctgttgacaccacactctgcctcgttgggagattgtaaacttcttttcttactggaaaatgcttagtgtgaaatatattttcaaattgtttgtgtttgca

SEQ ID NO: 2940 - DNA, 558 bp, Pinus taeda
ttttgtttgaaagtagtgataaatagcgcgaaaagatgtcgggccgtggaaagggagggaagggtttgggaaagggaggtgctaagaggcacaggaaagttctcagagacaatatccagggcatcaccaagcctgccattaggcgtttagccaggagaggaggcgtcaagcgcatcagtggccttatctatgaagagaccagaggcgtcttgaagattttcttggagaatgtcatcagagatgcggtgacatacacagaacacgcgaggagaaagactgtgacagctatggatgtcgtctactccctgaaaagacagggccgaactctttacggctttggaggctgagaagtctcactctgactattattcagtcgtttttactcatttatggtgtctttagacaccaccttatctacaggaaattttaagcctaataggtactgtaagtgtccaatgcattgctttggatgaagcttgtggagatttagtcagcgtgttgataaaaaagttgtcgatgtactaaatatttccaatttgtgttgactgtagtttgctg

SEQ ID NO: 2941 - DNA, 839 bp, Pinus taeda
gggggcggcatacattctatatattctcttcaatgccgtccaactcattatctctgtcaatttccacttactgtttgagctgagaggttgagaaaccggaagaattctgaaacatgtcggggcgtggtaagggaggtaagggtttggggaagggaggtgctaagaggcacaggaaggttctcagagataatattcagggcatcacaaagcctgcaatcaggcgtctcgccaggagaggaggcgtcaagcgcatcagcggtctcatctatgaagagactagaggcgttctgaagattttcttggagaatgtcatcagggatgctgtgacctatacagagcacgccaggaggaagactgtgacagccatggatgttgtctactcgctgaagaggcagggccgaaccctttacggtttcggaggctgagaaatgttgctttggttagatttatttcaatggtgtctcttgacaccaccttctggtctctcagaaatttcaaccccgttgtgattgctggttatttagcgtgttgatacccttgcaaggttgtagaggtttgttttgcctgtaaattgcttgttagctgtatttataagcttttgacttgatcaagggtttcagacaatcttgcaattgatgactggttagctgtatttttaaggttttgacttgatcaagggctggttagctgtatttttaaggttttgacttgatcaagggtttcagaccttgcaattgatgactggttagttgtatttttaaggttttgacttgatcaagggtttcagacaatcttgcaattgatcctaactgttgctgccacaaaaaaaaaaaaaaaaa

SEQ ID NO: 2942 - DNA, 639 bp, Pinus taeda
ttcttctgtttgagctgagagattgagaagccggaagaattctgaaacatgtcggggcgtggtaagggaggtaagggtttggggaagggaggtgctaagaggcacaggaaggttctcagagataatattcagggcatcacaaagcctgcaatcaggcgcctcgccaggagaggaggcgtcaagcgcatcagcggtctcatctatgaggagactagaggcgttctgaagattttcttggagaatgtcatcagggatgctgtgacctatacagagcacgccaggaggaagactgtgacagccatggatgttgtctactcgctgaagaggcagggccgaaccctttacggtttcggaggctgagaaatgttgctttggttagatttatttcaatggtgtctcttgacaccaccttctggtctctcagaaatttcaaccccgttgtgattgctggttatttagcgtgttgatacccttgcaaggttgtagaggtttgttttgcctgtaaattgcttgttaactgtatttataagcttttgacttgatcaagggtttcagacaatcttgcaattgatgactggttagctgtatttttaaggttttgacttgatcaagggtttcagacaatcttgcaattgatga

SEQ ID NO: 2943 - DNA, 576 bp, Pinus taeda
atcgctattcttcattctatcattttggttgaaagcagcagcaggtagcgagaaagatgtctgggcgtggaaagggaggaaagggtttggggaaaggaggtgctaagaggcacaggaaagttctgagagataatatccagggtatcaccaagcctgctatcaggcgtcttgccaggagaggaggcgtaaagcgcatcagcggtctcatctatgaagagaccagaggcgtcttgaagatcttcttggagaacgtgatcagggatgccgtgacatacacagagcacgcgagaagaaagactgtgacagccatggatgttgtgtactccttaaaaagacagggccgaactctttacggctttggaggctgagaagtctcattctgaccactggtcaagacagggccgaactctttacggctttgggggctgagaagtctcattctgaccactggtcattcttaattcactgtcatttatggtgtctctagacaccaccttcgtatccacggagaattttgagcctctcaagtgccgaaggcgtttttttagttgaagctcgtacgaatttattcagtgc

SEQ ID NO: 2944 - DNA, 510 bp, Solanum tuberosum
gctctgaaaaatgtctggccgtggaaagggaggcaagggtttgggaaagggaggagcaaagcgtcatcggaaagttctccgtgataacattcagggaatcactaagccggcgataaggaggttggcgagaagaggtggagtgaagagaatcagtggattgatctatgaagaaacaagaggtgttttgaagatctttttggagaatgtgattcgtgattctgtgacttacactgaacatgctaggagaaagactgttactgctatggatgttgtttatgctttgaagagacaaggaagaactctttacgggtttggtggttaatttactatattttcgcctttttttttcattgttgttgttgggaaatggaagctagctggtgttttggttatagttttatttagatgaagattgtgagatcattgtaattgatgaatttgtgttaaatgaaatagatctcattgatatttggataaaaaacaacaaaaaaacaaaaaaccaacaaaaaa

SEQ ID NO: 2945 - DNA, 607 bp, Solanum tuberosum
atcaggcagaggacgagacagaacgcagaaaaccatcgtcttcatcattgactctcttatcactctttgaaattcagaaagcttcctatttcagataaactcaatgtcgggccgtggaaagggaggaaagggattggggaagggaggagcgaaacgacatcgtaaggttcttcgtgataacattcaaggtatcactaagcctgctattaggcgtttggctcgtagaggaggagtgaagcgtatcagtgggctaatctatgaggagactcgtggagttttgaagatctttttggagaatgtgattcgtgattctgttacctacactgagcatgctaggaggaagacggtcactgctatggatgttgtctatgcactcaagagacaaggaaggactctgtatggttttggaggatgaatgggagtttttgggttctgacttttgtttagtctgcaaaagtcttgctgtcaagaaattattttgctttttgctggggttaatgggttctattctggtgtaattagtatggttcatgtaggagatgtggttgtagcttgtttcaaaacttctgaaaattagcttgaattcaacgaatactatttgcagatt

SEQ ID NO: 2946 - DNA, 562 bp, Solanum tuberosum
gctcttatcactctttgaaattcagaaagcttcctattttagataaactcaatgtcgggccgtggaaagggaggaaaaggattgggaaagggaggagcaaagcgtcaccgtaaggtgctccgtgataacattcaaggtatcactaagcctgctattaggcgtttggctcgtagaggaggagtgaagcgtatcagtgggctaatctatgaggagactcgtggagttttgaagatctttttggagaatgtgattcgtgattctgttacctacactgagcatgctaggaggaagacggtcactgctatggatgttgtctatgcactcaagagacaaggaaggactctgtatggttttggaggatgaatgggagtttttgggttctgacttttgtttagtctgcaaaagtcttgctgtcaagaaattattttgctttttgctggggttaatgggttctattctggtgtaattagtatggttcatgtaggagatgtggttgtagcttgtttcaaaacttctgaaaattagcttgaaatcaatggatactatttgcagattcagtttc

SEQ ID NO: 2947 - DNA, 502 bp, Solanum tuberosum
attcagaaccctagaaacttcttcttcttcaaatttctccgtgaaaatgtctggtcgtggaaagggaggcaagggattgggaaagggaggagccaagaggcacagaaaggtgctaagagacaacatccagggcatcactaagccagctattcgcaggcttgctcgtaggggtggtgtgaagcgtatctctggtctgatctatgaggagacccgtggagtgttgaagatctttttggagaatgtgattcgtgattccgtcacctacactgagcacgccaggaggaagactgttactgctatggatgttgtctatgctttgaagagacagggaaggactctctatggatttggtggttagatcagttgttaggtgcattagatgtagatctactgttaatttctgctgtttctgtgttttggtatctctgtaactgttcgtaagctctagatattgtaatttctcattacatattcaatgaacaaagctcagtttctacaattt

SEQ ID NO: 2948 - DNA, 443 bp, Solanum tuberosum
catttcttctctaaaatttcatcagaaaaatgtcaggcagaggtaaaggaggcaaaggattgggcaaaggaggagccaagaggcacaggaaagtattgagagacaatatccagggaattacaaagccggctattcgaagactcgctcgtagaggtggtgtgaagcgtatttctgggttgatttacgaagagactcgtggggttctgaagatctttttggaaaatgtgattcgtgattctgtgacttacacagagcacgctaggagaaagacggttactgctatggatgttgtttatgcacttaagaggcaaggaaggaccctttacggatttgggggttagggtttggtagtttttttattttttatttgagctttgatggtgtaattctctgttactaattcaaggaatagaaatttgcttattctcttcgtcatctaaaaa

SEQ ID NO: 2949 - DNA, 451 bp, Solanum tuberosum
tgtcgggccgtggtaagggaggtaagggattaggcaaaggaggagctaagaggcacaggaaggtgttaagagataacatccaaggtattaccaagccagctattcgtaggcttgctcgtagaggtggtgtgaagcgtatttctggattgatttatgaggaaactcgtggagtgcttaagatctttcttgaaaatgtgattcgtgatgctgttacatacactgagcatgctaggagaaagactgtgacggctatggatgttgtttatgctcttaagaggcagggaaggaccctttacggatttggaggttagggtgttggttagtggttgtagatttgggtttttagtgaagttgggttactttttttgtttgtttgtatgatctcgatattgtaattccttgttacacaaacaattaatggaaggggatcgtatttcgagtaaaaaaaaag

SEQ ID NO: 2950 - DNA, 562 bp, Solanum tuberosum
gaaacttcttcttcatcaaatttctctgtgaaaatgtctggtcgtggaaagggaggcaagggattgggaaagggaggagccaagaggcacaggaaggttctaagagataacatccaaggtatcactaagccagctattcgcaggcttgctcgtaggggtggtgtgaagcgtatctctggtctcatctatgaggagactcgtggagtgttgaagatctttttggagaatgtgattcgtgattctgtcacctacactgagcacgccaggaggaagactgttactgctatggatgttgtctatgctttgaagagacagggaaggactctctatggatttggcggttagattgggggttgtatgttggtgctatggtggtagtaaatgtaggttttagtttacaattgcgtataagtctgtgttggatctctgtagtgttgttagtgttgttcttatgctctagatcttgtaatttctcattacattatcaatgaacagagttaggtttttgtgtacattgatcatcttcctgctgttgatttatttttattaatttgttgctctt

SEQ ID NO: 2951 - DNA, 414 bp, Solanum tuberosum
ttcttctctaaaatttattcagaaaaatgtcaggcagaggtaaaggaggcaaaggattgggcaaaggaggagccaagaggcacagaaaagtgttgagagacaatatccagggaattacaaagccagctattcgaagactcgctcgtagaggtggtgtgaagcgtatttctgggttgatttacgaagagactcgtggggttttgaagatctttttggaaaatgtgattcgtgattctgtaacttacacagaacacgctaggagaaagacggttactgctatggatgttgtttatgcacttaagaggcaaggaaggaccctttacggatttgggggttagggtttgttggtttttttttatttgtgctttgatggtgtaattctctgttacatattcatggaatagaaatatgctt

SEQ ID NO: 2952 - DNA, 561 bp, Solanum tuberosum
aaaacttctcaaaaaatgtctggccgtggaaagggtggcaagggattaggcaagggtggagcaaaacgtcatcgcaaggtgcttcgtgacaacatccagggaatcaccaagcctgctattaggaggttggcgagaagaggtggagtcaagagaatcagtgggttgatttatgaagagacaagaggtgttcttaagatctttttggaaaatgtgattcgtgattctgttacctacacagagcatgctaggaggaagactgttactgctatggatgttgtttatgctttgaagagacaaggaaggactctctatggtttcggtggttaagaccttagatctgggttattgggtattagtagtattttagttttgttgatgtaattggttatgtttctgaatctatgaaatatcttgtttctgtgtttcgaatttggtcgttttatggctatgaatgtgaagaatggttttatttaatggaaaatatatcttatttctgtgtttcaattgcttcaaaattggttcttttcatctcttgataatgagaaactgtctaattagttg

SEQ ID NO: 2953 - DNA, 502 bp, Raphanus sativus
gggacacatctaaaacacacacaaagcgaatctcaattttaaaaaactttccgagaaaaaaatgtctgggcgaggaaagggaggaaagggtttgggaaagggaggagccaagaggcacaggaaggttctccgcgacaacatccaggggatcacgaagccggcgattcgccgtttagctagaagaggtggcgtcaagcgtatcagcggcttgatctgcgaggagactcgcggtgttctcaagatctttctcgagaatgtgatccgtgacgctgttacttacaccgagcacgctcgtaggaagacggtgacggcgatggatgttgtctacgcgttgaagaggcagggacggactttgtatggattcggcggttgatgagggggtgagattggcgtttgtaaatcgcgtttggtcttttagtgtttgtttgatttctattaagctgcttttagggtttcgttttagaatgttttaccggtttgaatttaatgaaacgcttctttt

SEQ ID NO: 2954 - DNA, 762 bp, Raphanus sativus
ggatcgtcaatcgcattttgctatcctcaccgatctattattcagggtatcgtcttcttcttctctgcaactactcgattcgttttgcagatttcatattaaatcgtgtttgagtatatatttcgcttcagataaataaggaagttttgatttcgattgtgaatttgattagatttgggaatctagggtttcgtttttcaattactgaaagctgctttggttttgattctacagagcttcggaatctagttggggagagagatgtcgggaagaggaaaaggaggaaagggattgggaaagggaggagcgaagaggcacaggaaggtacttagggataacatccaaggtatcaccaagcctgccattcgtcgtcttgctcgcagaggtggtgtcaagcgtattagcggcctcatctacgaagagaccagaggagccctcaagatctttctcgagaatgtcatccgcgacgccgtcacctacacggagcacgctaggaggaagactgttacggctatggacgtggtctatgccttgaagagacaaggacgcactctctacggattcggcggttaatcaacagattgagattttagtaggagacggaattagtgtgttgtttctgttatcatccacttgtttagtagtaaaaagtagaacgaaggagtttgtgttttgagctgtgtcttgttaggccaatttggtgttccatgtagctaagattcagcaatctctgcttggattcttaaatgaaaattctgtttg

SEQ ID NO: 2955 - DNA, 1942 bp, Raphanus sativus
  misc_feature (571)..(571): n is a, c, g, or t
ggataaacgccgtcatttagtaaagagacctccaaatttatcctcttccaattttcacagacaaattaaaaatcatcaatagatccggagattgttggtcgtcacactgtctttttcgagaagattcgatggctacgttcgtaaactccccgacggcgctcgttgactgggacagccaccggtacgatgttcttcacctcctctcttcccttccacatccgcatataaagcgccgctgtttgacgactccgacttggaatcggatctcgatcaagagcgttgagttgatttattggcggatctccatatctttcgcatgatggagaggaaagagaggaatctcccatttatttatagggaaccaacactgcctctcagatctaagcgaccctttcaagacccgtggagagtgaatcaataaaattaaacacgaaacatttgcttgaaccgtttcggatggtgagaagaagctcaaacggcatcggtcgccatcgcaggaagagagacttgtttgcatccgtattagggttaggatatctattcgattgggccaaacacatattcaaaattntcagcccaaatccacaaaacgtgaatgaagtccatcaagcatagaataaaacgaccctttttacctgacaagtgtcgacttctggagacttgagtttgtgacatggcgtctgacgtgtcaacaggaacaggagagaaacaactcttctttatataataagatagacttttaaactaacgtatggcccatgagaaactcgactcttgtcagtacgatgatgatgatgtgtaatgacagaaacgaaaagaaagaagataagtcctaatccaaaactcgtggtcgtgatttcgtttttattacatccttgtaaaaaatgtattgctttatttttattttttttaaattaaggagacgagaagcagcgtaccgatcgttattttcatgtctcagtagatggattctgctttgtctccccgcatctttttcgcacacagcttcgttagttcaagcaggtcgcctaggtttgcagctagtactagtacttgctggagattggttaacggttcatcttgggagacaaaggctattgggaatagtgatggcaatgatagtcctctcaaaggaacagatgatgggtctttctttgatcatgttgacgcggagatcacgccagaaactgttgatttcttcgtgagtgacgcagaaggtgatcctgattgtcctactcagggctactcctctatcgaactcgctcttcaatctctaccccaaggcaagtttgtgatcgttgttgacgatgaacacggggatgttgaagggaacctgatcatgtcggcaactctaactagtccaaaagacatagcctttctgatcaagaatggttccgggattgtctcggttgggatgaagaaagaagacctcgaaagattaaaccttacactcatgtcacctgaaatggaagacgaagattcctctgcaccaaacatatcactcttctctaatcgaagttcgtatcttaaactttcccgagaaaaaaaagatgtcagggagaggaaagggaggaaaaggattaggaaagggaggagccaagaggcatcggaaagttctccgagacaacatccaaggaatcacgaaaccagcgatccgtcgtctcgcgaggagaggaggtgtgaagcgtatcagcggattgatctacgaagggactcgcggcgtcctcaagatctttctagagaacgttatccgcgacgccgttacatacacagagcacgctcgccggaaaacagtcacggccatggacgttgtgtacgctctcaagaggcagggaagaactctctacggattcggcggctgattcgattgtttctgtttcacgattttgtaaaatgtttttatcagaatcaatgggaataataatatggcatctttttttcc

SEQ ID NO: 2956 - DNA, 493 bp, Raphanus sativus
  misc_feature (407)..(407): n is a, c, g, or t
gggcaatcacaaaaaaaaaagagagacataactgagaaaaatttagaagaaaatgtcgggtcgtggaaagggaggcaagggtttggggaaaggaggagcgaagcgacacaggaaggtcctgagagacaacatccagggaatcaccaagcctgcgatacgccgtttggctcgcagaggaggcgtgaagcgtatcagcggtctgatctacgaggagacacgtggagtgctcaagatctttatggagaacgtcatccgcgacgccgtcacatacaccgagcacgcgcgtaggaagacggtgaccgctatggatgtggtgtatgctctcaagaggcaaggcaggactctctatggattcggcggctagggttttacaatttgctttttttttttggtttttaatcaatttntcagatgtgatttttcttttagtaaagtaagtttcggtttgctttttgtattatcgaagaaatatatgaaattcaacatttgaaca

SEQ ID NO: 2957 - DNA, 714 bp, Raphanus sativus
ggagaatagtactcatgaggaagaggaggatgaagaagataagaacaagcaaggagaggaagtagttgaagaggatgaggaagaaaacaaacatgaagaagaagaagatgttattgatgaacaagatcaaagcaaagatgatgaattgcttcaagaagagaaggagaatggatcgaatgagagacaaactgaatctaatcctcagttatattctttgattccaagacagagtttccaagaaaaatgtcagagagaggaaagggaggaaagggattgggaaaaggaggagcgaagagacacaggaaagttctcagagacaacatccaaggaatcaccaagcctgcgatcaggcgtcttgctcgcagaggaggcgtgaagcgaatcagcggtttgatctacgaagaaacgagaggagttttgaagatctttctcgagaatgtgatcagggacgccgtgacttacactgagcacgcgaggaggaagacggtgacggcgatggatgtggtttatgctttgaagagacaaggacgtactctttacggattcggtggttgaatcgtttttttctattgtatttttctgggttgtgttgttggtactgattaagtcttgcggtcaagaaatctaggataatctaggattaagtcttgcggtcaagaaatctactgattagtcagatctttttatttcgctaatacaattcaagtttttata

SEQ ID NO: 2958 - DNA, 474 bp, Secale cereale
tccggccgtggcaagggagggaaggggctgggcaagggcggcgccaagcgccaccggaaggtgctgcgcgacaacatccagggcatcaccaagccggccatccggcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggcggataggccgcgtcggtccgggcgaggaggatccagctcgcaccaccggattgttactgtactagctagccatggttgttcagtgttcattgtgttcagtgtaacggccgcatctcgctgctgtttgttgtttagatgtagtactactatcatggaatggaaatatcagca

SEQ ID NO: 2959 - DNA, 385 bp, Secale cereale
tccggccgcggcaagggcgggaaggggctgggcaagggcggcgccaagcgccaccggaaggtgctccgcgacaacatccagggcatcaccaagccggcgatccgccgtctggctcgccgtggcggcgtgaagcgcatctcggggctcatctacgaggagacccgcggcgtgctcaagatcttcctggagaacgtcatccgcgacgccgtcacctacacggagcacgcccgccgcaagaccgtcaccgccatggacgtcgtctacgccctcaagcgccagggacgcaccctctacggattcggcggctaggccgcgtcggatccacctcgcgccgccagattcgtactagctagccatggttgttcagtgttcgttgtgttcagtg

SEQ ID NO: 2960 - DNA, 459 bp, Secale cereale
tcggggcgcggcaagggaggcaaggggctcggcaagggcggcgccaagcgccaccggaaggtcctccgcgacaacatccagggcatcacgaagccggcgatccgtcgtctggcgcggcggggcggcgtgaagcggatctcggggctcatctacgaggagacccgcggcgtgctcaagatcttcctcgagaacgtcatccgcgacgccgtcacctacaccgagcacgcccgccgcaagaccgtcactgccatggacgtcgtctacgccctcaagcgccagggacgcaccctctacggattcggaggctaggctccggcgtggcgaatccagctcgcatcacttgatcagatattcagattagtagtatttaggtgttgttcagtgttcatggtgatcgatgtaatttatgatgtatgctgcttgttcgctggaatggatcaaatcgcagttatgtactcg

SEQ ID NO: 2961 - DNA, 444 bp, Secale cereale
cggcgatgtcggggcgcggcaagggcggcaaggggctgggcaagggcggcgccaagcgccaccggaaggtcctccgcgacaacatccagggcatcaccaagccggcgatccggaggctggcgaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctagattcctgggttctgcgggtagcagcagcggtagttgcgactgtgcctgtcgcgtgtcctctgtgatctgtgctgtgggagatgggatttactactgctttggcgtgcgtcgttgtgttgtgttcagt

SEQ ID NO: 2962 - DNA, 637 bp, Picea glauca
ttaattaaattaatcccccccccccccgcaattgtcattattcattttcattgtctgagggcaggacaataatcgtcagcaaggatgtctggacgtggaaagggaggcaagggtttggggaagggaggagccaagaggcacaggaaagttctcagagataacattcagggcattaccaaacctgccatccggcgtcttgcaagaagaggaggcgtcaagcgtatcagtgggctcatctatgaagagacgagaggcgtcttgaagattttcttggagaatgttatcagagatgcggtgacgtacacagaacacgcgaggagaaagaccgtgacagccatggatgtcgtatactcattgaagaggcagggccgaaccctctacggcttcggaggctgagaggtctgctttcgactgttaaatctctttggggttgaaaagtctgcttttgactgttgatattttgggttattctcttttgggctgtatatagaattgacagcattgttagcagcagtgatgttttgagccgctgttactgataatgcttctgattcaggatctgtaaattttagtccatagatgaaagtttgttttggtttttcaagattagtaatatgatatttagtgattcacaact

SEQ ID NO: 2963 - DNA, 754 bp, Picea glauca
  misc_feature (323)..(323): n is a, c, g, or t
  misc_feature (344)..(344): n is a, c, g, or t
  misc_feature (735)..(735): n is a, c, g, or t
aattaatcccccccccccccgcaattgtcattattcattttcattgtctgagggcaggacaataatcgtcagcaaggatgtctggacgtggaaagggagggaagggtttggggaagggaggagccaagaggcacaggaaagttctcagagataacattcagggcattaccaaacctgccatccggcgtcttgcaagaagaggaggcgtcaagcgtatcagtgggctcatctatgaagagacgagaggcgtcttgaagattttcttggagaatgttatcagagatgcggtgacgtacacagaacacgcgaggagaaagaccgtnacagccatggatgttgtatantcattgaaaaggcagggccgaaccctctacggcttcggaggctgagaggtctgctttcgactgttaaatctctttggggctgaaaagtctgcttttgactgttgatattttgggttattatcttttaggctgtatatagaattggcagcattgttagcagcagtgacgttttgagccgctgttactgagaatgcttctgattcaggatctgtaaattttagtccatagatgaaagcttgttttggtttttcaagattagtaatatgatatttagtgattcacaactgatagtctcttgttgattgaattaaagactagcacagctgctaactcaaggctgagaatgtcgaaaggtattggtgagaatgtgtgactcgaatgagtgttcccnatataaaatgtttgtggta

SEQ ID NO: 2964 - DNA, 589 bp, Picea glauca
ttaattaaattaatccccccccccccccgataccatcgtctgtaattcttcatcttcattgttcgagcagcagtggaatttactgttgcgaggaaagatgtctggccgtggaaagggagggaagggtttaggaaaaggaggtgccaagaggcacaggaaggtgctcagagataacattcagggtatcacgaagcccgccatcagacgtctcgccaggagaggaggtgtcaagcgtatcagtgggcttatctatgaggagacaagaggcgttctcaagatcttcttggagaatgtgattagagatgccgttacatacacagagcacgcgaggagaaagaccgtgacagccatggatgttgtctactccctaaagaggcagggccgaaccctctacggcttcggaggctgataaattttactcgagtattacttattcctcctgtcgctaatcatttatttactaatggtgtctgttgacaccacccttctctatttgggaatggtagccttaacagttccctctatatattgaacatattgtgagtatccatttttagtgtgataatgtgattgtcaggaattgttttga

SEQ ID NO: 2965 - DNA, 621 bp, Picea glauca
aaattaatcccccccccccccgatcataattactcattttcattgcttgagagtaacagagaaacgtagcaagtagaaggatgtctggacgtggaaagggagggaagggtttgggaaagggaggtgccaagaggcacaggaaggttctcagagataacattcagggcattactaagccagccattaggcgtctcgccaggagaggaggcgttaagcgtatcagcgggctcatctacgaagagaccagaggtgtcctcaagatcttcttggagaatgtcatcagagatgccgtgacgtacacagagcatgccaggagaaagacagtgacagccatggatgtcgtctactccctgaaaaggcagggccgaaccctctacggcttcggaggttgagaagtcttagtctgactgctactcatttctcctattgttcatcccacatttattcatggtgtctgttgacaccacccttctcaatatgggaaatgttaaccttgataattccctgttaccatatgtaattaaggagattcgttacagagtgcactttctgtacatccacacacagtaaagtttgagtgctttgatttgggtatgattaagaaatgtttattatgaaata

SEQ ID NO: 2966 - DNA, 601 bp, Picea glauca
caattgtcattattcattttcattttctgagggcaggacaataatcgtcagcaaggatgtctggacgtggaaagggaggcaagggtttggggaagggaggagccaagaggcacaggaaagttctcagagataacattcagggcattacgaaacctgccatccggcgtcttgcaagaagaggaggcgtcaagcgtatcagtgggctcatctatgaagagacgagaggcgtcttgaagattttcttggagaatgttatcagagatgcggtgacgtacacagagcacgccaggagaaagaccgtgacagccatggatgtcgtctactcattgaagaggcagggccgaaccctctacggattcggaggctgagaagtctccgtctgactgttaatcatatttcttgttgctcatcatggtgcgttgacatcagtctcctctacttgggccaattattcccgagtactgtgttttgggcttatatagaattgtcgacattgttagtaatggcgatattttcatctgctgtaactgaaaatgtttcaaagtcaggatctggaaattttggtcaataaatgaaagttctctttcgtccttcaaaatta

SEQ ID NO: 2967 - DNA, 525 bp, Euphorbia esula
catctctccatctactaaattgaatccagagaaaaagagtctaaaaaatgtcaggaagaggaaagggaggaaaaggtctgggaaagggaggagccaagaggcacaggaaagtgctgagagataacattcaaggtattactaagcctgccattcgtcgtcttgcccggagaggaggcgtgaagcgtttcagtggtctgatttatgaggagactagaggtgttcttaagatctttcttgagaatgtgattcgtgatgctgttacttacactgagcatgctagaaggaagactgttaccgccatggatgttgtttatgctctcaagaggcaaggtcgcactctctatggctttggcggttgattgtaactgtcaattggttatggttacttgtttttttcgtttaatttgaatgaaattagattaggtttcagtttctgtattgttgaagaagggatgatttgaatcattcggctgtaaatgaagttacagatctgattatgaaattgaattttgcaaagtttagatc

SEQ ID NO: 2968 - DNA, 596 bp, Saccharum officinarum
  misc_feature (57)..(57): n is a, c, g, or t
  misc_feature (60)..(60): n is a, c, g, or t
  misc_feature (374)..(374): n is a, c, g, or t
  misc_feature (411)..(411): n is a, c, g, or t
  misc_feature (454)..(454): n is a, c, g, or t
  misc_feature (499)..(499): n is a, c, g, or t
  misc_feature (501)..(501): n is a, c, g, or t
  misc_feature (505)..(505): n is a, c, g, or t
  misc_feature (517)..(517): n is a, c, g, or t
  misc_feature (525)..(525): n is a, c, g, or t
  misc_feature (534)..(534): n is a, c, g, or t
  misc_feature (540)..(540): n is a, c, g, or t
  misc_feature (542)..(542): n is a, c, g, or t
  misc_feature (544)..(544): n is a, c, g, or t
  misc_feature (560)..(561): n is a, c, g, or t
  misc_feature (568)..(568): n is a, c, g, or t
  misc_feature (572)..(572): n is a, c, g, or t
  misc_feature (575)..(575): n is a, c, g, or t
gcgaattcgaatcccacaattttgtagcacacaccaccgtcactcgagtcttctttnctnttcggcggcgatgtctgggcgcggcaagggcggcaaggggctgggcaagggcggcgcgaagcgccaccgcaaggtcctccgcgacaacatccaggggatcacgaagccggcgatccggaggctggcgaggaggggcggcgtgaagcgcatctccgggctcatctatgaggagacccgcggcgttctcaagatcttcctcgagaacgtcatccgcgacgccgtcacctacaccgagcacgcgcgccgcaagaccgtcaccgccatggacgtcgtctacgcgctcaagcgccagggccgcaccctctacgggttcngcggctgagcgcgtgcgcgtctcctccgtcctctgcngctgctgctcgttccgccttacgtactcctttcggatccctgntccgtgctttccttgatgtagacagttatcggattcttaggtctntnccgngtctcgtattangtggaatnatgtgtccntagtancncngaaagttcaacacccnnttggatnttcnttngcaacaatgaaatgttaaagt

SEQ ID NO: 2969 - DNA, 560 bp, Saccharum officinarum
cgcggcgaattcgaatcccacaatttttgtagcacacaccaccgggactcgagtcttctttcctcttcggcggcgatgtctgggcgcggcaagggcggcaaggggctgggcaagggcggcgcgaagcgccaccgcaaggtcctccgcgacaacatccaggggatcacgaagccggcgatccggaggctggcgaggaggggcggcgtgaagcgcatctccgggctcatctacgaggagacccgcggcgttctcaagatcttcctcgagaacgtcatccgcgacgccgtcacctacaccgagcacgcgcgccgcaagaccgtcaccgccatggacgtcgtctacgcgctcaagcgccagggccgaaccttttacgggttcggcggttgaccgcgtgcgcgtttcctccgtcctttgcagccgttgttcgttccgccttacgtactcctttcggatccctgttccgtgctttccttgatgtagacagttatcggattctaaggtctctgccgtgtctcgttattaggtggaatcatgtgtccttagtagcactgaaagttcaa

SEQ ID NO: 2970 - DNA, 464 bp, Saccharum officinarum
  misc_feature (313)..(313): n is a, c, g, or t
  misc_feature (404)..(404): n is a, c, g, or t
  misc_feature (424)..(424): n is a, c, g, or t
  misc_feature (442)..(442): n is a, c, g, or t
agcgcagatacaaccttccacctactacttgcaaacaggggaggcgaccggcggcggagatgtcgggcagaggcaagggcggcaaggggctcgggaagggcggcgcgaagcgtcaccggaaggtgctgcgcgacaacatccagggcataacgaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgcctnggacgtcgtctacgccctcaagcgccagggccgcaccctctacggcttcggcggctaggttaggtcagggttagttgcctgtcgaggcgtntcgatccggtgttactagtnttgggttaccttcctggnttcgtctgggtagttgctgtaa

SEQ ID NO: 2971 - DNA, 515 bp, Saccharum officinarum
tccgtcagagaagagggcccgtgcgaggcggcggcggcggcggcggcgatgtcggggcgcggcaagggaggcaagggtctgggcaagggcggcgcgaagcggcaccggaaggtgctccgcgacaacatccagggcatcaccaagccggcgatccggaggctggcgcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcatcgccatggacgtcgtctacgcgctcaagcgccagggccgcaccctctacggcttcggaggctaggcgcctcttcgtagctggggaacggttgggggatatttctctctgtcgctgtggggcgtaatggtgctgaattgctgcgctccgggaatgaatcctacaatatgttcctgccatgaagaaatgcgagtaatggtgctctggcactaagaatcatg

SEQ ID NO: 2972 - DNA, 512 bp, Helianthus annuus
  misc_feature (512)..(512): n is a, c, g, or t
ggaaacaatttctttccagaaaccaaaaatccagttagcttctgttgaatcgaaaccctaatctaacaatgtctggacgtggaaagggaggaaaggggctgggaaagggcggagcaaagcgtcaccggaaagttctccgggataacattcagggaatcactaagccggcgatcaggaggctggctagaagaggtggagtgaagaggatcagcggtctgatatatgaagagacacgtggagttttgaagatatttttggagaatgtgattcgtgacgcggttacgtatacggagcatgcggggaggaagacggtgacggcgatggatgtggtttatgcgttgaagaggcagggaagaactttgtatggctttggtggttgaatagttgattgatactagcatcgttgttaggttagataattgtatgaattgttgtcttatcttggaacaatttggttttcaattgtttgaaatattgtgatagtggatgtgcaagtattttgaatcaaaaan

SEQ ID NO: 2973 - DNA, 529 bp, Tamarix hispida
  misc_feature (15)..(15): n is a, c, g, or t
  misc_feature (35)..(35): n is a, c, g, or t
  misc_feature (49)..(49): n is a, c, g, or t
  misc_feature (53)..(53): n is a, c, g, or t
  misc_feature (64)..(64): n is a, c, g, or t
  misc_feature (87)..(87): n is a, c, g, or t
  misc_feature (89)..(89): n is a, c, g, or t
  misc_feature (93)..(93): n is a, c, g, or t
  misc_feature (136)..(136): n is a, c, g, or t
  misc_feature (385)..(385): n is a, c, g, or t
  misc_feature (393)..(393): n is a, c, g, or t
  misc_feature (406)..(406): n is a, c, g, or t
  misc_feature (418)..(418): n is a, c, g, or t
  misc_feature (420)..(420): n is a, c, g, or t
  misc_feature (437)..(437): n is a, c, g, or t
  misc_feature (454)..(455): n is a, c, g, or t
  misc_feature (457)..(457): n is a, c, g, or t
  misc_feature (490)..(490): n is a, c, g, or t
  misc_feature (494)..(494): n is a, c, g, or t
  misc_feature (501)..(501): n is a, c, g, or t
gggggatcatcgatnacacttgctattcttcgctnggaaatcacaaacntctngagctcctctntcaggtcaaatttcgaggtcaantnacanctaaacaatgtctgggcgtggaaagggagggaagggattaggnaagggaggagcaaagcgccatcgtaaggtccttcgtgataacatccaaggcattaccaagccagccattaggcgtctggctaggagaggtggcgtgaagcgtatcagtggtctcatctacgaggaaactcgtggtgttttgaagatctttcttgaaaatgtcattagagatgctgttacctacactgagcatgctcgccgcaagactgttactgctatggacgttgtgtatgctcttaagagacagggnaggacctngtatggattcggnggttaagacttngntgtctatagtcttgctntcagggagggtttctcnncntgagggggtttctatgtaggttcttcgcttttncttntgctgtngcggtaaaatcaccaatggtttgacatt

SEQ ID NO: 2974 - DNA, 641 bp, Nicotiana tabacum
tctctcactatctttcagattcagaaactttcaatttcagagaaactaaaggttgattgaaaatgtcgggacgtggaaagggaggaaaaggattaggaaagggaggagcaaaacgacatcgtgaagtcctccgtgataacatccaaggtatcacaaagccagcaattaggcgtttggctcgtagaggaggagtgaagcgtatcagtggtctcatctatgaggagacacgtggcgtgctcaagatctttttggagaacgtcattcgtgatgctgttacttacactgagcacgcaaggagaaagaccgtgactgctatggatgtcgtgtatgctcttaagagacagggaagaactttgtatggatttggaggttaattggaagctttggtttttgacttttgttttgtctgcaaaagtcttgctgtcaagaaaagaactagaatgattactatatggtatatggtgtttgttttgcttttgattaggggtctgttttggtgtaattagtatggttacctactggtgatagggttcttttgcactagtattgctcgcctttgtaagctgaatttggtagatgcttgtttcagtacttctgaaatttgctctatttcaatgaatatgattgactggttcaggttc

SEQ ID NO: 2975 - DNA, 499 bp, Nicotiana tabacum
  misc_feature (50)..(50): n is a, c, g, or t
  misc_feature (492)..(492): n is a, c, g, or t
tctcaaatcaaaatccatattcttctcagttcagttcaattcaattactntaacaaaaaatgtcaggccgtggaaagggaggcaagggtttgggaaagggaggagcaaaacgacaccgtaaagtactccgagataacattcaaggaataacaaagccagccattcggaggttggcgagaagaggtggagtgaagagaatcagcgggctgatttatgaagaaacaagaggagttttgaagatatttttggagaatgtgattcgtgatgctgtcacttacactgagcatgctagaagaaagactgttactgcaatggatgttgtttattcactgaagagacaaggcaggaccctttatggttttggtggttgatttgtgtatttttatttgttttaaatggagtttagttggtgtttaattttaatatttgagaatgaaggttatgaggtcattgtaattgggttctttgaattaacgaaatggatctcattantatttcg

SEQ ID NO: 2976 - DNA, 579 bp, Solanum lycopersicum
ccaccatcaatctcatagcatcatcatcaattacgtccacattcaaaaccctagaaacttcatcttctacaaatttctctgtgaaaatgtctggccgtggaaagggaggcaagggattgggaaagggaggagccaagaggcacaggaaggttctaagagacaatatccagggtatcactaagccagctattcgcaggcttgctcgtaggggtggtgtgaagcgtatctccggtctgatctatgaggagacccgtggagtattgaagatctttttggagaatgtgattcgtgactctgtcacctacactgagcacgccaggaggaagactgtcactgcgatggatgttgtctatgccctcaagagacagggaaggactctctatggatttggtggctagattgtggagtttggtggttgtaatggtagtaactctaggttttaatttacatagcttttgtgactgctgtgaattttaattctctgtagccttgttttggatcttgttcgtaagctctatattttgttaatattcaaggaatcaagttcacctttccagaaattacatcgtgtatttgcag

SEQ ID NO: 2977 - DNA, 521 bp, Solanum lycopersicum
atcaaatttcataaccctagaatcatcacctttttcaaatttctatgtgaaaaatgtctggtcgtggaaagggaggcaagggattgggaaaggggggagccaagaggcataggaaggttctaagagacaatatacagggtatcactaagccagctattcgcaggcttgctcgtaggggtggtgtgaagcgtatctctggtctcatctatgaggagacccgtggtgtgttgaagatctttttggagaatgtgattcgtgactctgtcacctacactgagcacgccaggaggaagactgtaactgctatggatgtcgtctatgctcttaagagacagggaaggactctctatggatttggcggttaaattgggggtttatgttggtgatatggtggtaaatgtagggatttagtttacaattgcgtatgtctgtgttggatatctgtagtgctgttcttatgccttagatcttgtaatttctcattacagtatcaatgaatagatttcagtttctagtgatga

SEQ ID NO: 2978 - DNA, 587 bp, Solanum lycopersicum
  misc_feature (520)..(520): n is a, c, g, or t
  misc_feature (531)..(531): n is a, c, g, or t
aaccctagaatcatcacctttttcaaatttctatgtgaaaaatgtctggtcgtggaaagggaggcaagggattgggaaaggggggagccaagaggcataggaaggttctaagagacaatatacagggtatcactaagccagctattcgcaggcttgctcgtaggggtggtgtgaagcgtatctctggtctcatctatgaggagacccgtggtgtgttgaagatctttttggagaatgtgattcgtgactctgtcacctacactgagcacgccaggaggaagactgtaactgctatggatgtcgtctatgctcttaagagacagggaaggactctctatggatttggcggttaaattgggggtttatgttggtgatatggtggtaaatgtagggatttagtttacaattgcgtatgtctgtgttggatatctgtagtgctgttcttatggcttagatcttgtaatttctcattacagtatcaatgaatagatatcagtttctagtgatgacattggttcgncttttagctgntgattaatttttcttaattgattcatcctattgcaattcttctgaatttaaaatgt

SEQ ID NO: 2979 - DNA, 945 bp, Solanum lycopersicum
ccaaattaagaaattatggaggaaggcaacaactcattcaaatattcagataagaaaaagaagtcagatcttgcaaaacttcaaaaggaacatgatgagaaaatggcagcaataaaagagctcaagaaaaagagagaagaaatgaagcttcaattgtcaaagaataacatttctgaggaaaagaaagagactttcagaaaattgactgaaaaatatcaaaaaatgaatgatgaatataattcccttttaggttagatattaaagggaaaagagtagtatcttactaataaaaattattttctatcgttccataatgtatcgttttatattatactagttattatgttatatattgtatcatgcatgttcatgaatcaacaacaatataccttgtggtgttgtaagaataacacttcaagcttccaatttcagatacactcaaggttgattgaaaatgtcgggtcgtggaaagggaggaaaaggattgggaaagggaggagcaaagcgtcaccgtaaggtgctccgtgataacatccagggtattactaagcctgctattcggcgtttggctcgtagaggaggagtgaagcgtattagtgggctgatctatgaggagactcgtggtgttttgaagatctttttggagaatgtgattcgtgactctgttacttacactgagcatgctaggaggaagacagtgactgctatggatgttgtgtatgcactcaagagacaaggaaggactttgtatggttttggaggttgaatgtgacttttgtttagtctgcaaaagtcttgctgtcaagaaattgttgttttggttttttgctggtgttaatgggttctaatctggtgtaattagtatggttcatgcaggggatgtggttgtagcttgtttaattttgcattaatacaattcacagattcagtttcacatcttcttat

SEQ ID NO: 2980 - DNA, 441 bp, Solanum lycopersicum
aatcatcacaaatccaaattaaaagcatttcttctctaaaatttcttcagaaaaatgtcaggcagaggtaaaggaggcaaaggattgggcaaaggaggagccaagaggcacaggaaagtgttgagagacaatattcaaggaattacaaagccagctattcgaagactcgctcgtagaggtggtgtgaagcgtatatctgggttgatttacgaagaaactcgtggggttttgaagatctttttggaaaatgtgattcgtgattccgttacttacacagagcacgctaggagaaagacggttactgctatggatgttgtttatgcacttaagagacaaggaaggaccctttacggatttgggggttaagttttttttttttgagctttaatggtgtaattctctgttacatatcatggaatagaaatctgatttagttattaa

SEQ ID NO: 2981 - DNA, 472 bp, Solanum lycopersicum
catttcttctctaaaatttcttcagaaaaatgtcaggcagaggtaagggaggcaaaggattgggcaaaggaggagccaagaggcacaggaaagtgttgagagacaatattcaaggaattacaaagccagctattcgaagactcgctcgtagaggtggtgtgaagcgtatatctgggttgatttacgaagaaactcgtggggttttgaagatctttttggaaaatgtgattcgtgattccgttacttacacagagcacgctaggagaaagacggttactgctatggatgttgtttatgcacttaagagacaaggaaggaccctttacggatttgggggttaagtttttttttttttttgagctttaatggtgtaattctctgttacatatcatggaatagaaatctgatttagttattaattttgattctctacttcttcaacactctttatctattcaattacccctttttc

SEQ ID NO: 2982 - DNA, 542 bp, Solanum lycopersicum
atataaatacccaccaccctaaagagtacaattcacccaatttcaaaaccctagaaactacatcttcttcaaatttctctgtgaaaatgtctggtcgtggaaagggaggcaagggattgggaaagggaggagccaagaggcacaggaaggttctaagggacaacatccaaggtatcactaagccagctattcgcaggcttgctcgtaggggtggtgtgaagcgtatctctggtctcatctatgaggagacccgtggagtgttgaagatctttttggagaatgtgattcgtgattctgtcacctacactgagcacgccaggaggaagactgtcactgctatggatgttgtctatgctcttaagagacagggaaggactctctatgggtttggcggttagattggggtttgaatgttggtggtaaatgtaggtttagtttacaattgcgtataagtctgtcttggatctctgtagtgttgttcttatgctctagatgttgtaatttctcattacagtatcaatgaacagtagattgatcgtctt

SEQ ID NO: 2983 - DNA, 627 bp, Solanum lycopersicum
catcatcaaatctctcatttttctctctgattaatctctcaaaatttgtcaaaaatgtctggccgtggaaagggtggcaagggattaggaaagggtggagcaaaacgtcatcgtaaggtgcttcgtgacaacatccagggtatcaccaagcctgctattaggaggttggcaagaagaggtggagtgaagagaatcagtgggttgatttatgaagagacaagaggtgttcttaagatctttttggagaacgtgattcgtgattctgttacctacacagaacatgctaggaggaagactgttactgctatggatgttgtttatgctttgaagagacaaggaagaactctctatgggttcggtggttaaaactttagatctctgttattgggtattaatactattttagttatgattatgtttctgaatctatgaaatatcttgtttctgaatctatgaatgtgaagaacagttttattttgttgaagatttatcttatttctgtgttccaatggcttaaaaatggcttcttttcatctcttgataatcagaaactgtctaatttgatcttttgctgtatctatgaagttgtttttgcttttccaagtaatgaagaactttaacccattt

SEQ ID NO: 2984 - DNA, 544 bp, Solanum lycopersicum
ttttctctctgattaatctctcaaaatttgtcaaaaatgtctggccgtggaaagggtggcaagggattaggaaagggtggagcaaaacgtcatcgtaaggtgcttcgtgacaacatccagggtatcaccaagcctgctattaggaggttggcaagaagaggtggagtgaagagaatcagtgggttgatttatgaagagacaagaggtgttcttaagatctttttggagaacgtgattcgtgattctgttacctacacagaacatgctaggaggaagactgttactgctatggatgttgtttatgctttgaagagacaaggaagaactctctatgggttcggtggttaaaactttagatctctgttattgggtattaatactattttagttatgattatgtttctgaatctatgaaatatcttgtttctgaatctatgaatgtgaagaacagttttattttgttgaaaatttatcttatttctgtgttccaatggcttaaaaatggcttcttttcatctcttgataatcagaaactgtctaattt

SEQ ID NO: 2985 - DNA, 549 bp, Solanum lycopersicum
atataaatatccaccacccaaaagagctcaattcacccaatttcaaaaccctagaaacttcatcctcttcaaatttctctgtgaaaatgtctggtcgtggaaagggaggaaagggattgggaaagggaggagccaagaggcacaggaaggttctaagagacaatatccagggtatcactaagccagctattcgcaggcttgctcgtaggggtggtgtgaagcgtatctctggtctaatctatgaggagacccgtggagtgttgaagatctttttggagaatgtgattcgtgattctgtaacctacactgagcacgccaggaggaagactgttactgctatggatgttgtctatgccctcaagagacagggaaggacactctatgggtttggtggttagatcagttgttaggcgcattagatgtagatctaatgttaatttctgctgtttctgtgatttggtatctctgtaactgttcgtaagctctagatattgtaatttctcattacatattcaatgaacaaagctcagtttctacaaattacaacag

SEQ ID NO: 2986 - DNA, 459 bp, Solanum lycopersicum
aatcatcaaaaatccaaatctacatctcttctctataatttcatcagaaaaatgtcaggcagaggtaagggaggcaaaggattgggcaaaggaggagccaagaggcacaggaaagtgttgagagacaacattcaaggaattacaaagccagctattcgaagactcgctcgtagaggtggtgtgaagcgtatttctgggttgatttacgaagagactcgtggtgttctgaagatctttttggaaaatgtaattcgtgattccgtgacatacacagagcacgctaggagaaagacggttactgctatggatgttgtttatgcgcttaagaggcaaggaaggaccctttacggatttgggggttagggtttgccttaggattgttaattttattctcatctttgatggtgtaattctctgttatactaattcaaagaatagagtttttcttattctctccaa

SEQ ID NO: 2987 - DNA, 502 bp, Triphysaria pusilla
  misc_feature (227)..(227): n is a, c, g, or t
  misc_feature (340)..(340): n is a, c, g, or t
ccaatctcaatccctaacttatcagctgaaacaaaaaagaggttaaaatcaaatgtcgggaagaggaaagggaggtaagggattgggcaagggtggcgcaaagcgtcatcgcaaggtgttgagagataacatccagggcattaccaagccggccattcgccgtcttgctcgccgtggtggcgtgaagcgcatcagtggcctgatttacgaagagacacgtggcgtcntcaagatctttctcgagaatgtcatacgagacgcagtgacctacactgagcacgcccgccggaaaactgtgacggcgatggatgtcgtctatgctctcaagaggcagggtcgnactctctacggctttggcggttaagttctttggtttagggttttattgattgtatatttagggtacttcgattttctttatgtatggttatgtaatccttgtctcagatttcggaatgtcttgagtttcttattaatggaattcgaaactgggttttaacag

SEQ ID NO: 2988 - DNA, 556 bp, Juglans hindsii x Juglans regia
ttctcatattcagattttatatttcaatttgaaaatgtcgggtcgtggaaagggaggcaagggtttgggcaaggggggagcgaaacggcaccgtaaggttctccgagacaacatccagggaatcacgaagccgggaattcgtcggttggctcgcaggggcggtgtgaagcggatcagcggcctgatctacgaggagacccgtggtgtcctgaagatattcctggagaacgtgattcgcgacgctgtgacctacacggagcacgcccgaaggaagaccgtgacagccatggacgtggtctacgcgctcaagagacaggggagaactctgtacgggttcggaggttaggtttatggccgtaaaaagtcttgctgtcaagaaaaagcaaccaaacaaatggatggtcggtttttttttttattgcaattaggtgggaaaatttgtggtttctagggtctgtgttctggttgtggtctttgtaaatcgacctccgaatggaatttcccgaatatgtaatgcaaagaaaagactagttttagcaaagtttgaatctttatc

SEQ ID NO: 2989 - DNA, 567 bp, Lactuca sativa
cggcggggacacttccatttgcatttcttccaatcaacaaagtttcagatttcggagtaatttgaagaagtttgaagatgtcaggacgtggaaagggagggaaaggattggggaagggaggagcaaagcgtcatcgtaaggttctgcgagacaatatccagggaatcacaaaaccggcgatccgacgtctggcgagaagaggaggtgtgaaacgtatcagcggtttgatctacgaggaaactcgcgtagttcttaagatctttctagaaaatgtcatcagagatgctgttacctacaccgagcacgcacgccggaaaactgtcaccgccatggatgtggtgtacgcgctcaagagacaaggccgaactctgtatggattcggtggttagggttttcaaggcccgaaaatagtctgtgggtattggtgttaggttattgatttctactgcttgttcaaatcaaatgttgttagtacttagtgtaagcctcggatcattttaacaaaatagaagtactcgactgatttcttatctcgatgtttccaaatcaaaatgctttttggcaaaa

SEQ ID NO: 2990 - DNA, 453 bp, Solanum tuberosum
caagaacatttcttctcaaaaatttcttcagaaaaatgtcaggcagaggtaaaggaggcaaaggattgggcaaaggaggagccaagaggcacagaaaagtgttgagagacaatatccagggaattacaaagccagctattcgaagactcgctcgtagaggtggtgtgaagcgtatttctgggttgatttacgaagagactcgtggggttctgaagatctttttggaaaatgtgattcgtgattctgtgacttacacagagcacgctaggagaaagacggttactgctatggatgttgtttatgcacttaagaggcaaggaaggaccctttacggatttgggggttagggtttgttgggttttttttttaatttgtgctttgatggtgtaattctctgttacatattcatggaatagaaatgtgctttagttattaaaaaaaaaaaaaaaaaaa

SEQ ID NO: 2991 - DNA, 487 bp, Rosa hybrid cultivar
gacacaaagcatttcaaaaaatccaagatccgaaatccgaagtcgaatcaaaatgtcgggtcggggcaagggcggtaagggtttgggcaaaggcggagccaagcgccacaggaaggtcctccgcgacaacatccagggcatcaccaagccggccatccgccgtctgggtcgccgtggcggcgtcaaacgtatcagtggcctcatctacgaggagacacgtggcgtcctcaagatctttctggagaacgtcatccgcgacgccgtgacgtacaccgagcacgccaggaggaagacggtgacggccatggatgtggtgtacgcgctcaagaggcagggcaggactctctacgggttcggcggttagggttagggtttgggaaatttgtaaagggaatggggctgatttcgcgggtggttggattagggttattggaattcgatgttgtttaggctgattttgaatgaagaatctacttgcttcttttac

SEQ ID NO: 2992 - DNA, 354 bp, Arabidopsis lyrata
ggaagaggaaagggaggaaaaggattgggaaagggaggagcgaagaggcataggaaggttctgagggataacattcaaggtataaccaagcctgccattcgtcgtcttgctcgcagaggtggtgtcaagcgtatcagtggtctcatctacgaagagaccagaggtgtcctcaagatcttcctcgagaatgtcatccgtgacgccgttacctacactgagcacgccaggaggaagacggtgactgccatggatgttgtctacgctttgaagaggcaaggacgcactctctacggtttcggcggttaatctggagattagcaagtttgggaatttcttgtttctgagatgtgtgtt

SEQ ID NO: 2993 - DNA, 477 bp, Artemisia annua
tgtcaggaagaggaaagggaggaaagggattaggcaaaggaggagcaaagcgtcacaggaaagtcctccgcgacaacatccaaggtatcaccaagcctgccatccgtcgtcttgctcgtcgtggaggtgtgaagcgtatcagcggtctgatttacgaggagacacgtggcgtcctcaagatacttttggagaatgtgatccgtgatgctgtcacctacactgagcacgctcgccgtaagactgtgaccgccatggatgtggtttatgctttgaagaggcaaggaaggactctctacgggtttgggggttagaattggaattagggtttgttgttatggttaggatttggaagttgttatgtggttaagattgttatgttttagatctggttaggtgcttgtgtagatggggtttgttacatcttgtaattgaatctctgtttcggattaatatgaatttaagtatttcctgtttaaa

SEQ ID NO: 2994 - DNA, 432 bp, Artemisia annua
caggaagagggaaaggaggaaaggggttaggcaaaggaggagcaaaacgacatcgtaaagtgcttcgtgataatattcaaggaatcactaagcctgcgataaggcggttagctagaagaggaggtgtgaagaggataagcgggttgatttacgaggagacacgtggcgttctcaagatatttttggagaatgttattagagatgcggtgacttacactgagcatgcgaggaggaagacagtgactgctatggatgttgtttatgctttgaagagacaaggaaggactctttatggttttgggggttgaattgaattaggtggtgtttggttaggtggattagatctggttattgtgttagcttttgttatggttgtgtagttgaattgatgatgtgtttaatgaatgaaatttaaatccaaactacagtgct

SEQ ID NO: 2995 - DNA, 452 bp, Gerbera hybrid cultivar
tggaagaggcaaaggaggcaaggggttgggaaagggaggtgccaaacgtcaccggaaagttctccgggataacattcagggcatcacgaagccggcgattcgacggttggcgagacgtggcggcgtcaagcgtatcagcggtcttatctacgaggagacgcgtggtgttctcaagatctttctagagaatgtgattcgtgatgcggttacgtacaccgaacatgctcgccggaaaactgtcaccgccatggatgtcgtctatgctttgaagcgccagggccgtactctctacggattcggcggttaagaggtgtatttaggtgttcggggttcttgtggacctgaatctagatctgttttggttagtttttatttaacgtcgttgatgtgaagtgatatatgacgattctgttcaattcaagtttcaatgaaatttaaggttctgttattaa

SEQ ID NO: 2996 - DNA, 859 bp, Pinus taeda
gggggtctcagtcgatttccatctactgtttgagttggaacttgggagatagagaaacccgaagaattctgaaacatgtcggggcgtggtaagggaggtaagggtttggggaagggaggtgccaagaggcacaggaaggttcttagagataacattcagggcatcaccaagcctgccatcaggcgtcttgccaggagaggaggcgtcaagcgcatcagcggtcttatctatgaagagaccagaggcgtcctcaagatcttcttggagaatgtgattaaagatgctgtgacatacacggagcatgccagaagaaagactgtgacagccatggatgttgtctactccctcaagaggcagggccgaaccctttacggtttcggaggctgagagattttgctttgactaaatttattcaatggtgtctcttgacaccaccttctggtctctcagaaatttcaatcctgttgtgattcctggctattaagcgtgttacttcccttacaagattgtaggggtttgttttgcctgtaaatagcttgttagctgcagttttgaggttgtcttcatcaagggtttcagatcgatgactgtctaacgaggaagttaagtcatggggttaaaatgatttaattcttagcaaatgtatgggcaaattcttttttaaagatttgtttgaaatattagccattagacgaatttgatttgccctgctgtcaacagtttttttctcgatctctggcatgcaatcgtctttgaatttactgttccaacatcaatggtgaatttcttctatatttctttgttttttagcagtcaataaacttttacagatgttcaggacgtaaaaaaaaaaaaaaaa

SEQ ID NO: 2997 - DNA, 455 bp, Solanum tuberosum
tgtctggccgtggaaagggaggcaagggtttgggaaagggaggagcaaagcgtcatcggaaagttctccgtgataacattcagggaatcactaagccggcgataaggaggttggcgagaagaggtggagtgaagagaatcagtggattgatctatgaagaaacaagaggtgttttgaagatctttttggagaatgtgattcgtgattctgtgacttacactgaacatgctaggagaaagactgttactgctatggatgttgtttatgctttgaagagacaaggaagaactctttacgggtttggtggttaatttactatattttcgcctttttttttcattgttgttgttgggaaatggaagctagctggtgttttggttatagttttatttagatgaagattgtgagatcattgtaattgatgaatttgtgttaaatgaaatagatctcattga

SEQ ID NO: 2998 - DNA, 682 bp, Solanum lycopersicum
atcttcatctaaacacagcagcttccgattacaattcagtgaattgaagatgtcaggacgtggaaagggaggaaaaggattgggaaagggaggagcaaaacgacaccgtaaggttctccgtgataacattcaaggtatcactaagcctgcaattaggcgtttagctcgtagaggaggagtgaagcgtatcagtggactaatctatgaggagactcgtggagttttgaagatctttttggagaatgtgattcgtgattctgttacttacactgagcatgctaggaggaagacggtcactgctatggatgttgtgtatgcactcaagaggcaaggaaggactctttatggattaggtggttaaaagaatgtgggttgctttaactgatttagtgttttttttaaagtaatagagttgcttaatcaatgacattgcactatcgtcttgtaatcgatttctcaaattctctgtttggatcatatgtatgttttttttgaagtaatcactgagattgtgtatatagaaacttcaaaattgaatcctccaatatgcaatagtcttagtccaattagatatatatatatattgatttatgttcattggatataaaaatgtaggtgaatttcttgtgttttgattagtcattgttgaatccccttctagaagatgactgcaagggcggag

SEQ ID NO: 2999 - DNA, 531 bp, Artemisia annua
  misc_feature (190)..(190): n is a, c, g, or t
  misc_feature (193)..(193): n is a, c, g, or t
  misc_feature (223)..(223): n is a, c, g, or t
  misc_feature (272)..(272): n is a, c, g, or t
  misc_feature (281)..(281): n is a, c, g, or t
  misc_feature (301)..(301): n is a, c, g, or t
  misc_feature (307)..(307): n is a, c, g, or t
  misc_feature (316)..(316): n is a, c, g, or t
  misc_feature (377)..(378): n is a, c, g, or t
  misc_feature (380)..(380): n is a, c, g, or t
  misc_feature (384)..(384): n is a, c, g, or t
aacacacacaaaacacaatccattaatccaaacacccccaaattcaaattcaaaataaaaaaaaatgtcaggaagaggaaagggaggaaagggattgggcaaaggaggagcaaagcgtcatcgcaaggttcttcgcgataacatccagggtatcaccaagcctgccatccgtcgtttggctcgtcgtggnggngtgaagcgtatcagcggtctgatttacgangagacacgtggcgtcctcaagatctttttggagaatgtgatccgtgatnccgtcaccnacaccgagcacgctcgccgnaagacngtgactgcnatggatgtggtttatgctttgaagaggcaaggaaggactctctacgggtttgggggttagnntngaanttagggtttgttgttatggttaggatgtggaagttgttatgttttagatctggttaggtgcttgtgtagatggggtttgttacatcttgtaattgaatctctgttgcgaattaatttgaatttaagtactttctgattaattgtttg

SEQ ID NO: 3000 - DNA, 435 bp, Artemisia annua
ggaagaggaaagggaggaaagggactaggcaaaggaggagcaaagcgtcacaggaaggttctccgtgacaacatccaaggtatcaccaagcccgccatccgtcgtctggctcgtagaggtggagtgaagcgtatcagtgggcttatctacgaagagacacgtggcgttctcaagatctttttggagaatgtgatccgtgatgctgtgacctacactgagcacgctaggaggaagactgttactgctatggatgttgtctatgctctcaagaggcaaggccgtaccctttacggtttcggcggctagatctagggtttctagggttaaggtttcgaatttggtgctgtttagtgattaatgattaatatctgattaatcattttaatttgtatttcgtattttatgttttaatgaaatgaaatttgaattctgttt

SEQ ID NO: 3001 - DNA, 537 bp, Artemisia annua
  misc_feature (176)..(176): n is a, c, g, or t
  misc_feature (178)..(178): n is a, c, g, or t
  misc_feature (208)..(208): n is a, c, g, or t
  misc_feature (211)..(211): n is a, c, g, or t
  misc_feature (229)..(230): n is a, c, g, or t
  misc_feature (232)..(232): n is a, c, g, or t
  misc_feature (286)..(286): n is a, c, g, or t
  misc_feature (425)..(426): n is a, c, g, or t
  misc_feature (434)..(435): n is a, c, g, or t
  misc_feature (457)..(457): n is a, c, g, or t
  misc_feature (462)..(462): n is a, c, g, or t
  misc_feature (492)..(492): n is a, c, g, or t
  misc_feature (502)..(502): n is a, c, g, or t
acaatcaattctaacacacatagtttaagatccgtcaccacacagaacagtaaaaatgtcaggaagaggaaagggaggaaaaggactagggaaaggaggagcaaagcgtcacaggaaggttctccgtgacaacatccaaggtatcactaagcctgccatccgtcgtttggctcgtngnggtggagtgaagcgtatcagtgggcttatntangaagagacacgtggcgtnntnaagatctttttggagaatgtgatccgtgatgctgtgacctacactgagcatgcnaggaggaagactgttactgctatggatgttgtctatgctctcaagaggcaaggaaggactttgtatgggtttggtggttaggtgtgtttgggattgggttttaagtcttgctgtcaagaaagaaatgtgtttagggttnnttctgttnngattttggatggtttagttagngtttngttggtattgaatgtagttagtgtttgtgnttagatgttntaatgatgaatcaagtaatgaagttgattttcgta

SEQ ID NO: 3002 - DNA, 589 bp, Musa acuminata
  misc_feature (16)..(16): n is a, c, g, or t
  misc_feature (26)..(26): n is a, c, g, or t
  misc_feature (30)..(30): n is a, c, g, or t
  misc_feature (35)..(35): n is a, c, g, or t
  misc_feature (46)..(46): n is a, c, g, or t
  misc_feature (57)..(57): n is a, c, g, or t
  misc_feature (112)..(112): n is a, c, g, or t
  misc_feature (121)..(121): n is a, c, g, or t
  misc_feature (133)..(133): n is a, c, g, or t
  misc_feature (142)..(142): n is a, c, g, or t
  misc_feature (196)..(196): n is a, c, g, or t
  misc_feature (278)..(278): n is a, c, g, or t
  misc_feature (292)..(292): n is a, c, g, or t
  misc_feature (381)..(381): n is a, c, g, or t
  misc_feature (409)..(409): n is a, c, g, or t
  misc_feature (414)..(414): n is a, c, g, or t
  misc_feature (428)..(428): n is a, c, g, or t
  misc_feature (432)..(432): n is a, c, g, or t
  misc_feature (440)..(440): n is a, c, g, or t
  misc_feature (453)..(453): n is a, c, g, or t
  misc_feature (457)..(457): n is a, c, g, or t
  misc_feature (476)..(476): n is a, c, g, or t
  misc_feature (496)..(496): n is a, c, g, or t
  misc_feature (544)..(544): n is a, c, g, or t
ggggtcaaaggcttcngtcctccgtnaccnttacntcttctccaancgttctctttnggatcgatcgattgtgggcgcaatgtccggccgcggaaagggaggcaagggtctnggcaagggnggggcgaagcgncaccgaaangttctccgcgacaacatccagggcatcaccaagccggccatccgccgccttgcncgccgtggtggtgtcaagcgcatcagtggccttatctacgaggagacccgcggcgtcctcaagatcttcctcgagaacgtcntccgagatgccgtnacgtacacggagcacgcccgccgcaagaccgtcaccgccatggacgtcgtctacgctcttaagcgccagggccgtactctctacgggtncggtggttgagctgtcccttttcgagtnccgcngtcgacgtcggcgncggngtttgagnccctaggctagcnaggnttagggttcctcttttggntagatttctgaagaagacgngtttagatagtaagttcggaatattgccttctgcaattgagaatctgnacgatctaacttcatctaattttattgagtgatgtatgttttagc

SEQ ID NO: 3003 - DNA, 713 bp, Hordeum vulgare
tcctcacattccacatccgctcgctcgctcggagctcgagatcgtcagccatgtccgggcgcggcaagggaggcaaggggctcggcaagggcggcgccaagcgccacaggaaggtgctgcgcgacaacatccagggcatcaccaagccggcgatccggcgtctggcgcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgacatggacgtcgtctactcactcaagcgccagggccgcaccctctacggattcggcggctaggccatcagctaactttgtttggcacacattggtagaagtgttcgtggccggtcctgggttgaaatcgccgcatctagatgatctttgccctgaccttgatgtcgctggtcgacaggatgtgctaccaaggaatggaaatcgaagctgtttgtttacccttgaataaacgaattcttcgaggaaaagctattccattagagcattaccaaaatgtatggggagatctaaacccaaaatactagatgggagtgcacacttggacgggggcgctttcgcatttgggaaggaagaagttacagaacataacttggaggatgcaaatggtaaagaattagggcaaagaaactaggc

SEQ ID NO: 3004 - DNA, 577 bp, Manihot esculenta
  misc_feature (136)..(136): n is a, c, g, or t
  misc_feature (138)..(139): n is a, c, g, or t
  misc_feature (562)..(562): n is a, c, g, or t
gaccggatcgagcaagctcttaatctctcttatttgattctctcctcaagtttctccatatcagatccagtttctaaacaaaaatgtctgggcgtggcaagggaggcaagggcttgggaaaaggaggagccaagcntnnccgcaaggtccttcgagataacattcaaggaatcacaaagccagccattcgtcgattggctcgcagaggtggtgtgaaacgtatcagtggtttgatctatgaagagacccgtggagtactgaagatcttccttgagaatgtgatcagagatgctgtgacctacacagaacacgcccggcgcaagactgttacagccatggatgtggtgtatgccttgaagagacaaggcaggaccctttatggatttggtggttagggcttttagttttattggattgaaagtcttgctgtcaagaaattgtgtttctttagctttaggtgtttgtgggtgtgtggttatttgtaagtaattcaatgggtttgatctgattttgagcttttgttgtaactatggtggatttggaatgaaatggtggtgtttgnttcatggaaaaaaaa

SEQ ID NO: 3005 - DNA, 518 bp, Cryptomeria japonica
cgactttctctgtcagtgtttttattaattgtttacttcaatttcgttcaatctctcatcaatttgaattatgtctggacgtggtaaaggaggtaagggattaggaaaggggggagccaaacgtcatcgaaaagttttacgtgataacatccagggtatcaccaagccagctatccgtcgtttagcaagaagaggtggtgtaaaacgtatctctggattgatctatgaagaaactcgaggtgttcttaaggtattcttggaaaacgttattcgagatgctgttacctatactgagcacgccaagaggaagacagtaaccgccatggatgttgtctatgccttgaaacgacaaggaagaaccttgtatggttttggaggttaagactcttaaatataacctggtatcaaccaatttatgtacctcagttcatcatcatcattttattcctcattccctatttaattttattccatcaaaaaacggcccttttcagggccaaatacatttttgacgaaaa

SEQ ID NO: 3006 - DNA, 510 bp, Cynara scolymus
acttcctcttcttcgtggagttatctttcgaaaccccattataaaaatttctagtgcagatttgaagatgtcgggacccctaaagggaggaaagggattaggaaaaggaggagcgaaacgacatcggaaggttctccgtgacaacatccagggaatcacgaaaccggcgatccgtcgtttggctaggagaggcggtgtgaagcgtatcagtggtttgatttacgaagagactcgtggagttctgaagatctttctagagaatgtgatcagagacgctgtaacatacacagagcatgctcgccggaaaactgtcaccgccatggatgtggtgtatgcgttgaagaggcaggggcgtacactttacggtttcggtggttaaggttggtaagctatgaaaaagtcttgctatcaagaaagaaaaagggctagggttcttcccctctggtcgggtcaggtcgggtcaatatgcatatggattttagggttttactcttattaatgtcattactg

SEQ ID NO: 3007 - DNA, 487 bp, Lactuca sativa
ggaagaggaaagggaggcaagggattgggaaagggaggagccaaacgacatcgtaaggttctccgggacaacatccaaggtatcaccaagccggcgatccgccgtctggctagacgaggaggtgttaagcgtattagtgggctaatctacgaggaaacccgtggagttttgaagatctttcttgagaacgtcatccgtgacgccgtcacatacacggaacatgctcgccggaaaactgttacggccatggatgtcgtatatgctttgaagcgccaaggccgtactctctacggatttggtggttaatagaatttaggatttctagggttcttgtttgataccggagtttaatctgaagtgatgatattatttgtaattgaagttcttaatacaatattatatagttgttgtcagttcgtggtttacgattcatctttctcgaatgatgtacctttatccagtatatggaatttagttttgtccttga

SEQ ID NO: 3008 - DNA, 433 bp, Lactuca sativa
aaaaaaaaatgtcaggaagaggaaagggaggcaagggattgggaaagggaggagccaagcgacatcgtaaggttctccgggacaacatccaaggcatcaccaagccggcgatccgccgtctggccagacggggaggtgttaagcgtatcagtgggttaatctacgaggaaacccgtggagttttgaagatctttcttgaaaacgtcatccgcgacgccgtcacgtacaccgaacatgctcgccggaaaactgttactgccatggatgtggtatatgctttgaagcgccaaggccgtactctatacggatttggtggttaatagaatttagggtttgtagggttcttgtttgacacaggattttaatctgaaatgattctacttgtaattgaagttcttaatacaatatcagatagttgtcaatttatggttta

SEQ ID NO: 3009 - DNA, 546 bp, Lactuca sativa
aaaaaaatgtcaggaagaggaaaaggaggcaagggattgggaaagggaggagccaaacgacatcgtaaggttctccgggacaacatccaaggtatcaccaagccggcgatccgccgtctagccagacgaggaggtgtcaagcgtatcagtgggttaatctacgaggagacccgtggagttttgaaaatctttcttgagaacgtcatccgtgacgccgtcacatataccgaacatgctcgccggaaaactgttactgccatggatgtcgtttatgctttgaagcgtcaaggccgtactctctacggatttggtggttgatagaaatttgctaccttttcgtttctgggtgtaggctttttcctagtttgattatgtaatctgaattgatatgatgtgtaattgatgtctcttaatacaaatttagttactttttatcaatttcttgtcgaattcttcatctcgaatgattctcttaatacaaattcgtcggatatcacgtgtatcagatgtgtaattgatgctcacgaattgattagtttttatcaa

SEQ ID NO: 3010 - DNA, 589 bp, Eragrostis curvula
acacaaaaaagcaggagggagtcgaagtctcccaaacactcgtacagcggcagagtcttcttcctcctccggcgacgatgtctggtcgcggcaagggcggcaaggggctgggcaagggcggcgccaagcgccaccgcaaggtgctccgcgacaacatccagtgcatcaccaagccggcgatccggaggctggccaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgaaacctctacgggttcggcggctaagcgctgtctcctacctcgtacgcttctgccattgctgctgccaggtgctactgatgattgtacttagaatcatgtgacgtgattctctgatggacgtgtagagatgtaacaatccgtactactatatattagtaccaatgtaaggtgctgaaatgtgaagatgagtaagaaaggaaacggtcagaaagactgagtgaatg

SEQ ID NO: 3011 - DNA, 558 bp, Medicago truncatula
  misc_feature (500)..(500): n is a, c, g, or t
  misc_feature (531)..(531): n is a, c, g, or t
  misc_feature (558)..(558): n is a, c, g, or t
gcggggatctaaaacaaacaaattacaaattgtaaatatcttcttcattttctcattgaaagaagctttttgatttcagatcaagatgtctgggcgtggaaaaggtggaaagggtttgggaaagggtggagcaaagcgacatcgtaaggtgcttcgtgacaacatccagggaataacaaagccagcgattcgtcgtcttgctcgtaaaggaggagtgcagcgtatcagtggtttgatttatgaggagacacgtggcgtgttgaagatatttttggagaatgtgattagagatgctgtgacttacactgagcacgctagaaggaagacggttactgctatggatgtggtttatgccctcaagagacagggaagaaccctttacggatttgggggttagggtttctcttggattttattttggttgtaattgatgtttaattttggtacgaaattgttgctgtacggataattaggtagatttttaggaatcgatcttatantatttttgcagcaattctgtaatccaattcnctattatgaattataaagttacaaccn

SEQ ID NO: 3012 - DNA, 585 bp, Nicotiana benthamiana
  misc_feature (26)..(27): n is a, c, g, or t
  misc_feature (29)..(29): n is a, c, g, or t
  misc_feature (31)..(31): n is a, c, g, or t
  misc_feature (125)..(125): n is a, c, g, or t
  misc_feature (233)..(233): n is a, c, g, or t
  misc_feature (422)..(422): n is a, c, g, or t
  misc_feature (424)..(427): n is a, c, g, or t
  misc_feature (434)..(434): n is a, c, g, or t
  misc_feature (437)..(437): n is a, c, g, or t
  misc_feature (511)..(511): n is a, c, g, or t
  misc_feature (560)..(560): n is a, c, g, or t
gcacgaggtttcatttctgatttcanntnanatccaaaaccttggaaggtttttaatcttcaagttcctgtgtgaaaatgtctggtcgtggaaagggaggcaagggattgggcaaaggaggagcnaagaggcacaggaaggtgctaagggataacattcagggatttacgaagccagcaattcgtcggttggctcgtaggggaggcgtgaagcgtatttctggtctgatatangaggagacacgtggtgtgctaaagatctttctagagaacgtgattcgtgatgctgttacctacactgagcacgccaggagaaagactgttactgctatggatgttgtgtatgcactcaagaggcagggtaggactctctacggttttggtggttaaggaatttgtgtttgtgtttttgacttttgtttntnnnncaaagtnttncggtcaagaaattgaatgaagtattattaaaatagttgatgtaattagggttccttattagtatttgtagtagntgttgtaagaaaagcattctcaggtattctggaatttgctcaacttaanggcagaagaattcaagtttcaaaca

SEQ ID NO: 3013 - DNA, 436 bp, Petunia hybrida
aattcaactgctgttacagaaaatgtcaggacgtggtaagggaggcaagagattgggaaagggaggagcaaaacgacatcgtaaagtgctccgtgataacattcagggaattactaaacctgccattaggcgtttggcgcgtaggggtggtgtgaagcgtatatcagggttgatatatgaagaaacaagaggggtattgaagatatttttggaaaatgtgatacgtgatgctgtcacttacactgaacacgctagaagaaaaactgtgactgctatggatgttgtttactctttgaagagacaaggccgtaccctttatgggttcggtggttaaatgttaaatggagatctattagttgttgttatgaagtttttaatttggttttgttaatgtaattgactggattatcgtatcaatgaaatcaatgttatcttc

SEQ ID NO: 3014 - DNA, 569 bp, Petunia hybrida
cgggggaatttcattactgtttcaaaaaatgtcaggccgtggaaagggaggcaagggattgggaaagggaggagcaaaacgacaccgtaaagtgctccgtgataacattcagggaattactaaacctgccattaggcgattggctcgtaggggtggtgtgaagcgtatatcagggttgatgtatgaagagacaagaggggtattgaagatatttttggagaatgtgatacgtgacgctgttacttacactgagcacgctaggagaaagactgttactgctatggatgttgtttattccttgaagagacaaggtcgtaccctttatggcttcggcggttaagttgtaatatgttttagtttgtagctgggttaagtaagtgaaatgggatatagttggtgtttattagtgtttgaatctcaagtttatgtatgaggtctttgtaactgaatagtttatattaatgaaatggatctcattaagtgtttttgatatataattcttgtgcttgtcttctatgaatgggtcatatattatttgttttgcaatttaagagctcatttctcattta

SEQ ID NO: 3015 - DNA, 587 bp, Pinus taeda
  misc_feature (115)..(115): n is a, c, g, or t
  misc_feature (136)..(136): n is a, c, g, or t
  misc_feature (139)..(139): n is a, c, g, or t
  misc_feature (145)..(145): n is a, c, g, or t
  misc_feature (148)..(148): n is a, c, g, or t
  misc_feature (157)..(157): n is a, c, g, or t
  misc_feature (160)..(160): n is a, c, g, or t
  misc_feature (169)..(169): n is a, c, g, or t
  misc_feature (196)..(196): n is a, c, g, or t
  misc_feature (199)..(199): n is a, c, g, or t
  misc_feature (205)..(205): n is a, c, g, or t
  misc_feature (262)..(262): n is a, c, g, or t
  misc_feature (269)..(269): n is a, c, g, or t
  misc_feature (298)..(298): n is a, c, g, or t
  misc_feature (304)..(304): n is a, c, g, or t
  misc_feature (346)..(346): n is a, c, g, or t
  misc_feature (373)..(373): n is a, c, g, or t
acgcggggagcatcgctattcttcattctatcattttggttgaaagcagcagcaggtagcgagaaagatgtctgggcgtggaaagggaggaaagggtttggggaaaggaggtgcnaagaggcacaggaaagttctnagngataanatncagggtatnacnaagcctgcnatcaggcgtcttgccaggagaggaggngtnaagcgnatcagcggtctcatctatgaagagaccagaggcgtcttgaagatcttcttggagaangtgatcngggatgccgtgacatacacagagcacgcnagaagnaagactgtgacagccatggatgttgtgtactccttaaaaagncagggccgaactctttacggctttggnggctgagaagtctcattctgaccactggtcaagacagggccgaactctttacggctttgggggctgagaagtctcattctgaccactggtcattcttaattcactgtcatttatggtgtctctagacaccaccttcgtatccacggagaattttgagcctctcaagtgccgaaggcgtttttttagttgaagctcgtacgaatttattcagtgc

SEQ ID NO: 3016 - DNA, 370 bp, Solanum tuberosum
ctcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccttttctaccaataaaaggcccttttcagggccaccct

SEQ ID NO: 3017 - DNA, 713 bp, Solanum tuberosum
tattaaggagtttaattcattaaacgatttgaatcaactattagagaacattgaacttgcaattgtctcttataatcccaacttcgttaatgcagaataggagggagaatgtctaataggcgttaaagcaaatcctgtaacaccatcttaaacatgttgcacagatttgccaaattcaaaaccctagaaacttcatcttcttcaaatttctctgtgaaaatgtctggccatggaaagggaggcaagggattgggaaagggaggagccaagaggcacaggaaggttctaagagataacatccagggtatcactaagccagctattcgcaggcttgctcgtaggggtggtgtgaagcgtatctccggtctgatctatgaggagacccgtggagtattgaagatctttttggagaatgtgattcgtgactctgtcacctacaccgagcatgccaggaggaagactgttactgctatggatgttgtctatgccctcaagagacagggaaggactctctatggatttggcggttagattctggagtttggttggtgtaatggtagtaactgtaggtttagtttacattgcgtttgtggctggtgtagctgtggattttaattctctgtagcttctttttgggtcttgttgttaagctctatattttgttaatattcaagtaatcaagttcacctttccagaaaaaaaaaaaaaaaaaa

SEQ ID NO: 3018 - DNA, 456 bp, Pseudoroegneria spicata
  misc_feature (6)..(6): n is a, c, g, or t
  misc_feature (82)..(82): n is a, c, g, or t
  misc_feature (142)..(142): n is a, c, g, or t
  misc_feature (154)..(154): n is a, c, g, or t
  misc_feature (184)..(184): n is a, c, g, or t
  misc_feature (196)..(196): n is a, c, g, or t
  misc_feature (262)..(262): n is a, c, g, or t
  misc_feature (265)..(265): n is a, c, g, or t
  misc_feature (295)..(295): n is a, c, g, or t
  misc_feature (366)..(366): n is a, c, g, or t
catgtngggccgcggcaagggaggcaagggcctcggaaagggtggggcgaagcggcacaggaaggtgctgcgcgacaacatncaggggatcacgaagccggcgatccggcggctggcgcggcggggcggcgtgaagcgcatntccgggctgatntacgaggagacccgcggcgtgctcaagatnttcctcgaaaangtcatccgcgacgccgtcacctacacggagcacgcccgccgcaagaccgtcaccgccatggacgtngtntacgcgctcaagcgccagggccgcaccctntacggcttcggcggctgagcccgggtcgcgcctcgcgtgggatttagatgtggttaggcgggttgtcgttntgtggtgtgccgtcctgtgtgtgcagctgcgtgctggtgcttgtaatgagttccagattctaatatggatgattatctcgcattggatcg

SEQ ID NO: 3019 - DNA, 444 bp, Raphanus sativus
gggaaaaatgtcgggtcgtggaaagggaggcaagggtttggggaaaggaggagcgaagcgacacaggaaggtcctgagagacaacatccagggaatcaccaagcctgcgatacgccgtcttgctcgcagaggaggcgtgaagcgtatcagcggtctgatctacgaggagacacgtggagtgctcaagatctttttggagaacgtcatccgcgacgccgtcacatacaccgagcacgcgcgtaggaagacggtcaccgctatggatgtggtgtatgctctcaagaggcaaggcaggactctctatggattcggcggctagggtttttttttttttgttttttttttttttggtttttaatcaattctcagatttgatttttcttttagtaagtttcagtttgcttttttatcatcaagaaatatatgaaattcaacatttgaacc

SEQ ID NO: 3020 - DNA, 418 bp, Secale cereale
ccacgcgtccgccaccgctcctcgacctcgatccgctagcagcttgagccaaggagagatcgtcagccatgtcatggcgcggcaagggaggcaaggggctcggcaagggtggcgccaagcgtcaccggaaggtgcttcgcgacaacatccagggcatcaccaagccggccatccggcgcctggccaggaggggcggcgtgaagcgcatctccggcctcatctacgaggagacccgcggcgtgctcaagatcttcctcgagaacgtcatccgcgacgccgtcacctacactgagcacgcccgccgcaagaccgtcaccgccatggacgtcgtctacgccctcaagcgccagggccgcaccctctacggcttcagcggctaggcactttctcgcctccctgcagatcccaaaagcttgat

SEQ ID NO: 3021 - DNA, 790 bp, Saccharum officinarum
cgcttcctcctgatccgcattccaagtgccagcagcgaagctctcggtttcggtgatgtcggggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccggaagaccgtcaccgtcatggacgtcgtctacgcgctcaagcgccagggcctgaccctctacggctttgggggctaagtcattccttaattcggtggccaacatgcattttgtggctcgaaggggtccgaattagtgtgccctcatctaaattgtaatactggtgcttcttttgtgggcaactagcttttaattcatggtggcgggtcttatgcgctcttatacttaacacttttagggattgttctttttttcaactaaatttaatctatttaatctaaaccaaattggaaaataacctttttaccttatttttacatccctttttaattgtttgattgtaacactaacttattcttagttcatgtcgaattaatcctatcgaactttaatctggttgtatcgctattcctttttctaataaatagtatttccctctaattctttaatattcttctgcactaaatacaatataagtaatatgtatttataacgctctaa

SEQ ID NO: 3022 - DNA, 589 bp, Saccharum officinarum
caaatatttctcgccccaaatacactcaaacctccgctccttcagcgggctcctgcccgttcgtctcgaagcagcaggcagccatgtcgggccgcggcaagggaggcaagggcctgggcaagggcggcgccaagcgccaccggaaggtgctccgcgataacatccagggcatcacgaacccagcgatccggaagctggcgaggaggggcggcgtgaaacgcatctccgggctgatctacgaggagactcgcggcgtgctcaagatcttcctcgagaacgtcattcgcgacgccgtcacctacacagagcacgcccgccgcaagaccgtcaccgccatggatgtggtctacgcgctcaagcgccagggccgcaccctctacggtttcggcggctgagccttggctccgtccgcgttctctggccatgtggttgtggtcaggtgctaactaagggtgttgatggattaagggaggttggtactttgtgttggggttgcactgtgcttaaaggttatgtttgtaacggagaatggaaccttattaattgaaagaaagggtgtttaattatttggggtcattcccaatgactc

SEQ ID NO: 3023 - DNA, 705 bp, Saccharum officinarum
ccagctcaccccaccaacagcaagcgatcgaaaaaatccccaatcccctcgtctccgcggcgaagatgtcggggcgcggcaagggcggcaagggcctgggcaagggcggcgcgaagcgtcaccggaaggtgctccgcgacaacatccaggggatcaccaagccggcgatccggaggctggcgcggagaggcggcgtgaagcgcatctccgggctcatctacgaggagacccgcggcgtgctcaagatcttcctcgagaacgtcatccgcgacgccgtcacctacaccgagcacgcgcgccgcaagaccgtccccgccatggacgtcgtctacgcgctcaagcgccagggccgcaccctctacggcttcggagagtaggccggccgagcctcgcccctctccgaccgcctgtgttgccgacgccgtggttgtcatgtagctgaaaatccctatttgtcccgagtgggaaaaaatgcccggtggcacaacaggtacatacattgtccgtatccgacagagtctaatcctcaacaacattcacaggacccacttcccacaggctcaacacgccccactgctctcaaatacaaatacacaagctgcggcggccctccaaaagagcccatctaaaaccaacacgtgcttacacagcagaatgcaccatcaccagatccacccaaaccacaccagcaaccactcaactatc

SEQ ID NO: 3024 - DNA, 520 bp, Juglans hindsii x Juglans regia
  misc_feature (137)..(137): n is a, c, g, or t
  misc_feature (162)..(162): n is a, c, g, or t
  misc_feature (325)..(325): n is a, c, g, or t
  misc_feature (348)..(348): n is a, c, g, or t
  misc_feature (477)..(477): n is a, c, g, or t
agagacgcagaatagagagcaagtaggagaagatgtcaggaagagggaagggaggcaagggattgggaaagggaggtgcgaaacggcaccgtaaggtactgagggacaacatccagggcatcaccaagcccgctatncgacgactcgcgaggcgtggtggantcaagcgcatcagcggcctcatctacgaggagactcgtggcgttctcaagatcttcctcgagaacgtgatccgcgacgccgttacctacacagagcatgctcgccgcaagactgtaaccgccatggacgtcgtctatgccttgaagcggcagggcagaacccnctacggctttgggggctaaggangtttgagtttctgtaataattagatggcttagaattagggtcgtgtcttggtcaattaaaattggggggttcattgtatcgggcttaattctttgacatgtcactgaatcgagaaatgaaccaacatgnctatttaagttcatattattctgtgcgaaaagagtcttgaatc

SEQ ID NO: 3025 - DNA, 385 bp, Zinnia violacea
ggaagaggcaaaggaggaaagggattagggaaaggaggagcaaaacgacatcgtaaggtcctccgtgacaacatccagggcattaccaaaccggctatccggcggttggctcgtcgaggtggtgttaagcggattagcggtcttatttatgaggagacacgtggcgtgttgaagatatttctggagaatgttattcgtgacgccgttacttataccgagcatgctagacggaagacggtaacggcgatggacgtcgtttacgctttgaaacgtcagggacgaactctgtatggttttggtggttagtgtgttaggttaagtagatcttgaattagatttagtcgaaattgaatttcgaatttgtaatttgattttaggttttgtt

SEQ ID NO: 3026 - DNA, 798 bp, Pinus taeda
cggccggggacgatccttcttcattttaccttattgctaaccattgtggttgggagaagagcaggagaaaggaaggatgtctggccgcggaaagggagggaagggtttgggaaagggaggtgccaagaggcacagaaaagtgctgagagataacattcagggtatcaccaaaccagccatcagacgccttgccaggagaggaggcgtcaagcgcatcatcgggctcatctatgaggagaccagaggcgtcttgaagatcttcttggagaatgttattagagatgcagtaacatacacagaacacgccaggagaaagactgtcactgctatggatgttgtctactcactcaagaggcagggccgaaccctctacggctttggaggctgatcgttattatcttttttggccgttcatcactcgcgcattcatggtgtctattcacaccaccgtctactgttggaggattgtaacctcactggcgaatatttaatgcactgcagatatgagtgaaaataattttgtattcaaatgttccagaatgatcagcaccctataagactcgatcaaacatgaatgccttacgaatcaacacgccatcaagctaatatgtggaggaatcttaccctcacggagggtaaacctacaacgaaagctgacatttaacaagattcagaacacagagcagaaagaatgaacacacatgtattttagatcgatttttgtgacaaacttagtggagtatgcactagatacagtaatattatcgagcaattagtgtgttaatttggatcctctgc

SEQ ID NO: 3027 - DNA, 493 bp, Artemisia annua
agcagtggttcaacgcagtactccaacgggatcaaaaacccaaacaactttcattcaatcaattaaaaaagaaagaaaaaaatagtcgggacgtgggaagggaggaaagggactaggcaaaggcggagcgaagcgtcacaggaaagtgttaagagacaacattcaaggaatcacaaagccggctattcgtcgtttagctcgtagaggtggagtgaagaggatcagcgggttgatttacgaagagaccagaggtgttttgaagatctttttggagaatgttatccgtgatgctgtcacctacaccgagcacgcttgtcgtaaaactgtcactgctatggatgttgtttatgctcttaagagacaaggcaggactctctatggtttcgggggttaggttgattagtattatgttgtcgttacgatgttctttgtacggttttatggttgtattgtgtaattgaaagttcatcaatccaatgaatctgaatttagc

SEQ ID NO: 3028 - DNA, 539 bp, Saccharum officinarum
cttcctcctgttccgcattccaagtgccagcagcgaagctctcggtttcggtgatgtctgggcgcggcaagggcggcaaggggctgggcaagggcggcgccaagcgccaccgcaaggtgctgcgcgacaacatccagggcatcaccaagcccgcgatccggaggctggcgaggaggggcggcgtcaagcgcatctccgggctcatctactaggagacccgcggcgtgctcaagatcttcctcgagaacgtcatccgcgacgccgtcacctacaccgagcacgcacggcgcaagaccgtgaccgccatggacgtcgtctacgcgctcaagcgccagggccgcaccctctactgctttggcggctaggtcattcctcatccggtggcgaactgcatgtggtggcggagggggtcgtgttgtgtgccgcgtctagtgtagactgtgctctctgcgtctgtgctgcgttgtgaggtggttgcgctctatctacgctatgagagttgcttgaatatctagttgacattatgaatggaaaaccct

SEQ ID NO: 3029 - DNA, 580 bp, Triticum aestivum
  misc_feature (47)..(47): n is a, c, g, or t
tcatcgctgtctggaacagaccgacgggacaaccagccgccgccacnacagctcctccatttgcatctcagtcagctccaaggaaggaagcggtcagccatatccggccgcggcaagggcgggaaggggctgggcaagggcggcgccaagcgccaccggaaggtgctgcgcgacaacatccagggcatcaccaagccggccatccgtcgtcttgcccgcaggggcggcgtgaagcgcatctcggggctcatctacgaggagacccgtggcgtgctcaagatcttcctcgagaacgtcatccgcgacgtcgtcacctacacagagcacgcccgccgcaagaccgtcaccgccatggacgtcgtctacgcgctcaagcgccagggacgcaccctctacggattcggcggctgaactgcgctcggctgctctatcgagtcgactctgctggatgctgctgttcctctgctatggtttcgtttctgggtgcgtgcgttgttgttccgtcggtctgtgtagttaggggaaggcgatgaatctgaatgcaatgaaaatggttggttcttgtggtataaaaaaaaaa

SEQ ID NO: 3030 - DNA, 471 bp, Triticum aestivum
  misc_feature (349)..(349): n is a, c, g, or t
  misc_feature (411)..(411): n is a, c, g, or t
  misc_feature (419)..(419): n is a, c, g, or t
  misc_feature (451)..(451): n is a, c, g, or t
ccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaaggagacccgcggcgtgctcaagatcttcctcgagaacgtcatccgcgacgccgtcacctacactgagcacgcccgccgcaagaccgtcaccgccatggacgtcgtctacgcgctcaagcgccaaggccgcacctctacggcttcngcgggctaagctgatgggctcctcgcgatgttctccccttctgcaaatgcaacttttctggncgtgccanaagtcttgcggtcaagaaatttcaggaactcntgttaagtcactctggctgt

SEQ ID NO: 3031 - DNA, 491 bp, Triticum aestivum
  misc_feature (323)..(323): n is a, c, g, or t
  misc_feature (358)..(358): n is a, c, g, or t
  misc_feature (393)..(393): n is a, c, g, or t
  misc_feature (396)..(396): n is a, c, g, or t
  misc_feature (469)..(469): n is a, c, g, or t
gccgttcctccggttccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaancgccaggggcgcacctctacggcttcggcggtagnccggcgacggcgcattctctctcgccgcctgcagntcnaaaacttgatggaacccgacttctattcctttcctgtgtactccattgttgttggaacaaatctctctgcaangcgctttctgaataaaaaaaaa

SEQ ID NO: 3032 - DNA, 598 bp, Artemisia annua
aaatcacaaccaacttttataaaacataaaaagttaaaaaaaaaatagtcaggaagagggaaaggaggaaaagggttaggcaaaggaggagcaaaacgacatcgtaaggtgctccgcgacaacatccaggggatcaccaagccagctataaggaggttagtgagaagaggcggagtgaagaggataagcgggttgatttacgaagagacacgtggcgttctgaagatatttttggagaatgtgattagagatgcggtgacgtacactgagcatgcgaggaggaagacagtgactgctatggatgttgtttatgctttgaagagacaaggaaggactctttacggcttcggtggttgaatttgaattaggtggtgtttggttacatggattagatctggtttattgtgttaggttttgttatcgttgtgtagttgtattgatgatgtgtttaatgaacaagtaaggcggtggccggccgcgttgcggcctggcggtagttttttttcgttgtatttggccatcaatatacaattaaaaggatatgacatgtacttgatgaaataaaagacctgtagcattaaggtccaagagtgcgtct

SEQ ID NO: 3033 - DNA, 560 bp, Artemisia annua
tagtcaggaagagggaagggaggaaagggactaggcacaggaggagcaaagcgtcatcgtaaagtactccgcgacaacattcaaggtatcaccaagcctgctattaggagactagccagacgtggtggtgtgaagcgtatcagcgggttgatttacgaggagacacgtggcgtgttgaagatatttttggagaatgtgatccgtgatgccgtcacctacactgagcatgctcgccgtaagacagtgactgctatggatgtggtgtatgctttgaagagacaaggaaggactctctacgggtttgggggttagagtggaaattagggtttgttgttatggttaggatgtggaagttgttatgttttagatctggttaggtgcttgtgtagatggggtttgttacatcttgtaattgaatctctgttgcgaattaatttgaatttaagtactttctgtttaattgtttgtgttattttttttaaagcttggttaattcaatttcttaagtctagggtttgtgttgactgtttattggatttatacaaatttagttatgttat

SEQ ID NO: 3034 - DNA, 496 bp, Taraxacum officinale
tcaaatccacttctagacgacctacagagagagatgtcaggaagaggaaagggaggcaagggattgggtaaggcgaggagccaagcgtcaccgtaaagttctccgtgacaacatccagggaatcacgaagccggcgatccgtcgtttggcgaggcgtggtggtgttaagcgtatcaccggtctcatctacgaggagacacgaggcgtcctcaagatctttctcgaaaacgttattcgagatgcagttacctacactgagcacgctcgccggaaaactgtgactgctatggacgtggtttatgctttgaaacgacagggccgtactctctacggttttggaggttaagagatatagggattctagaattagtgcttcacagatctgttagtttgtttgttgaaattgttcatatatctgtgtaaccgatactcccaattaattccagttcgaacttgttctctggaatggatcattacattactaaaaaaacatgtc

SEQ ID NO: 3035 - DNA, 548 bp, Camellia sinensis
tatcggccattacggccggggatcatcaaaatctcttcatatttgagttgactcatcaatcaatatttgtcgcaatgtccggtcgtggaaaggtggtaagggtttaggcaagggtggagcaaagcggcaccgcaaggtcctccgagacaacatccaggggatcacgaagccggcgattcggagactggcgagaagaggaggtgttaagaggattagcggtctgatctatgaggagactcgaggagtgtcgaagatcttcttggagaatgtgattcgtgatgctgtcacctacacagagcacgctaggaggaagactgtcaccgccatggatgttgtctatgctctcaagaggcaagggaggactctgtacggttttggaggttgaggctttgggttttgtttaggtctgtgcttatgtaatagaattaatgactctacatttcaatataatgcatttctgactttgctacggcatttctctatgtttgttgttgtgttgtgtctctaatctaatactatgattttcgttttgattgcctgtattggag

SEQ ID NO: 3036 - DNA, 575 bp, Raphanus sativus
  misc_feature (169)..(169): n is a, c, g, or t
ttgcgagaagatgtcaggaagagggaaaggaggaaagggattgggaaagggaggagccaagaggcacaggaaggtgctgagggataacatccaaggtatcaccaagcctgctatccgtcgtcttgctcgccgaggtggagtcaagcgtataagcggtctgatctacgangagacaagaggagtcctcaagatcttcctcgagaatgtcatccgcgacgccgtcacctacaccgagcacgccaggaggaaaaccgtcaccgccatggatgtggtctatgcgttgaagaggcagggacgcactctctacggtttcggcggttaaattgaatcgacggagttggggattagggtttgaaaatttggggatctgaaaatttctttgtttctgatttagctgaagtaaatccacgactattgtgtatcgttttatgctatgttgttagccaacgttatgttaaatgaatcttatcaaaacttatgatgagaatttctaattagaatgttttatattgaaatcatcttgtataaatcccaatctgcaggcgttaatcaaacctgcaaaattagtgtgcgca

SEQ ID NO: 3037 - DNA, 349 bp, Persea americana
agctcgagtctttttcagatctcatcgatcaatttcaaatctctgcaccatgtctggccgaggaaagggaggcaagggtttgggaaagggaggagcgaagcgccaccggaaagtgctccgagacaatattcaaggcatcacgaagccggcgatccggcggctggcgaggagaggaggcgtgaagaggatcagcggcctcatctacgaggagacgaggggagtcctcaagatctttctggagaatgttattcgcgatgcggtcacctacacggagcacgctcggcggaagacggtgacggccatggatgtggtgtatgctctcaagaggcaggggaggaccctctatgga

SEQ ID NO: 3038 - DNA, 329 bp, Orobanche aegyptiaca
ctattttctctctctcaagcttttgaaaaatgtctggacgtggtaagggaggcaagggattgggcaaaggaggagcaaagaggcacaggaaagttctaagggataacatccagggaattacaaagccagctattcgtagacttgctcgtaggggtggtgtcaagcgtatttctgggttgatttatgaggagacacgtggagtgcttaagatctttttggagaatgtgattcgtgatgctgttacctacactgagcacgctaggagaaagactgttactgctatggatgttgtgtacgctctcaagaggcagggaaggaccttgtatgga

SEQ ID NO: 3039 - DNA, 454 bp, Malus domestica
aaaagcaaacgagttctctctcactttctctgcaattttcagttttgtgttcaggtgtttgagaattttggctggcaacaatgtctggacgcggaaagggaggcaaggtgttcggcaagggaggagcaaaacgtcaccggaagatcctccgtgacaacatccagggcatcaccaagccagcgattcgccgcctggcccgcagaggtggcgtgaagcgaatcagcggcctgatatacgaggagactcgcggcgtcctcaagatctttctcgagaatgtgattcgtgatgccgttacctacacggagcatgcaaggaggaagacggtgacggccatggacgttgtctatgcgctcaagaggcagggcaggactctgtacgggttcgggggttaagagttttggtggggaaacttgctgtcaaagggactggggattggtatcgggtatttttaacg

SEQ ID NO: 3040 - DNA, 556 bp, Zea mays
agagttcgagtgaccatgtcggggcgccctttgggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcaggaccgcaccctctacggatttggcggctgaggtgttaggggtgtccgccagctgctgctggtcgtggcagaagtcttggggcgcggtcacgaaatggactgattccagaatattcttgcccatgggcttagtttccagggcttatcacctagaactccaatggccttggcccaagagtaggcaaacaacttggaccggcattttctttgggtttgaaacccctaaaatgaaagaaatgggggattccctttaatccccc

SEQ ID NO: 3041 - DNA, 559 bp, Pinus taeda
agtcactgttgacttctcatttacgtctcatctcttctctgacatcatgtccggtcgcggtaaaggcggtaaaggtttaggcaagggcggcgccaagcgtcatcgtaaggtattgcgtgataacatccaaggtatcaccaagccggccattcgtcgtctcgctcgtcgaggcggtgtcaagcgcatttcgggattaatctatgaggaaacgcgcggcgttctcaaggtattcctagagcacgtcatacgagacgccgttacatacacagagcatgcacgacgaaagacggtcaccgccatggacgtcgtatacgcgctcaaacgtcaaggtaagaccttgtacggattcggtggttaagagttgactgtatatatgagggcgggacgaacgaaacgatgcgcacgcgcgtaatacgacggcggtcgcggagctgtttgctgagtgatgagatgtgcggcgttgtcgtgacgttgtaacggcgttgtggtcacgatgatacgacatccgatgtcactgcggttttggtcatgtatttcgtatacattatattggcatcgg

SEQ ID NO: 3042 - DNA, 726 bp, Pinus taeda
aaggatgtctggccgcggaaagggagggaagggtttgggaaagggaggtgccaagaggcacagaaaagtgctgagagataacattcagggtatcaccaaaccagccatcagacgccttgccaggagaggaggcgtcaagcgcatcatcgggctcatctatgaggagaccagaggcgtcttgaagatcttcttggagaatgttattagagatgcagtaacatacacagaacacgccaggagaaagactgtcactgctatggatgttgtctactcactcaagaggcagggccgaaccctctacggctttggaggctgatcgttattatcttttttggccgttcatcactcgcgcattcatggtgtctattcacaccaccgtctactgttggaggattgtaacctcactggcgaatatttaatgcactgcagatatgagtgaaaataattttgtattcaaatgttccagaatgatcagcaccctataagactcgatcaaacatgaatgccttacgaatcaacacgccatcaagctaatatgtggaggaatcttaccctcacggagggtaaacctacaacgaaagctgacatttaacaagattcagaacacagagcagaaagaatgaacacacatgtattttagatcgatttttgtgacaaacttagtggagtatgcactagatacagtaatattatcgagcaattagtgtgttaatttggatcctctgc

SEQ ID NO: 3043 - DNA, 378 bp, Rosa hybrid cultivar
aatgtcgggtcggggcaagggcggtaagggtttgggcaaaggcggagccttgccccacaggaaggtcctccgcgacaacatccagggcatcaccaagccggccatccgccgtctgggtcgccgtggcggcgtcaaacgtatcagtggcctcatctacgaggagacacgtggcgtcctcaagatctttctggagaacgtcatccgcgacgccgtgacgtacaccgagcacgccaggaggaagacggtgacggccatggatgtggtgtacgcgctcaagaggcagggcaggactctctacgggttcggcggttagggttagggtttgggatttgggaaatttgtaaagggaatgggcctgatttcggtggtggttggatt

SEQ ID NO: 3044 - DNA, 336 bp, Glycine max
agcaagaatgtctgggcgtggaaagggaggcaagggtttgggaaagggaggagcgaaacgacaccgtaaggtgttgcgcgataacattcagggaatcactaagcccgcgattcggcgtttggctcgtaggggtggtgtgaagcgtatcagtggtctcatctacgaagagacacgtggcgtgctcatgatctttttggagaacgtgatttgtgacgtcgttacctacactgagcatgctaggagaaagaccgttacggcaatggacgtggtttatgctctcaagagacagggaaggaccctctacggatttgggggctaggttttttattttattgt

SEQ ID NO: 3045 - DNA, 546 bp, Saccharum officinarum
ttgatccgctttccaagttccagcaacgaagctctcggttttggcaatgtcggggcccggcaagggcgccaaggggctgggcaagggcggcgccaagcgccaccgcaaggtgttgcgcgacaacatccagggcatcaccaagcccccgatccggaggctggcgaggaggggcggcgtcaagcgcatctccgggctcatttacgaggagacccgcggcgtgctcaagatcttcctcgagaacgtcatccgcgacgccgtcacctacaccgagcacgcccgccgcaagaccgtcaccgccatggacgttgtttacgcgctcaagcgccagggccgcaccctttacggcttcggcgggtaggtcattcctcatccggtggcgaactgcatgtggtggcggaggtggtcgtgttgtgtcccgtgtctagtgtagtctgtgctctctgtatcggtgctgtgttctgtggtggttgtgctctatctacgctttgggtgttgctgtaatatctagttgtcattatcaatggaaaaccctcggttttagcctcc

SEQ ID NO: 3046 - DNA, 431 bp, Nicotiana tabacum
gaagaggcaaaggtggcaaaggattgggcaaaggaggagccaagaggcacagaaaagttttaagggacaacatccagggaatcacaaagcctgcaattcggcgtttggctcgtaggggaggagtgaagcgcatttctggtttaatttacgaggagacgcgtggggtgttgaagatatttttggagaatgtgattcgtgatgcagtgacttacacagaacacgctaggagaaagactgttactgctatggatgttgtttatgcactcaagagacagggcaggactctctatggatttgggggttaggttttggaattagggtttgtgtgggtaatgattgtagatcgttttatcacctgttgtggattagaatttcttagtttttgtttgagctttgtaatgtaattctccgttacatattcaagaaatagt

SEQ ID NO: 3047 - DNA, 314 bp, Volvox carteri
atgtctggtcgcggcaagggtggcaagggtctgggcaagggtggagccaagcgtcaccgcaaggtacttcgtgataacatccagggcattaccaagcccgctattcgccgtttggctcgccgtggtggtgtcaagcgcatcagcggcctcatctacgaggagacccgcactgtgctgaagaacttccttgagaacgtcatccgtgactcggtgacctacaccgagcacgctcgtcgcaagaccgtcacggccatggacgtcgtctacgccctcaagcgccagggccgcaccctctacggcttcggtggttaagc

SEQ ID NO: 3048 - DNA, 784 bp, Volvox carteri
ccaactttcaacttcgctatccaagtcacattaagtaaccatgtcgggacgtggcaagggcggaaagggcttgggcaagggaggagctaagcgccatcgcaaggtgcttcgcgacaacattcagggtatcacgaagcctgctatccgtcgtctggcacgtcgtggcggtgtgaagcgtatcagcggcctcatctacgaggagacccgcactgtgctgaagaacttccttgagaatgtcatccgtgactcggtcacgtacaccgagcacgctcgccgcaagactgtgaccgccatggacgtcgtgtatgctctgaagcgccagggccgcaccctctacggcttcggtggttaagctggaggtggcgtcgatgggttctgcaagcccaccataaaacccggtgtttttaaacaccaccaacgttcattcaaattcatttcttttccgctgctcctgcgtttttttatttttcgccattgcttctgcgaagtgaagtgctagcaaggcatgtccgattccgtacgggcagggaatatcgaagaggaaagggacattctacctgttcatcgttttggagggcagggcgagggggcagcgccctgagcgtggtctagcatggggagttggggatccgggctgtgtgtgttttgtgtgctcgtgtggttgccctctccccggaaattggggcccgtcggagtgaggggaatgggttctgtgctgtctggcatcagagtagagaagacgtaggtggcttatgagagtggagaggaggtgggaaagcggtgg

SEQ ID NO: 3049 - DNA, 312 bp, Volvox carteri
atgtctggtcgcggcaagggtggcaagggcctgggcaagggcggtgctaagcgccaccgcaaggttctccgtgacaacatccagggcatcacgaagcctgctattcgtcgtttggctcgtcgtggtggcgtcaagcgcatcagcggactcatctacgaggagacccgcacggtgctgaagaactttctggagaacgtgattcgtgactctgtcacgtacacggagcacgctcgccgcaagactgtcacggctatggacgtcgtctatgcgctcaagcgccagggccgcactctgtacggcttcggtggttaa

SEQ ID NO: 3050 - DNA, 312 bp, Volvox carteri
atgtctggtcgcggcaagggtggcaagggtctgggcaagggtggagccaagcgtcaccgcaaggtacttcgtgataacatccagggcattaccaagcccgctattcgccgtttggctcgccgtggtggtgtcaagcgcatcagcggcctcatctacgaggagacccgcactgtgctgaagaacttccttgagaacgtcatccgggactcggtgacctacaccgagcacgctcgtcgcaagaccgtcacggccatggacgtcgtctacgccctcaagcgccagggccgcaccctctacggcttcggtggttaa

SEQ ID NO: 3051 - DNA, 312 bp, Volvox carteri
atgtctggacgtggcaagggcggcaaggggttgggcaagggtggagccaagcgccatcgtaaggtgctgcgcgacaacattcagggcatcacgaagccggccattcgtcgtttggcacgtcgtggcggtgtgaagcgcattagcggccttatctacgaggagactcgcacggtgctgaagaacttcctggagaatgtcattcgggattcggtcacgtacaccgaacatgctcgccgcaagactgtgacagctatggacgtcgtctacgccctgaagcgccagggccgcaccctctacggcttcggtggttaa

SEQ ID NO: 3052 - DNA, 312 bp, Volvox carteri
atgtctggacgcggcaagggtggcaagggcctggggaagggtggagccaagcgccatcgtaaggtgctgcgtgacaacattcagggtatcacgaagcccgctattcgtcgtttggcacgtcgtggtggcgtgaagcgcatcagcggccttatctacgaggagacgcgcacggtgctcaagaacttcctcgagaatgtcattcgtgactcggtcacctacactgagcatgctcgccgcaagactgtgacagctatggacgtcgtttatgccttgaagcgccaaggccgcaccctctacggcttcggcggttaa

SEQ ID NO: 3053 - DNA, 312 bp, Volvox carteri
atgtccggacgtggcaaaggtggcaagggcttgggcaagggtggtgccaagcgccacaggaaggtacttcgcgacaacatccagggcatcaccaagcccgctattcgccgtctggcacgccgtggtggtgtcaagcgtattagcggcctcatctatgaggagacccgcacagtactgaagaatttcctggagaacgtcattcgtgactcggtcacctacaccgagcacgctcgccgcaagactgtgaccgctatggacgtggtctacgcgctgaagcgacagggtcgtactctgtatggcttcggtggttaa

SEQ ID NO: 3054 - DNA, 312 bp, Volvox carteri
atgtccggtcgcggcaagggtggcaagggcctgggcaagggcggtgctaagcgccaccgcaaggttctccgcgacaacatccagggcatcacgaagcctgctatacgtcgtttggctcgtcgtggtggcgtcaagcgcatcagcggactcatctacgaggagacccgcacggtgctgaagaactttctggagaacgtgattcgtgactctgtcacgtacacggagcacgctcgccgcaagactgtcacggctatggacgtcgtctatgcgctcaagcgccagggccgcactctgtacggcttcggtggttaa

SEQ ID NO: 3055 - DNA, 312 bp, Volvox carteri
atgtctggtcgcggcaagggtggcaagggcttgggcaagggtggcgctaaacgtcaccgcaaggttctacgtgataacatccagggcatcacgaagcctgccatccgccgcctggctcggcgtggtggcgttaagcgcatcagcggcctcatttacgaggagacccgcacggtcctcaagaacttcctggagaacgtcattcgtgattcggtcacctacaccgagcacgctcgtcgcaagaccgtcacggccatggacgtggtttacgcgctcaagcgccagggccgcaccctgtacggcttcggtggttag

SEQ ID NO: 3056 - DNA, 478 bp, Zinnia violacea
acaaaccctacaaataccaagtaatccttaaatcaataaaaaaatgtctggtcgtggaaaaggcgggaaaggtttgggaaaaggaggagcaaaacgacaccgtaaggttctgagagataacaatcagggtatcacgaaaccggccatcaggaggctggccagaagaggtggagttaagaggatcagcggcttgatttacgaagagacacgtggcgtgttgaagataatcttggagaatgtgattcgtgacgctgtaacttacacggagcatgctcggaggaagaccgtgacggcgatggatgttgtgtatgcgttgaagaaacaaggaagaactttgtatggatttggaggttgattgtgatgaattttattatcgtaaaaaaatttgctgtttaatgtttataaaatatgtgcaacagaaaacgttaaaaaatgcaattggtggaatgaaaagttgttcactgttttatgttctgca

SEQ ID NO: 3057 - DNA, 457 bp, Artemisia annua
gacataaaaactttttcattcaatcaaaaaacccagaaaggaaatcatgtcaggacgtgggaagggaggaaagggactaggcaaaggcggagcaaagcgtcacaggaaagtgttaagagacaacattcaaggattacgaacccgcgattagacggttggcgagacgaggaggagtcaagaggataagcgggttgatttacgaagagaccagaggtgtgttgaagatctttttggagaatgttatccgtgatgctgttacgtatactgagcatgcgagaaggaagactgttactgctatggatgttgtttatgctcttaagaggcaaggcaggactttgtacgggttcgggggttaggtgaattagtattatgttgttacgatgttttttgtacggttttatgtgatgtaattgaaagtttaccaatgaagtgaatgttatctgtaaaacgcactcgt

SEQ ID NO: 3058 - DNA, 526 bp, Artemisia annua
tactccgacgggtacgcagtactccgacgggattcccaattttgtgtttaaaataacaacttcgatttgtatttgtgaactttttcatttcttgaaatctttcttagtgttcaatcatgtcaggacttggtaaaggaggtaaaggtcttggtaaaggaggtgcaaaacgtcaccgaaaagttttacgtgataacatccaagggtatcaccaagccagctatccgtcgtcttgctcgaagaggtggtgtcaaacgtatctctggtttgatctacgaagaaactcgaggtgttcttaaggttttccttgaaaacgtcattcgagatgctgtcacctacactgagcacgccaagaggaagactgtaaccgccatggatgtggtctatgctctgaaacgtcaaggaagaactctgtatggtttcggtggttaatctcatcaatccctcatacattgtaattctcgctcagtcctgtttagtaccgctttaggtcccgttggagtactgcgttgaaccactctcgcgatat

SEQ ID NO: 3059 - DNA, 338 bp, Artemisia annua
ggaagaggaaagggaggaaagggattgggcaaaggaggagcaaagcgtcatcgcaaggttcttcgcgacaacatccagggtatcaccaagcctgccatccgtcgtttggctcgtcgtggtggtgtgaagcgtatcagcggtctgatttacgaagagacacgtggcgtcctcaagatcctttttggagaatgtgatccgtgatgccgtcacctacactgagcatgctcgccgtaagacagtgactgctatggatgtggtgtatgctttgaagagacaaggaaggactctctacgggtttggggttagaatggaaattagggtttgttgttatggttagg

SEQ ID NO: 3060 - DNA, 403 bp, Gerbera hybrid cultivar
actccacaaatcctcagatctcgaatcgatttgaagaaatccgaaaatgtcgggacgtggaaaaggaggaaaaggattaggaaagggaggcgccaagcgtcaccggaaagttctccgggacaacatccagggaatcatctaagccggcgatccggcgtctggccagaagaggcggcgttatttttattagcggtttgatctacgaggaaacccgcggtgttcttaagatctttctcgaaaacgtcatcagagacgccgttacctacacggagcacgctcgccggaagactgtgaccgccatggatgtggtgtatgcgttgaagaggcaaggccgtactctctatggattcggaggttagggttttgactttgtacattacaaaaagtcttgctattgctatca

SEQ ID NO: 3061 - DNA, 1413 bp, Amborella trichopoda
  misc_feature (841)..(841): n is a, c, g, or t
gggctagtctgattttcctcgatacatcatctaaccaagttagtataaagattttcgccgacttaaaaaaaagcccactctctaacacacctcaatcccactctctaacacgcctcaatctcgttcacaggcttttctttttacaaaaagtccctctcatgaatgagccttgagtctgtcacactacaaaaatttcctctcatgaatgagcctcgagtctgtaaaatatctaaaccaagttacaggggtagctcaacaatcaaaaatttcctacaaaaaattggtgtatctaagccacaatttaaaaaaaaatcaaatatgaaaaacaacaccactagcatcaatctaaaaccctaaaaaatatgagtttcaataaaaatccaatacaaaaaaatcagaggtgaataaataacaataagggataccatctacaactaagttgcaagggcagctcaacaatcaaaaatatagtgcaagacttccaccaaaaaataagagtttcaataaaaaaaacccaataaaataaaaatcagaggtgaagccatgaaactcacctctgagtagcgagagggtatggtagttgctggtgtggagagagttgttgtggtctctgagcgtagagagagaattaatggttgagcgtagagagagaagggtgaggataacagggagagagagtagttgaaagggagacatagagagtagcaaaatgggtaatggtgagcgtagagagaaaagtaatagttgagcgtaaagagaaggttgagggtaacagggagagagaatagttgacaggggaagagagactggcaaaatggcgtagagagagaaaggtgagtancaggaagcccaggacccgaatttcgggtcctgggggaggtaagggactgggaaagggtggagcgaagaggcacaggaaggtgcttcgcgataacattcaggggatcaccaagccctgcaattcgtcgtttggctcgaaggggaggagtgaagcgtatcagtggtcttatttatgaagaaaccagaggcgttcttaagattttccttgaaaatgttatcagggatgctgttacctacactgagcatgcacgtaggaagactgtgaccgccatggatgtggtctatgctctaaagcgccaaggccgcaccctctatggctttggtggctagggtttggtctatggttcctagattttagtgatgtaaattctcatctattataaccactgtatctcgctcatatcttctttctcctatttctagctttgtttcttggttttttgaccttttgtagggtttctgtgatggaggttaggtacatttggggcttttgtattttgggttgaaaagttttggagtttcgtggtggtttattgaagaaacgaaatttaattgattttggggaaaaaaaac

SEQ ID NO: 3062 - DNA, 456 bp, Gossypium hirsutum
aatcagtcaacgttcagcgttcatagcagcaagtcttgcaacactaagttggaaactacataaaatcaaaatgaccggacgcggtaaaggaggaaaaggtcttggaaaaggaggcgccaaacgtcatcgtaaagtgttgcgtgataacatccagggaatcaccaagcccgccatccgtcggttagctcgtcgtggaggagtgaaacgtatctccggtttgatctacgaagaaacccgtggagtcttaaaagtattccttgagaacgtgatccgtgatgccgtcacttacaccgaacacgccaagaggaagaccgtcaccgccatggacgtcgtctacgctctgaaacgtcaaggacgtaccttgtacggtttcggaggttaaacgcatcatccgccacacacacacaccaccttttataataaaaaggcccttgttgtctcgtcctctgcctgatg

SEQ ID NO: 3063 - DNA, 617 bp, Ipomoea nil
  misc_feature (24)..(27): n is a, c, g, or t
  misc_feature (40)..(40): n is a, c, g, or t
  misc_feature (59)..(59): n is a, c, g, or t
  misc_feature (113)..(113): n is a, c, g, or t
  misc_feature (176)..(176): n is a, c, g, or t
  misc_feature (196)..(196): n is a, c, g, or t
gggggggggactacttactgactnnnnacactactacttnataaaggcactgagatggngacatgcgcgctttgcagtcgacctagactttccaaagattcggcacgaggatntcaacagcgaattttccgaagagtctgggcgtggaaagggcggtaagggtttgggaaagggangagctaaacgacatcgtaangtcctccgggacaacatccaaggcatcacgaagccggccattcgccgtctggctcgccgtggaggagtgaagcgtatctccggcctcatctacgaggagactcgcggcgtcctcaagatcttcctcgagaacgtcatccgcgacgctgttacctacactgagcacgctcgccggaagacggtcaccgcaatggacgtcgtctatgctctcaagagacagggccgcactctgtatggattcggcggttagaatttcgtatcgccggtgtatattttggtggtgtttaggtctagggttgatgattagggttaaactgggcgttctattttgaatcaatctccgattgatgattgttggaatgttaatctgatcttagatccaatgaattttagttcttatgaatccttaattctctaatttt

SEQ ID NO: 3064 - DNA, 423 bp, Rosa hybrid cultivar
aaaattcaatttcttatcttccatcaaaatcaaattctctcttttcaaatttttctggtgaaaatgtcaggccgcggcaagggaggcaagggtttgggcaaatgagcacccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgttacttacaccgagcacgcccggaggaagaccgtcaccgccatggatgtcgtctatgctctcaagaggcaaggaaggactctctacggatttgggggttaaatcagtgtagggttggttccaggatttgggtttagatctgggtgtaat

SEQ ID NO: 3065 - DNA, 1504 bp, Volvox carteri
gtacgctacatccaaggatggtggtgttaagaaacaccggatagttgaagataatgaagtcgttatgacgatcagccaccaaagccatacagggtgcggccctggcgcttaagtgcgtatacgacgtccatggctgtgacagtcttgcggcgagcgtgctcagtataagtaactgaatcacggatgacgttctccaggaagttcttgaggaccgtgcgggtttcctcgtaaatgagcccgctaatacgctttacaccgccacggcgagccaatcgccgaatggcaggcttggtgatgccttggatgttgtcacggagaactttgcggtggcgctttgcaccgcccttgcccaggcccttgccacccttgccgcgtccagacatggtagtggtgatataacaatgtgaggacacaagagcagaacacggtcgaaagtgttgcgtttatagtgttatccaagctattcgtatttatagctttggtttggacattaccactatgttcgagtttgttttggatcggctcagcggggcaacggaagtcgtacaaccacctccgcaaaattcataacacaccctaaaatgacgctgcaagattctaactgggaagagctctagaggtgcacttgattcttacttaactttgatacagaatggcccgtactaagcagactgcgcgcaagtcgaccggcggcaaggcgccccgcaagcagctggccaccaaggcagcccgcaagactccagccaccggcggcgtcaagaagccccatcgctatcgccccggcacggtaagacaccatacatatcttcattcaatttcgtaaaccgcctcaaactctggaccccaattgtcctgccctgccgctccttccctgttggacccctacaggtcgctctgcgagagatccgcaagtaccagaagagcacggagctgctcatccgcaagctccccttccagcggctggtgcgcgagatcgctcaggacttcaagaccgatctgcgcttccagagccaggcggtgctggcgctgcaggaggctgctgaggcctacctggtgggcttgttcgaggacactaacctttgcgccatccacgccaagcgcgtcaccatcatgcccaaggacatccagctggcccgtcgcatccgtggcgagcgcgcgtaagaggtccaggacagccctcaaagcaaaatccggtgtttttcaacaccaccgtgaaattgaggatttgctgcttaggcggcgggactcatgattggtgttgcaacttcttagtcgccatgattgtggattgtatctacgcgtgtgttgctgaaggtatgggcggcattcgatgccaggcattcgtaactttggaaggtcatgcaggttaccaaattatggagttaggctttcattacatttccatcgcggttttactataccggtttcgtacgggttagatccatgctctgtcgaaaatgccgctacgcaaagcgtttcgatttcaaccctttcctatgaattc

SEQ ID NO: 3066 - DNA, 1580 bp, Volvox carteri
ttaaccgccgaagccgtacagggtccggccctggcgcttgagggcgtagacgacgtccattgcggtcacagtcttgcgacgagcgtgctccgtataggtgaccgagtcacggataacattctccaggaagttcttgagcacagtgcgggtttcttcgtaaatgagaccgctgatgcgcttaacaccgccgcggcgagccaggcggcggatggcgggctttgtaattccctggatgttgtcacgaagaaccttgcggtgacgcttggcaccgcccttgccgaggcccttgccgcccttgccgcgtccagacattgccaattgttcacttcttgggcagcaacacggcatggatgtttggcaacacaccgccggacgcgatggtcacatcgccaagcagcttgcccagctcctcgtcattgcggatggccaactggatatggcgtgggacgatgcggttcttcttgttgtcgcgagcagcgtttccggccagctccagaacctcagcggtgaggtactccaggacagcagccaggtacacgggagcaccagcaccgatacgctcagcatacttgcccttcttgaggtagcgcgcaatacggcccactgggaactgcaggccagccttagcgctacggctgacggccttcttgccagcggtcttacccttgccacggccagccatttcagatttatgataatataaaagataaaaggagatactgtgtggatgtacaccgaacatgtttcttggttcttaaggaatttatcgcatggcggttgccccggtgagcccaaccacttctgaccgttaccgttggaaacttgtcccggtgagccatacctgtcttcgtataaacctccttatggttcgcctgaaagcgcaagagttctactgttacctgcaatatcaacatccactcatttactactcgtcaaatatggccccgaagaaggaggagaagcccgcatcccaggccgctgaggctcctgaggttaaggctgaggctaagcccaaggctgtgaaggctcccaagaagaaggagaagaaggcgccggctaagaaggtcgccaaggagccttccgctggtggggaggatggcgacaagaagtccaaaaagaaggccaaggttgccaagagtgagacctacaagctgtacatctataaggtgctgaagcaggtgcaccctgacaccggcatcagctccaaggcgatgagcatcatgaacagcttcatcaacgacatatttgagaaggtcgccaccgaggcttcaaagcttagccgttacaacaagaagccgaccgtcacgtctcgcgaaatccagactgccgtgcgccttgtcctgccaggcgagctggccaagcacgctgtgtccgagggaaccaaggctgtcaccaagttcacgtccgcttaaatttcgtccgcgtgacctgctcaaaatccggtgtttttcaacaccacctaaatctaatggatctttttagtagtctactatcaagtctacatgacttgcgcttccctcggctaagtgcttcccgaatatcgtacatcggtattcaagagtttatgacgatccgatatc

SEQ ID NO: 3067 - DNA, 478 bp, Ocimum basilicum
  misc_feature (46)..(46): n is a, c, g, or t
  misc_feature (135)..(135): n is a, c, g, or t
  misc_feature (254)..(254): n is a, c, g, or t
  misc_feature (258)..(258): n is a, c, g, or t
  misc_feature (366)..(366): n is a, c, g, or t
  misc_feature (380)..(380): n is a, c, g, or t
gcagctttttatacttgctaaattaaaatttcaatttcatcaaaangtctgggcgcggcaaaggaggtaaggggctggggaagggcggagctaagcgtcaccgcaaagtgcttagggataacattcaaggaatcnccaagccagccattcgtcgtttggctcgtcgtggcggtgtcaagcgtattagcggtcttatctacgaggagactcgcggagttctcaagatctttttggagaatgtcattcgtgatgcngtcncctatactgagcacgctcgccggaaaaccgtcactgccatggatgttgtgtatgcgttgaagaggcaggggcgtactctgtatggttttggtggttgagtgattagantggggcgtaaatgncctgctcttgtagaatttagggctgtttattgagctttgttaggttgtatcttcagatgctgactttctgcagtggtctatatgagatctcattttac

SEQ ID NO: 3068 - DNA, 500 bp, Lactuca sativa
aaacaaaaacaaaatgtctggaagaggaaaaggaggcaagggtttgggaaagggaggagcaaaacgtcaccggaaagttctccgtgacaacatccagggaatcacaaagccggcgattcgccgtcttgcgaggcgtggtggcgttaagcgcataagcggtcttatctacgaagagacacgtggtgtgttgaagatcttcctcgagaacgttattcgtgacgctgttacttacacagaacatgctcgccggaaaaccgttactgcgatggacgttgtctatgcattgaagcgtcagggtcgtactctgtatggattcggtggttgaggtaacatagggtctgtattgttaggttattttgagatttccgatttccttcgttttgttgtggaaatgtatgatatatcagtttaattgaagctcgattgtgacttggataatttgtaatcagcatccataatcacaaacaaaagatcaatttataaattttgaagttctatct

SEQ ID NO: 3069 - DNA, 415 bp, Helianthus annuus
  misc_feature (398)..(398): n is a, c, g, or t
aacaaacaaacaatgtccggacgaggtaaaggaggcaaggggctgggaaagggaggagcaaaacgacaccgtaaagttctccgtgataacatccaaggtatcaccaagccggctattcgtcggctggcgcgccgtggcggcgttaagcggatcagcgggctcatctacgaggaaacacgcggcgtgttgaagatctttctcgaaaatgttattcgtgatgcggttacatacactgagcatgctcgtcggaaaactgttactgctatggatgttgtttatgcgttgaagcgacagggccgtactctgtatggttttggtggttagggtttgttttttacagatttgttggtttaaattttttcatgtgtttgtgtaattgaagtttctagtgaattgcnaactttgcattttatga

SEQ ID NO: 3070 - DNA, 386 bp, Tropaeolum majus
tcatcaactcaatctgaaatcatcaatttacgtttttattcaattcctaaagagaatcattcagcatgtcaggaagaggaaagggaggaaaaggtctcggaaagggaggagcaaagaggcacaggaaggtattgagggataacatccaaggtatcaccaaacctgcaatccgcagacttgctcgtagaggaggtgtaaagagaatcagcggtctgatctacgaggagactcgtggtgttctcaagatctttctagagaatgtgatccgtgattcggttacatacaccgagcatgctaggaggaagacagttactgctatggatgttgtgtatgctctaaagaggcaaggtcgtactctttacggatttggaggtttaaggtcttag

SEQ ID NO: 3071 - DNA, 458 bp, Ocimum basilicum
  misc_feature (62)..(62): n is a, c, g, or t
  misc_feature (393)..(393): n is a, c, g, or t
  misc_feature (430)..(430): n is a, c, g, or t
  misc_feature (432)..(433): n is a, c, g, or t
gcaccacgttcgggaagaggaaagggcggaaagggattgggcaagggcggtgccaagcgccnccgcaaggtgctgagggataacatccagggcatcacaaagcccgcgatccgccgcctggctcgccgtggcggcgtcaagcgtatcagcggcctcatctacgaggagacgcgtggcgtcctcaagattttccttgagaatgtgatccgtgacgccgttacctacaccgagcacgctcgccggaagactgtgacggcgatggatgtcgtctacgctctcaagaggcagggccgaaccctgtacggcttcggtggttaagcttgtgtagttgttgagatatctgtgctcgatgtatttaatagttactttctatttgctgtgatttggattagnctgtagtattcatcaggtacttttcaagctgcaatangnntcatcgatgtgttccgatttcattt

SEQ ID NO: 3072 - DNA, 2890 bp, Mimulus guttatus
aaacaataacaactgcttcataatttcttcgcatcgttttctactacttccttcgctgaaaaaatgtctggccgtggcaagggaggcaaggggctgggcaagggcggagcaaaacgacaccgtaaggtgctccgtgacaacatccagggcatcacgaagccggcgatccggcgtctggcgaggagaggcggagtgaagagaatcagcggcctgatttacgaggagaccagaggtgttctgaagatatttttggagaacgttatcagagacgccgtcacctacaccgagcacgccaggaggaagaccgtcaccgccatggatgttgtctatgctctcaagaggcagggccgtactcttgatggctgtttattgctatccacatgtttgctgatgccacatattttccacgtcagcaaattttcgaaaaataataaaatctttcttcgccgttggatctcgccgttgacggaattaatgttaaaaaaatgcgttcagctcactggtagagagagaaaaaaaatggagccccagattttgacggttaaaccccagggattctatttaattcccaatacttacaaaaattgcatcactcgccgacgccacgtcagtgttcctcgttgttgccgtcgccttcccgaacattccggcgaagcacgtgcgccgaaacgtcgagatgtcttaattaccccgctcctcgccctcggagcttatgcactccgtaccgcggtggcgaaggccgacgacaagccggctttggaaggcggagcgcagattccacagccatcgcagcagggggcagttggctcgcaggaggaggccgccgcggatccggcggcgaaggaggaagtgattaattcgaggatttacgacgcgacggtgattggagagccgatggcgttgggcaaagacaagagcaaggtgtgggagaagatgctggatgcgcgggtcgtgtatttagcggaggcggagcaggttccagttcccgacgataaagagttggagcttgaaattgtgaaaaagctgaacaagagatgcgtggaatccgatcggcctattgctttggccttggaagcttttccctgcaacttacaggaacagctcaatcagtacatggataaaaggattgatggacaaaccctaaaatcattcgtaacacattggccacctcagcggtggcaagaatatgagcctctattgacttactgcatcaataatgggattcggcttgttgcttgtggggtcccacttgaggttctaagaacagttcaagctgaaggtgttcttggtctttctaaagtcgatcgtaaaaaatatgctccgccagctggctcgggcttcatctcgggtttcccttccatctctcggagatcatccatggacaacaattttcccaatcagtctgctacatttggcccaatgtcgtatctttcagtacaagcaagagctgttgaggattacacaatgtcgcagattatattacaagctgtgtccgatgtggggtccactggcatgcttgttgtagtaacaggggctagccatgtcacgtatgggtccaggggaactgggctgccagcaaggatttcgaggaaaatgcagaagaagaatcaagtggtgattttactcgacccggagagacagtacatacgaagggaaggcgaggccccgattgcagatttcttgtggtattctgcagcaagaacttgcaatagaaattgcttcgatcgtgctgaaattgctcgcgttatgaatgcagctggcagaaaaagagatgccttaccccaggaccttcaaaacggacttgatcttggtctcgtatcaccagaagttcttcaaaacttctttgatctggagaaatatcctcttatctcagaattgactaaccgattccagggtttcagagagagattattggcagatccaagattcctacaaagattagccatagaagaaacaatctcaatcacaactactctgttagcacagtaccaaaagcgtaaagagaatttcttcgaagagattgattatgttgtgacagatacgctgaggggaatagttgttgactttttcacagtgtggcttccagcgcccacgttgtcattcctctcgaatgtcgacgacatgaatccacctggcagtgtggaggcattaaaaggtcttcttggctcaattccggataatgcgtttcagaaaaatcttgcagggaaggactggaatttgaatcacagaatcgcgtcagtatttgtcggagggtttaaacttgccggggttggatttatttccagcatcggtgcagtagcttcctccaatgtactgtatgcaatacggaagcttcttagttcgagttttgataacaagcaagggaatagacggtcgcctgtactgaaaacagcactcgtgtatgcttcctttcttggaacatcggctaatctacgttatcaatttattgccggaattgtggagcatagaatatcggagcagttctctgaccagacattacttgtgaacatgatatcttttgtggctcgaacaatcaactcctactggggaacccagcaatggattgatctggcacggtatacagggctgcagtctcgtaagaacgaagaagttcagtctcaaattccagatccttcaactaatactgcatcggaatgcaatactgtagaagataccaccacgattgatgaaacaaacaagcaatagaaacttttgccttcggtacctttttttttttttttttttaattaatttaaatttgtaccgtcagaaattccgggcataagttatatatatagtacagaatgtaggaaacagaaccacacctatgtcattacaatggcacatacttgcatgcagttcaatatacctgttacttattcttccttcc

SEQ ID NO: 3073 - DNA, 453 bp, Avena sativa
tccccacctcttcttctcggagctcctctggcaagggaggcaaggggctgggcaagggcggcgccaagaggcacaggaaggtgctgcgggacaatatccagggcatcaccaagccggcgatccggcgcctcgcgaggaggggtggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgtaccctctacggtttcgggattccgtcagggcttagatctctctgtctgtttgtgcttagtgtttttaggatctcggtactatgcgtgagttgtttgggagcgatggcatgtagtctgtgatggaatttgttgcatatggatggatgaa

SEQ ID NO: 3074 - DNA, 505 bp, Avena sativa
aaaacaatccacccaagaaaagcagcaccaggagaggcaagggcggcaaggggctcggcaagggcggcgcgaagaggcacaggaaggtgctgcgcgacaacatccagggcatcaccaagccggcgatccggaggctggcccgcaggggtggcgtgaagcgcatctcgggactcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcaaggcatcgcgattagttaggtcttttcaagggattggtcgtcggatctctgcagttgctgtaatctctatctgcttgttgttgttgaatggtggtagtgatgtatgaacaaactgttgtcatgttggtttccaagaatttaatcacttcaaatctcttgcagagataatgttgtt

SEQ ID NO: 3075 - DNA, 469 bp, Avena sativa
gatctcacatctcacaccagaaaaaaaatccccaatctccacccgtccttctccaagctcatctggcaagggaggcaaggggctcggcaagggcggcgccaagcgccaccggaaggtcctgcgcgacaacatccagggcatcaccaagccggcgatccggcgtctggcgcggaggggcggcgtgaagcgcatctccggcctcatctacgaggagacccggggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggtgtgggcttctctgtcagcgtgcgtgtattagggtttcggttgtgtgtgtgctgtttgggagcgctggtatgtagtttgtgatggaacttgttgcatatggatgaaggaatg

SEQ ID NO: 3076 - DNA, 446 bp, Avena sativa
aaaattccccaatctccacctgttcttctccgagctcctctggcaagggaggcaagggactcggcaagggcggcgccaagaggcaccggaaggtgctgcgcgacaacatccagggcatcaccaagcccgccatccggcgcctcgctcgccgtggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggtgtgggcttctctgtcagcgtgcgtgtgttagggtttcggttgcgtgtgtgttgtttgggagcgctggtatgtagtttgtgatggtacttgttgcatatggatgaaggaatg

SEQ ID NO: 3077 - DNA, 504 bp, Avena sativa
aaaacaatccacccaagaaaagcagcactaggagaggcaagggcggcaaggggctcggtaagggcggcgcgaagaggcacaggaaggtgctgcgcgacaacatccagggcatcacgaagccggcgatccggaggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcaaggcatcaggattagttaggtctttcgagggatcgctcgtcggatctctgcagctgttgtaatctctatctgcttgttgttcttgcgtggtggttgtggtgtatgaacaaactactgtcatgttggtttccaagaatttagtcactgcaaatctcttgcagagctattgttgtt

SEQ ID NO: 3078 - DNA, 671 bp, Saccharum officinarum
  misc_feature (473)..(473): n is a, c, g, or t
  misc_feature (478)..(479): n is a, c, g, or t
  misc_feature (622)..(622): n is a, c, g, or t
aaaatccccaaatcttcctcgccccaaatccactcaaacctccgttcttcaacgggcttctggccgttcgtctcgaagcagcaggcagccatgtcgggccgcggcaagggaggcaagggcctgggcaagggcggcgccaagcgccaccggaaggtgctccgcgataacatccagggcatcacgaagccagcgatccggaggctggcgaggaggggcggcgtgaaacgcatctccgggctgagatataagaagacactcgcggtgcgctaaatatttttctagagaacgtcatccgcgacgccgtcacctacacggagcacgcccgccgcaagaccgtcaccgccatggatgtcgtctacgcgctcaagcgccagggccgcaccctctacggtttcggcggctgagccttggctccgtccgcgtcctctggcatgtggttgtggtcaggtgctagctaggttgttgatggatangaaanntttggttcttttgggtgggggtttggacttgtgcttaatgtttataaacggaagattgggaacccttaataaatttgaaaggattggggattgtttcaattaattcttggggtttaatttccccattggaattcaactttggntttctggcctttggaattcaattaaaatttttttttcccccttatcggg

SEQ ID NO: 3079 - DNA, 456 bp, Triticum aestivum
  misc_feature (294)..(294): n is a, c, g, or t
  misc_feature (312)..(312): n is a, c, g, or t
  misc_feature (353)..(353): n is a, c, g, or t
  misc_feature (397)..(397): n is a, c, g, or t
  misc_feature (419)..(419): n is a, c, g, or t
  misc_feature (442)..(442): n is a, c, g, or t
ccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaggagacccgcggcgtgctcaagatctttctcgagaacgtcatccgcgacgccgtcacctacacggagcacgcccggcgcaagaccgtcanagccatggacgtcgttangcgctcaagcgccaggggcgcaccctttaaggcttcggcgntaaggcgctaggctaggccatgctcgaaccgcccccattttcgnttgggtcgtactggttcttgancctgtgcgggtcggtcggtggtntaaggtaacagttg

SEQ ID NO: 3080 - DNA, 499 bp, Triticum aestivum
  misc_feature (459)..(459): n is a, c, g, or t
  misc_feature (474)..(474): n is a, c, g, or t
cagcaccagtccccaattatttggcctccgtcagagaggggagaaagacccgttcgaggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaactcatacgcgacgccgtcacctacaccgagcacgcgcgccgcaagaccgtcaccgccatggatgtcgtctacgcgctcaaacgccaagggccgcacctctacgcttcggaggtagggcctcttcgtactggggaatgctaaggtgatactctcttcctgtggtctatgttctgcgtcctggattatcaatttttttcncaatgaaaaatctgnaaacatatactgcaaaaaaaaaaaa

SEQ ID NO: 3081 - DNA, 400 bp, Helianthus annuus
cactttggttccaaacatgtgcggtttgtgaaagggcggaaagggtctcgggaagggcggagctaagcgtcaccgaagagtcctccgcgacaacattcagggaataacaaagccggctattcgaaggctggcgagaagaggtggagtcaagagaattagtgggttgatttatgaggagacccgtggtgttttgaagatatttttggagaatgtgattcgtgacgcggttacttacaccgagcatgctcggaggaaaacggttactgctatggatgttgtgtatgctcttaagaggcaggggcgaactttgtatgggtttggtggctaattttttttttttgattagtttgttgaatggattgtaaggatttacgtgtttgaatgaaatgttggattatgg

SEQ ID NO: 3082 - DNA, 361 bp, Artemisia annua
tactccgacggggacacacaatcacacaaaacccaaatccaaacacacccaattcaaaaaaaatgtcaggaagaggaaagggaggaaaaggactaggcaaaggaggagcaaagcgtcacaggaaggttctccgtgacaacatccaaggtatcactaaacccgccatccgtcgtcttgctcgtcgaggtggagtgaagcgtatcagtgggcttatctacgaagagacacgtggcgttctgaagatctttttggagaatgtgatccgtgatgctgttacctacactgagcacgctaggaggaagactgttactgctatggatgttgtctatgctctcaagaggcaaggaaggactttgtatgg

SEQ ID NO: 3083 - DNA, 519 bp, Festuca arundinacea
  misc_feature (374)..(374): n is a, c, g, or t
ggcacgaggcggcaagggaggcaaggggctgggcaagggcggcgccaagcgccaccgcaaggtgctccgcgacaacatccagggcatcaccaagccggccatccgccgcctggcccgccgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctagaggcctcgcctcctcctcctcgtctgcgccgaacccgtcgcctcctcgtcgtcaacagcctgtngtcttcctcagtgtgttctgttcagtagatgtagttggaaccatgttaccactagttcttcagttgtccatcgcaaatctatccagctagcctgtaatagctctgtatgagcgcagatctgaattcgaatatattatcttccccc

SEQ ID NO: 3084 - DNA, 498 bp, Festuca arundinacea
ggcaagggaggcaaggggctcggcaagggcggcgccaagcgccaccgcaaggtgctccgcgacaacatccagggcatcaccaagccggccatccgccgcctggcccgccgtggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggattcggcggctagacccccgtcgtcttcttccgcgccgcctgctacacatcccagttcctttcgtccgcctgtgcttgcgagtctcgcggtcaagaaagcttagatggaattgcatacatcccaccctgtttagttcaccgtttcattactagtactagatcgaactgtaccgtcaaagttgttcgcacttgaatgtcgaattcaggcttg

SEQ ID NO: 3085 - DNA, 505 bp, Senecio madagascariensis
ggaaagggaggaaaaggactaggaaagggaggagcaaaacgacatcgtaaggttctccgcgacaacatccagggtatcaccaaacccgctatccgtcgtctggcccgtagaggcggtgtcaagcgtatcagtggtttgatctacgaagagacacgtggcgtcctcaagatctttctagaaaatgtcatcagagatgctgtcacctacaccgagcacgctcgccggaagaccgtcaccgcaatggacgtcgtatatgctcttaagagacaaggccggactctctacggtttcgggggttagggttttgtttttagatctgaggataagtcttgctgtcaagaaagaaatgggtcgggtttcaatcgggtcaaaaaggattaggtgtatttggttattgtttagttttaattttagtgatttttactgtttgttgaaatagaatgtagttaatgtttaatgaaaaaagttaattatgttcatttgttgttttagtctgttataaaaa

SEQ ID NO: 3086 - DNA, 448 bp, Euphorbia esula
gaagaggaaagggagggaagggattggaaaaaggaggagccaagaggcaccgcaaagttctccgagataacatccaaggaatcaccaagcctgccattcgtaggctcgctcggagaggaggcgttaagcgtatcagcggtttgatttatgaagagacacgtggcgtgctcaagatcttccttgagaacgtgattcgtgatgctgttacttacactgagcatgcgaggagaaagactgtgaccgccatggatgtggtttatgctctcaagaggcaaggtcgcactctctacggctttggcggttaattgattactttttttatcattgattagtggttgcttaaattcctaattgagattctagcgcctgtatattttagatctaagttgattgtgttgaatgaagtttttgtgttgcaaatgaatcattatcagtctttatgtgctcc

SEQ ID NO: 3087 - DNA, 531 bp, Saccharum officinarum
cggcgaatttgaatcccacaatctttttatcacaccactacaccagcgtcttcctctggggcagtgatgtctgggcgcggcaaggcccgcaaggggctgggcaagggcggcgcgaagcgccaccgcaaggtcctccgcgacaacatccaggggatcacgaagccggcgatccggaggctggcgaggaggggcggtgtgaagcgcatctccgggctcatctacgaggagactcgcggcgtgctcaagatcttcctcgagaacgtcatccgtgacgccgtcacctacaccgagcacgcccgccgcaagaccgttaccgacatggacgtcgtctacgccctcaagcgccagggccgcaccctttacgggtatggcggatgagcacgtgcgccttttcttcgtcctatgcagcagctgctcgtatacgccttacatactcctttcagatccctgatacgtgctttccttgatgtagaacagtatcaggatagttaggtatgtgccaggtcttgataataggtggaataatgatgt

SEQ ID NO: 3088 - DNA, 554 bp, Nicotiana tabacum
catgcggccgctcacaatctcacaagttttttcttttttaactttcaactaaaatgtccggacgtggtaaaggtggtaaagggctcggaaagggaggagccaaacgtcatcgtaaagtcttacgtgataacattcaaggtatcactaagccagccatccgtcgtcttgcacgtcgtggtggtgtcaaacgtatctctggtttaatttatgaagaaacccgtggtgtattaaaggtctttcttgaacatgtcattcgtgatgcagttacatatactgaacacgctcgtcgtaagacagttactgcattagatgttgtctatgtcctcaaacgtcaaggtcgtacactctatggtttcggtggttaagaacttgcatacccccagtataccatttctcatttcaattcgacttacacgcatatgtgtattgtcattcatttgtcatctcaccggtgaatctattcaccaccccatactcactaagaaagtgtatcccattttttgtttcgtctacgctgctgttttacaatgttatcaatttactgcatgtcttct

SEQ ID NO: 3089 - DNA, 461 bp, Brassica napus
gaaaaacatttcgagcatgtctgggcgaggaaagggaggaaagggactgggaaagggaggagccaagaggcacaggaaggtcctccgagacaacatccaggggatcactaagccggcgattcgtcgtttagcgaggagaggcggtgtgaagcgtatcagcggtttgatctacgaggagactcgcggcgttctcaagatctttctagagaatgtgattcgtgacgctgttacttacactgagcacgctaggaggaagaccgtgacggcgatggatgttgtgtatgctttgaagaggcagggaaggactctgtacgggttcggcggctgaggggattcaattaggggtttttaaatcgcgtttgtgtttttacggtttggttctatttgggagtttaacaactctctaagttgtctttatctgaatgttttaaaaaagctttatctgaacttgtccgtctctt

SEQ ID NO: 3090 - DNA, 360 bp, Secale cereale
ccaaatccagctacgatgtcagggcgcggcaagggcggcaaggggctgggcaagggcggcgccaagcgccaccggaaggtcctccgcgacaacatccagggcatcaccaagccggcgatccggaggctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgctctcaagcgccagggtcgcaccctctacggcttcggaggctaaatgtgcaatggtaccggcagtggggcaactccc

SEQ ID NO: 3091 - DNA, 497 bp, Triphysaria pusilla
  misc_feature (22)..(22): n is a, c, g, or t
  misc_feature (76)..(76): n is a, c, g, or t
tttcaatcagctaaaaatgtcnggccgtggcaagggaggcaagggcttggggaagggtggagcaaaacgacatcgnaaggtgctgagggacaacatccaggggatcacaaagcccgctattcgccgtttggcccgcagaggtggcgtcaagcgtatcagtgggctcatctatgaggagactcgtggtgttttgaagatctttttggagaatgtcattcgcgacgctgttacctacactgaacacgctcgccggaaaactgtcactgccatggatgttgtttatgctttgaagaggcaaggccgcactttatacggcttcggcggttgatatttctgagttttgttctcgattatcttcggcttggatttgtcttttgtgatttgttagaatttgcagaaatgtgcatggtttgatccagactttatttttgcttttggagtgtttgttgactgaatctggagaaagtttattaaaaattgaaaactattcctacgta

SEQ ID NO: 3092 - DNA, 523 bp, Triticum aestivum
aaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattaaagtgtctggggttcgtggtcgttgattctgtgtctgattcgtgataaaatcgttcgattgcgttacctgtctaccattctaccccaaatccctgtacgaatcacatcgatcttattcaagttccaaatccgtcgagttataacttcaggcgtcgacattggcgcatctgcgttgc

SEQ ID NO: 3093 - DNA, 548 bp, Brassica napus
ccgtgcaggccatttaggccgtggaaagggtggcaagggcttaggcaagggcggagcgaagcggcaccgaaaggtcctaagggacaacatccagggcatcaccaagccggctattcggcgtctcgctcgtcgtggcggggtgaagcgtatcagcgggctgatttatgaggagacacgtggcgtgttgaagatatttttggagaatgttattcgtgatgctgttacttacaccgagcatgccaggaggaagactgtcactgctatggatgttgtctacgctcttaagaggcaaggacgtactctctacggttttggcggttgattgattcataatcgattttcctttggttcggtttggttcggttcgggtaggggttgtagatgagatatggtagtttgtttggttggtttggtttgttgttattgttggttccgatttggctgatgaatttgtaattgaatcaagttttatgaaggagtcaaattacgtgtcttggctaatctatttggtttgtttggatttatgaaatgttaactccttcaatcga

SEQ ID NO: 3094 - DNA, 526 bp, Cicer arietinum
tcagaaattcaaaatgtctggccgtggaaaaggtggaaagggtttcggaaagggtggagcaaaacgaccccgtaaagtattccgcgacaacattcaaggaataacaaagccagcaattcgtcgtcttgttcgtagaggaggagtgaaacgtataagcggtttgatttacgaagagactcgtggtgtactcaagatctttctttagaacgtgattcgtgatgctgttacttacactgagcatgccaggaggaagactgttactgctatggatgttgtttatgctcttaagagacaaggaaggactctatatggatttgggggttaaattagggttagggtttcttgtcgatctgttttctttggttgtagttgatgtttgtgtttattttgggagggaaattgaatgttaatgattgggggttcttagggatttgaaaaatattgttgatgtgtttgatatgaatatgtttgcagcagcaatcttgtaatccaatcattataatgtcaatgttacaaccatatatca

SEQ ID NO: 3095 - DNA, 543 bp, Avena sativa
ggcaagggcggcaaggggctcggcaagggcggcgccaagcgccaccgcaaggtcctccgcgacaacatccagggcatcaccaagccggcgatccgcaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggggccgtggcagaagtcttggctcgcggtcaagaaactggaggggaggataactgttctagatccgtgttctatgcctagttccattggtagtagtagtagtagcatcatctgcagtagttcagtgtttgctttcatgttctcaccttctgatgggcaaatatgttgtttgccgagttgtatgttttcagtattaacaaggttatccttcagatatgaattgtgctattgatttatgccctgcttccttgg

SEQ ID NO: 3096 - DNA, 508 bp, Avena sativa
aagtcaacctcaccagtagccaccggagaagcgggcaagggaggcaagggtctgggcaagggcggcgcgaagcggcaccggaaggtgctccgggacaacatccagggcatcaccaagccggcgatccggcgcctggcgcgcaggggcggcgtgaagcgcatctcggggctcatctacgaggagacccgcggcgtgctcaagatcttcctcgagaacgtcatccgcgacgccgtcacctacaccgagcacgcgcgacgcaagaccgtcaccgccatggacgtcgtctacgcgctcaagcgacagggacgcaccctctacgggttcgggtcttcagggatggaagaagttagggaatggtgttgttgttgttcgttagggttcgtgtgtcgttggtgtggtatgtgtgtctctgatgtctcctgctgttgtgtcttgttcatgtttggatgttgtactaggatgatgagctgaacctctggttcggcagaatggaatgagaatttcacta

SEQ ID NO: 3097 - DNA, 601 bp, Avena sativa
ctccgcaccaaccaccgcacacagacaagtcaacctcaccggagaagcgaaggcaagggaggcaaggggctgggcaagggcggcgcgaagcggcaccggaaggtgctccgggacaacatccagggcatcaccaagccggcgatccggaggctggcgcgccgcggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggacgcaccctctacggattcgggtcttcagggatggaagaagttagcgaatgctgctgttgttggttagggttcgtgtgtcgtctgtcgcgcatgctgatgttgtttcctgttagtgtcttgttcatgtttggatgttgtagtaggatgatgagctgaacctctggttcggcagaatggaatggaaatttcactagtagttttccttattttatttgcaatatctgcctctcttgatgctgatttgtgacaaaaatgttcaccagttcgttcagcaatt

SEQ ID NO: 3098 - DNA, 532 bp, Avena sativa
aagtcaacctcaccagtagccaccggagaagcgggcaagggaggcaagggtctgggcaagggcggcgcgaagcggcaccggaaggtgctccgggacaacatccagggcatcaccaagccggcgatccggcgcctggcccgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggtaggccgccaaggagggcgacccggggtcttcagggatggcagaagttagcgaatgttgttgttggttagggttcgtgtgtccttggtgtggtagctgtgggtcttgatgttgtttcctgctgctgtgtctagttcatgtttggatgttgtagtaggatgatgagctgaacctctggttcggcagaatggaatgggaatttcacta

SEQ ID NO: 3099 - DNA, 436 bp, Eucalyptus gunnii
  misc_feature (236)..(236): n is a, c, g, or t
  misc_feature (240)..(240): n is a, c, g, or t
  misc_feature (322)..(322): n is a, c, g, or t
  misc_feature (329)..(329): n is a, c, g, or t
  misc_feature (390)..(390): n is a, c, g, or t
  misc_feature (405)..(405): n is a, c, g, or t
  misc_feature (429)..(429): n is a, c, g, or t
aacgcattcaaccgaagctcctccccatcccgaaaccctagccaagctcgatcccatccatccgatccaatccaatccaatccatccatcgccatgtccggccgcggcaaggggggcaagggcctgggcaagggcggggcgaagcggcaccgcaaggtcctccgggacaacatccagggcatcacgaagccggccatccgccgcctggcccgccgcggcggcgtgaagcgcatcancggnctcatctacgaggagacccgcggggtgctcaagatcttcctcgagaacgtcatccgcgacgccgtcacctataccgagcacncccgccncacggaccgtcaccgccatggacgtcgtctacgccctcaagaggcagggccgcaccctgtncggcttcggcggttnagtgtggggggatcgggacccggnacatacc

SEQ ID NO: 3100 - DNA, 472 bp, Allium cepa
  misc_feature (111)..(111): n is a, c, g, or t
  misc_feature (128)..(128): n is a, c, g, or t
  misc_feature (135)..(135): n is a, c, g, or t
ctccaatcaatcagcaaaactctaatttcatcagtaaaatgtcaggaagaggaaagggaggtaagggattgggaaaggcggagccaagaggcacagaaaagtgttgagggncaacatccaaggaattnccaaccntgctatccgtcgtcttgctcgtcgtggtggagttaagaggattagcggtctcatttacgaagaaaccaggggtgttctgaaaattttccttgagaacgttatcagagatgctgttacttacactgagcatgctaggaggaagacggttactgctatggatgtggtttatgccctgaagcggcagggaaggactctttatggttttggcggttaacttaattttatatttatgtgtttggtccgtgggtttctgttctgtagtctggtgttaattcgaaagtttgaatcaatggatattatcttttcgtttatgctaaatttaatttgtctatttggt

SEQ ID NO: 3101 - DNA, 889 bp, Pinus taeda
  misc_feature (338)..(338): n is a, c, g, or t
  misc_feature (378)..(378): n is a, c, g, or t
cggccggggtgtgaagaagtttgtcgcagcgtgtagggttcgaattgcagcgaccgagtttcatttgaaagccccggtcgtgaagaaacaataacaatgtctggccgcggcaagggtggtaagggtttgggaaagggaggagcgaagaggcacaggaaggtactgagggataacatccagggtattaccaagcctgccatcagacgtcttgccaggagaggaggcgttaagcgcattagcggactcatctacgaagagaccaggggagtattgaaaatctttctggagaatgttatcagagacgccgtcacttacactgagcacgccaggcgcaagantgtcactgccatgaatgtcgtctatgcgctcaagaggcanggcagatccctccatggcttcggcgctgcttcatgcgcgagccgaccccatcaaaatgaaggtatagcggctgaggaagaactcgcagagtaccctcttatccatcctgaggcagcggcccccaggaagaatttctccgctctggaaggaagcacattcattcaacgctctatctgctcacccaggatagctattaccctgttctagatctgcaaaacttgttaagcttcctggatctaccgggacggatctcccggaaactctcttcggcggaacgcattgacaggcttattaatctttggacctttccctcttctactctcattcccctgcggcaaattcaggaggagaaggcccttcaaagctctagtcctctctcttctgagatttgcgaaagatggagccgggtagcaggagccagatctgacccagatctgcatgaagattcactcgttttccagatccaagtcaacctctcgggcaagacatcaatgcaatgggtacacgcaac

SEQ ID NO: 3102 - DNA, 531 bp, Secale cereale
  misc_feature (31)..(31): n is a, c, g, or t
  misc_feature (167)..(167): n is a, c, g, or t
  misc_feature (290)..(290): n is a, c, g, or t
  misc_feature (326)..(326): n is a, c, g, or t
  misc_feature (483)..(483): n is a, c, g, or t
gaccaccgctcccccaatcccactcgcgcancagctccaagaggatcgtcggcgaccatgtccgggcgcggcaagggaggcaagggtctcggtaagggcgcgccaagcgccaccggaaggtgtgcgcgacaacatccagggcatcaccaagccggccatccggcgcntggcgaggaggggcggtgtgaagcgcatttccggcctcatctacgaggagacccgcggcgtgctcaagatcttcctcgagaacgtcatccgcgacgccgtcacctacacggagcacgcccgcngcaagaccgtcaccgccatggacgtcgtctacgccntcaagcgccagggccgcaccctctacggcttcggcggctaggctcgtcctcgcccccgccagatggtcgtcagtcttcgtcgccgccagcagattccgatgtgttagtccgcccgttcctagtagtgttgtgctcaagaaatttcagatggaaaccnccttgtttccttatttcttctgtatgtttagttgattcttgtttttat

SEQ ID NO: 3103 - DNA, 592 bp, Saccharum officinarum
  misc_feature (348)..(348): n is a, c, g, or t
  misc_feature (359)..(359): n is a, c, g, or t
  misc_feature (398)..(398): n is a, c, g, or t
  misc_feature (417)..(417): n is a, c, g, or t
  misc_feature (562)..(562): n is a, c, g, or t
  misc_feature (592)..(592): n is a, c, g, or t
accaaatccccaattcccaacctcacctccgagtccaagcgaccatgtcagggcgcggcaagggcggcaaggggctgggcaagggtggcgcgaagcgccaccgcaaggtcctccgcgacaacatccagggcatcacgaagttggcgatctagaggctggcgaggaggggcggcgtgaagcgcatctcggggctcatctacgaggagacacgcggcgtgctcaagatcttcctcgagaacgtcatccacgacgccgtcacctacacggagcacgcccgccgcaagaccgtcaccgccatggacgtcgtctacgcgctcaagcgccagggctgcaccctctatggattcngcggctgaggngtgcccctccgccgctggtggccgtggcaaaagtcttgngtcacggtcaagaaatcgnaggaggcgagagtattctgcccatatgctagtttcgtagtcttatcggtagtgcttattgtacaggtttgttggttcgatcactctagagccatgtccagtagtagtatatgagttgtaccgcattttctttgcttctgaacttnccatgtatgaaatgtggattcacttgattn

SEQ ID NO: 3104 - DNA, 472 bp, Camellia sinensis
ggggattgcaactcatctttctcgttagctcaaagcccttaaagtttccactctgtgtaactttctctctctagaaaaatgtctggtcgtggcaagggcggcaagggtttgggcaaaggaggagccaagcgtcacaggaaggtcctacgggacaacatccaggtatcactaagcctgcgattcgtcgtctggctcgcagaggcggagctcaagaggatcaggtgggctcatctatgaggagactcgcgggtgttctcaagatcttccttgagaatgttattcgtgatgctgtgacctacactgagcacgctcggaggaagactgtgactgccatggatgtcgtctatgctttgaagaggcaggggaggactctctatgggttgggggttgagtttgtcgctggtgtcttgtaagggttgggtaaaggtaggtaagggggttgtaaatgggtggtggttttaggatcagggtt

SEQ ID NO: 3105 - DNA, 356 bp, Triphysaria pusilla
tcaagcttcaaaatcatctctcaattcaagtttccaaatctcaaacagcaaaatccgaaaatgtcaggccgcggcaaaggaggcaagggcttaggaaagggaggagcaaaacgtcatcgcaaggtgctgagggacaacattcagggcatcaccaagcccgcaattcgtcgtctggcccgcagaggtggagttaagcgtatcagcgggctcatctatgaggaaacccgtggtgtgttgaagatctttttggagaatgtcatccgtgatgctgtcacctacactgagcatgctcgccggaaaactgttactgcaatggacgttgtttatgctttgaagaggcagggccgcactctgta

SEQ ID NO: 3106 - DNA, 514 bp, Triticum aestivum
  misc_feature (454)..(454): n is a, c, g, or t
caccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctgggagaacgtcatccgcgacgccgtcacctacactgagcacgctcgccgttaagaccgtcaccgccatggacgtcgtctacgcgcttaacgccaaggccgtacctctacggcttccggcggtaagcctgccgcccgcgcctcgccgtcgctgcggttctggtgttgctgcaattcgcaagttgtttgtgttggggaaatttcctagatactggtanaactgcagtgccgtatgctcacatggtgtgtttgtccgaagaaatgttgtcattgctggg

SEQ ID NO: 3107 - DNA, 723 bp, Triticum aestivum
  misc_feature (159)..(159): n is a, c, g, or t
  misc_feature (171)..(171): n is a, c, g, or t
  misc_feature (305)..(305): n is a, c, g, or t
  misc_feature (486)..(486): n is a, c, g, or t
  misc_feature (498)..(498): n is a, c, g, or t
caccgttcctccgattccacaaccgctcgcacctcgagatcggcagccatgtccgggcgtggcaagggaggcaaggggctcggcaagggcggcgccaagcgccacaggaaggttctgcgcgacaacatccagggcatcaccaagccggcgatccggcgnctgccgcgtagnggcggcgtgaagcgcatctcagggctcatctacgaggagacccgcggcgtgctcaagatcttcctcgagaacgtcatccgcaacgccgtcacctacaccgagcacgcccgccgcaaggaccgtcaccgccatgnacgtcgtctacgcgctcaagcgccagggacgcaccctctacggttccggggggtagggcctgcaaattcaaaaagcttgatggaaccccgacttgtctaggtcgggtgctcctgagtgactcaattgaatcggggaacaagttaaccgcttggttttgttggcaaacaaaaaaaacaaccnccccgacacggngcgcctccggggggggcgtgccccaaatataccccgcgagggcccccaagttttcgcttccccgacttttttgtaaaagggggcccccattggggggtggtaaataagccaaggccgggccctggttttaaaaaggtgttgattggaaaaatggcaagttgggacctttgtgaaaaaccccttctttgtgggggggatatattggacaaccccccccaggggttt

SEQ ID NO: 3108 - DNA, 453 bp, Artemisia annua
aaagggaggaaagggattaggcaaaggaggagcaaagcgtcacaggaaagttctccgtgacaacatccaaggtatcaccaagcctgccatccgtcgtcttgctcgtcgtggaggtgtgaagcgtatcagcggtctgatttacgaggagacacgtggcgtcctcaagatctttttggagaatgtgatccgtgatgccgtcacctacaccgagcacgctcgccgtaagacagtgactgcaatggatgtggtttatgctttgaagaggcaaggaaggactctttacgggtttgggggttagagttgaaattagggtttgttgttatgttaggatgtggaagttgttatgtggttaagtttgttatgttttagatctggttaggtgcttgtgtagatggggtttgttacatcttgtaattgaatctctgtttcggattaatatgaatttaagtattt

SEQ ID NO: 3109 - DNA, 488 bp, Artemisia annua
acgagtgcgtggaggaaaaggattaggcaaaggaggagcaaaacgacaccgtaaagtcctccgtgacaacatccaaggtatcactaaacccgccatccgtcgtttggctcgtcgaggtggagtcaagcgtatcagtgggcttatctacgaagagacacgtggcgtgttgaagatctttttggagaatgtgatccgtgatgctgtgacctacactgagcacgcgaggaggaagactgttactgctatggatgtcgtctatgctctcaagaggcagggaaggactttgtatgggtttggtggttaggtgtttttgggattgggttttaagtcttgctgtcaagaaagaaatgtgtttagggtttaagtctgtttggaatttggatggtttagttagcgttttgttggtattgtatgtagttagtgtttgtggttagttgttttaatgatgaatcaagtaatgaagttgattttcgtaaaaaaaaaaaaaa

SEQ ID NO: 3110 - DNA, 318 bp, Artemisia annua
gaagggaggaaagggactagggaaaggcggagcgaagcgtcacaggaaagtgttaagagacaacattcaaggaatcacaaagccggctattcgtcgtttagctcgtagaggaggagtcaagaggatcagcggcttgatttacgaagagaccagaggtgttttgaagatctttttggagaatgttatccgtgacgctgtcacctacaccgagcacgctcgccgtaaaactgtcactgctatggatgttgtctatgctctcaaaagacaaggcagaactttgtacggattcgggggttaggttgattagtattatgttgt

SEQ ID NO: 3111 - DNA, 602 bp, Avena sativa
ctccccaaaaaactttcgcaaactttacaaactcaaactctccactcacccaacccccaaaacacaaatcaaacatgtctggacgtggcaagggaggaaaaggactcggaaagggaggagccaagcgccatcgcaagatccttcgcgacaacattcaaggtatcaccaagcccgccattcgccgtcttgcccgccgtggtggtgtcaagcgtatttctggtctcatttacgaggagactcgtggcgttctgaaaactttcctcgagaatgtcattcgcgatgcggttacctataccgagcacgccaagcgcaagaccgtgacctcactggacgtcgtgtacgcgctcaagcgtcaaggtcgcactctctacggctttggcggctaaaagcgctcattctcgctcgcgggggttccgcatcggtgtcgcgagtcgctttgacagtcgcttggcgttctctcgatgctttgtatataattcttttttttttttttccctcgttttcatcttgatgtattacattagcgtggtgatgaagcctttatttgcatggtgtggggatgcatttcggtttgtttgaaatataataagtttctcaggacc

SEQ ID NO: 3112 - DNA, 555 bp, Liriodendron tulipifera
  misc_feature (86)..(86): n is a, c, g, or t
  misc_feature (167)..(167): n is a, c, g, or t
  misc_feature (196)..(196): n is a, c, g, or t
  misc_feature (210)..(210): n is a, c, g, or t
  misc_feature (252)..(252): n is a, c, g, or t
  misc_feature (307)..(307): n is a, c, g, or t
  misc_feature (326)..(326): n is a, c, g, or t
  misc_feature (388)..(388): n is a, c, g, or t
  misc_feature (425)..(425): n is a, c, g, or t
  misc_feature (529)..(529): n is a, c, g, or t
  misc_feature (550)..(550): n is a, c, g, or t
tctccaaattccactcgaaactcctccgatactctcgaaaagaccgtaacagcagccatgtcgggtcgtggaaagggcgggaaggnccttggaaagggtggtgctaaacggcaccggaaggtgttgagagacaacatccaaggaattaccaagcctgccatcaggcntcttgcacggagaggtggtgtgaagcgcntcagcggtctgatntacgaggagacacgtggcgtgctgaagatctttctggagaangtgatcagggatgctgtgacctacacggagcatgctaggaggaagacggtcactnccatggatgtggtttatgntctgaagaggcaggggaggactctgtacgggtttgggggttgaggctatgggtgtttttgtnccttctgcgtatgttagcaaccactgggttgtgattntagggctctgtcttttggttttagggttttactttctttggtttgtaaattttcaacatgtggggatcttttgttgcaaatctgtggaaaatggagttgaaatntaatgatagtggcgttttctnccaca

SEQ ID NO: 3113 - DNA, 492 bp, Zea mays
atgtcggggcgcggcaagggcgggaagggcctgggcaagggcggcgcgctgcgccaccggaaggtgctccgcgataacatccaggggatcacgaatctgacaatccagcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccactagatcaagcatgttgtgcgtgtctgaagaaatgccaattgtgacttgctgtttgttcaaacatgctccatttcatcacgcc

SEQ ID NO: 3114 - DNA, 573 bp, Medicago truncatula
ggtacctaaaaccctttcattttattctttcacaaaaaacaaaaacataaaaaaatgtctggacgtggtaaaggaggaaaaggacttggaaaaggaggcgcaaaacgtcatcgcaaaattcttcgagataacattcaaggtatcactaaacctgctatcagacgtctcgcacgcagaggtggtgtaaaacgtatttctggtcttatctatgaagaaacacgtggagtcctcaaagttttccttgaaaatgtaattcgagatgctgtaacctacacagaacatgctaagcgtaagactgtaacgtctctagatgttgtctatgcactcaagcgacaaggacgtactctttacggttttggaggttaaacagtttcttaacactttaccatcaagaaacgagaagactaatattcaaatacgaccatatatctatctttctttatatactcaaactttttttcttcttttttttttttttatctcctcataatgcttggactctgtaaattaataataatattatgcgctcgtttcccaacagaataaatcgacgtatttgattgcataaaaaaa

SEQ ID NO: 3115 - DNA, 574 bp, Medicago truncatula
ggtacctaaaaccctttcattttattctttcacaaaaaacaaaaacataaaaaaatgtctggacgtggtaaaggaggaaaaggacttggaaaaggaggcgcaaaacgtcatcgcaaaattcttcgagataacattcaaggtatcactaaacctgctatcagacgtctcgcacgcagaggtggtgtaaaacgtatttctggtcttatctatgaagaaacacgtggagtcctcaaagttttccttgaaaatgtaattcgagatgctgtaacctacacagaacatgctaagcgtaagactgtaacgtctctagatgttgtctatgcactcaagcgacaaggacgtactctttacggttttggaggttaaacagtttcttaacactttaccatcaagaaacgagaagactaatattcaaatacgaccatatatctatctttctttatatactcaaactttttttcttctttttttttttttttatctcctcataatgcttggactctgtaaattaataataatattatgcgctcgtttcccaacagaataaatcgacgtatttgattgcataaaaaaa

SEQ ID NO: 3116 - DNA, 459 bp, Avena sativa
attcggcacgagggcggcaaggggctgggcaagggcggcgccaagcgccaccggaaggtcctccgcgacaatatccagggcatcactaagccggcgatccgaaggctggcgaggaggggcggcgtgaagcgcatctccgggctcatctacgaggagacccgcggcgtcctcaagatcttccttgagaacgtcatccgcgacgccgtcacctacaccgagcacgcccgccggaagactgtcaccgccatggacgtcgtctacgcgctcaagcgacagggccgcaccctctacggcttcggaggctagatttgtggtcgagacggtgctgcagttctgctgcgatgtggtctctctgtgatagcgcgctgtagtggatgagattttactgctctggtgatcgtcttgtctgtagtctgtaaaaccgtgatggcttcaatgaaactgctccaattctgaatc

SEQ ID NO: 3117 - DNA, 365 bp, Rosa hybrid cultivar
gattcacaaaagcaaccaatctctctctctctcttaagcaaatccaatttctgatttgagctgagcaacgatgtccggccgcggcaagggaggcaagggtctgggcaaaggaggagccaaacgtcacaggaaggtcctccgcgataacatccagggcatcaccaagcccgccattcgccgtctggctcgccgtggcggcgtcaagcgtatctccggcctgatctacgaggagacacgtggcgtgctcaagatctttctcgagaacgtcatccgtgacgccgtcacttacactgagcacgctcggaggaagaccgtcaccgccatggatgtggtgtatgcgctcaagaggcaaggaaggactcttt

SEQ ID NO: 3118 - DNA, 390 bp, Triticum aestivum
  misc_feature (330)..(330): n is a, c, g, or t
  misc_feature (351)..(351): n is a, c, g, or t
caaatctctcgtggtagacagcttccatctcatctccggcgatgtctgggcgtggcaagggcggcaaggggctcggcaagggcggcgccaagcgccaccggaaggtgctccgggacaacatccagggcatcaccaagccggcgatccggaggctggccaggaggggcggtgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtgtacgccctcaagcgccagggccgcncctctacggttggcggctgangcatcacggctgcgtggtgaactctgttctctttcttgt

SEQ ID NO: 3119 - DNA, 421 bp, Nicotiana tabacum
aaaaaaaggcttaaaaatgtcaggccgtggaaagggaggcaagggattaggaaagggaggagcaaaacgacaccgtaaggtattacgtgacaatattcagggaattacaaagcctgctattaggaggctagctagaagaggcggagtgaagagaattagcggattgatttacgaagagacacgtggagtgttgaagatctttctagaaaatgtgattcgtgatgctgtgacctatactgagcatgctaggagaaagactgttactgctatggatgttgtttattcgctcaagagacagggtaggactctatatggatttggtggttaaatttctgtatctgggttttgggtgttttgtttagtctactttaactgatgtaatttactgtgtttttaaatctatgaaatatcttgtttcagt

SEQ ID NO: 3120 - DNA, 481 bp, Triticum aestivum
  misc_feature (119)..(119): n is a, c, g, or t
  misc_feature (149)..(149): n is a, c, g, or t
  misc_feature (405)..(405): n is a, c, g, or t
  misc_feature (424)..(424): n is a, c, g, or t
  misc_feature (474)..(474): n is a, c, g, or t
gttcgtcagcgaccatgtccgggcgcggcaagggaggcaagggtctcggcaagggcggcgccaagcgccacaggaaggtgctgcgcgacaacatccagggcatcaccaagccggcgatncggcgcctcgccaggcggggcggcgtgaancgcatctccggcctcatctacgaggagacccgcggcgtgctcaagatcttcctcgagaacgtcatccgcgacgccgtcacctacaccgagcacgcccgccgcaagaccgtcaccgccatggacgtcgtttacgccctcaagcgccagggacgcaccctctacggcttcggcggctaggctcgtcctcgcccccgtgcaaattccgatgtgcttatccgcctgtgcgcaagagtcttgctgtcgagaaaattagctnaaatgaatccccatgttanctccgctgttctttcgtaggataactgtattgtcaaacaaactgttccanccgatct

SEQ ID NO: 3121 - DNA, 1012 bp, Populus trichocarpa
gaaacagaatacgaagtaataagagcttttcatatagaacaagtatcaagagatagatacatgacgttttgcaagtacaggaatcagatatctaccactatttgtaaagctgaagcctaatgcctatcaaaccacatacccaagaaacatataaaaaccctaaatcgaccactagcccagaaaatccccagatccccttaaccaccgaacccatagagagtgcgtccctgccttttcaaagcatacacaacatccatagcagtcacagtcttgcggcgagcgtgctcggtgtatgtcacagcatcacgaatcacgttctccaggaagatcttgagaactcctctggtctcctcgtagatgagaccactgatacgcttgactcccccacgcctagccagacgacgaatcgcaggcttcgtgataccctggatattatcacgaagaactttcctgtgcctcttggctcctccctttcccaatcccttacctccctttcctcttcctgacatctttgcttaaccctccttgattctctctcaaaaatctcaatttggctttatgattgcagctgcctggagaggaaagggagggaagggattgggaaagggaggagccaagaggcatcgcaaggttcttcgtgataacattcagggcatcaccaagcctgccatacgtcgtctggctagacgtggtggagtcaagcgtatcagtggtcttatctacgaggagaccagaggcgttctcaagatcttcctggagaatgtgattcgtgatgccgtgacatacactgaacacgctcgccgcaagacagtgactgctatggatgttgtgtatgctttgaagaggcagggccgcacactatacgggttcggtggttaaagggatatttgttttgttggtagtgtagagtgggttagggttatcttgtttcaaaatctatttagtttaaagttggagtaatctatgaaattcagtgtttagaataaatgaatattttacaagtttgctaatc

SEQ ID NO: 3122 - DNA, 500 bp, Triticum aestivum
cgtcagcgaccatgtccgggcgcggcaagggcggcaaggggctcggcaagggaggcgccaagcgccaccggaaggtgctgcgcgacaacatccatggcatcaccaagccggcgatccggcgcctggcgaggaggggcggcgtgaagcgcatctccggcctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggccgcaccctctactgcttctgcggctaagccgctagtccccgctgccagatggtcgtcagtcttcgtcgccgcctgcagattccgatgtgttagtccacccgttcctagtagtgtcgccctccctcaagaaatctcacatggaaaacgccttgtttccccatttcctctgtatgtttagctgaatcatgaaattatgcaatgaag

SEQ ID NO: 3123 - DNA, 424 bp, Triticum aestivum
  misc_feature (35)..(35): n is a, c, g, or t
  misc_feature (263)..(263): n is a, c, g, or t
  misc_feature (304)..(304): n is a, c, g, or t
  misc_feature (343)..(343): n is a, c, g, or t
  misc_feature (386)..(386): n is a, c, g, or t
  misc_feature (397)..(397): n is a, c, g, or t
ccgagtcccttcttctcccaaatcgagcgacgatntccgggcgcggcaagggcggcaaggggctgggaaagggcggggccaagcgccaccggaaggtcctccgggacaacatccagggcatcaccaagccggcgatccgcaggctggcgaggaggggcggcgtgaagcgcatctccggcctcatctacgaggagacccgcggcgtcctcaagatcttcctcgagaacgtcatccgtgacgccgtcacctacacccgaagcacngcccgccgcaagaccgtcacccgccatggacgtcgtctacncgctcaagcgccagggccgcaccctctacggcttcgggnggctagatttgtagtggtgccagcagcggtgcaacttcctcgnttgctctctgntgatgtgtgctgttgggtagatgaaga

SEQ ID NO: 3124 - DNA, 425 bp, Artemisia annua
aaatgtcaggaagaggaaagggaggaagggattgggcaaaggaggagcaaagcgtcatcgcaaggttcttcgcgataacatccagggtatcaccaagcctgccatccgtcgtctggctcgtcgtggtggtgtgaagcgtatcagcggtctgatttacgaagagacacgtggcgtgttgaagatctttttggagaatgtgatccgtgatgctgtcacctacactgagcacgctcgccgtaagacggtcactgcaatggacgtggtttatgctttgaagaggcaaggaaggaccctctacgggtttgggggttagagttgaaattagggtttgttgttatggtatggttagggtgctagtattgggaagatcttgttgatatatctttgtgtaattgcaatttggaatggaatatcagtttaatttt

SEQ ID NO: 3125 - DNA, 357 bp, Rhizophora mangle
taattgggttcttccaactccaacaggtgtaggttctgcgttgatttcgatctgattcgaggatgtctggtcgcggaaagggaggaaaaggattgggcagaggaggggcgaagcgccaccgcaaggtcctccgtgacaacatccagggaatcaccaagccagccatccgccgcctggctcgcagaggcggcgtgaagaggataagtggtcttatctacgaggagactcgtggggtcctcaagatcttcctggagaacgtgattcgcgatgcggtgacatacaccgagcacgccaggagaaagaccgtgacggcaatggacgtggtctatgctctcaagaggcaaggaaggactctct

SEQ ID NO: 3126 - DNA, 841 bp, Hordeum vulgare
cagatcccctccaaggttaccctcggcacagacataccatccaccgagcgtggccagccatgtcgggccgcggcaagggaggcaagggcctgggaaagggcggcgcgaagcggcacaggaaggtgctgcgagacaacatccaggggatcaccaaacccgcgatccggcggctggctcggcggggcggcgtgaagcgcatctccgggctcatctacgaggagacccgcggcgtgctcaaaatctaccttgagaacgtgatacgagacgccgtcacctacacggagcacgcccgccgcaagaccgtcatcggcatggacgtcctctacgcgctcaaccgccaaggccgaaccctctactgcttcggaggctaagccctcgcgtggtgcaggtgcttcgggtgtagttgtggtcaagcaggtcatcgatctctggtgtgctggtcatgtgtgtgcagctgcactctggtgcttgaaacgagccacaaattctgtgatgtggggtcttcatgttggcctgtgggttgggagtgtaggggagggggagggcagtgtgcgtgtggtgtttgctagtgggggcgtccccgatgcttcgtataggtggtgtgtgatgtcgtcttgtggcgttgtcttgtcgttagctgggcaccgcgagttgctcttgtcgccccgtgtttcgtcgctgttctttcctgttctctctgtgttgctcctgcggtcttcccttgagtcatagttgatcctgcgttgattcccgccttgttcctgcgtatttttcagttttgtgcccgcttagtttttcattacttatgttggcgatttttgcccgatatgttgcatgattg

SEQ ID NO: 3127 - DNA, 826 bp, Hordeum vulgare
ccgcagcactcacttcttctcccaaatccagcgacgatgtccgggcgcggcaagggcggcaagggtctgggcaagggcggcgccaagcgccaccggaaggtcctccgcgacaacatccagggcatcaccaagccggcgatccggaggctggccaggaggggaggcgtcaagcgcatctccggcctcatctacgaggagacccgcggcgttctcaagatcttcctcaagaacttcatccgcgacgccgacacctacaccgagcacgcccgccgcaagaccgtaaccgtcatggacgtcgtttacgctctcaagcgccagggccaaaccctctacgggttaggaggctaaatgcgtagcgtcgtggagcaacttgctcgtctgctctgcatgataaaaactgttgcggatgggtccaacgaaaaaatatacaactgatgagtcaataatatgagatcagtatcttgatatttatatactgtacatttaaaatgtatattttatattttgtcagacacaacactaaatatagatacaatttcatatattaatacgatacctttctcggatgcgccggtcaaagcatataactattcagtttcatcagttctttttattatgattccttacacctctcacagaaccttcacgtagacatacccttaggacacactcaaattgcacagtgtataagacgttataacacgatacattgagaggtcagttaaatgataacattctcatacaattatacattgttttcactatgatttatcaccattcattgaatgccgtgtatatatgaccaaatcattgtctgcattacatt

SEQ ID NO: 3128 - DNA, 656 bp, Hordeum vulgare
ccgccgcagccgccgctcctggtcgtccggcatctcagtcagctccaaggaggaagccgtcaaccatgtccggccgcggcaagggagggaagggcctcggcaagggcggcgccaagcgccaccggaaggtcctccgcgacaacatccagggcatcaccaagccggccatccgccggggggggcggcgtggcggcgtgaaccgcatctcggggctcatctacgaggagacccgcggcgtgctcaagatcttcctggagaacgtcatccgcgacgccgtctcctacaccgagcacgcccgccggaagaccgtcaccgtcatggacgtcgtctacaccctaaagcgccagggacgcaccctctacggattcggcggatgacctgcaccctccgctagtacatcgagccgactatacttactactgatgctagtattgggctatcggtttagcgcagaaatgaaagagcgcgcaataagaataaagctacacggcgaaggagtggagagggccccggatcgcgcacgaaaacaggcgaattggagatgattcaaataaacgaaacatcgaccgccatgggagaccgatgatatcgttgcgagtgagcgaccctactgcaagggatgagcgcgtcgtcgacatggtgtgggacccaaaaat

SEQ ID NO: 3129 - DNA, 481 bp, Centaurea maculosa
gggcggaaagggtttgggcaaaggcggagcaaagcgtcaccggaaagttctccgagataacatccaggggatcaccaagcccgccatccgacggctggcacgtagaggaggtgtgaagcgtatcagtgggctgatctacgaggagacacgtggcgttctcaagatctttctagagaatgtgatcagggacgccgtgacctacaccgagcacgctcgccggaagacggtgaccgccatggatgtggtttatgctcttaagagacagggccgtactctttatgggtttggtggttaagggttttttagcagtaattgaaaaatagtcatattagggtttgtaagtttttccctttttttggttaattttgttgaatttgaatgaaaggtgatggatgcatacccttcttgggtgtattgttaactttggtgttatagaatgtttctgtgatgaaatgaaatatatatggttgaagttgatggt

SEQ ID NO: 3130 - DNA, 668 bp, Zea mays
  misc_feature (649)..(649): n is a, c, g, or t
ttcctttgggagaagttacagagatggaaaaccaagggccggacatggtggagttggtggtcagtgaggaagaagttccagcctcgtgccgaattcggcacgagggtaactcgcatcttcctccgtgatccaagttctagcagcgcagcgctcggtttcgacaatatgtcggggcgtcttttatgggcggcaagggtctgggcaagggcggcgccaagcgccaccgcaaggtcctgcgcgacaatatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgcccggcgcaagaccgtcaccgccatggatgtcgtctacgcgctcaagcgacagggccgcaccctctacggcttcggcggctaggcctgccgcgccgcgccgcgcctcgccctcgctgcggttctggtgttgctgcagttcgcaagttgtttgtgcgggggaaaaatgctagctactgtagaactgcagtggggcatgctgcacatgctgtgtttgtctgaagaaatgttgtcaatgttggcttgctctggacncaaacaatgctccattttt

SEQ ID NO: 3131 - DNA, 557 bp, Zea mays
tccgtccgcgtagctcacggattcggcgatgtcggggcacggcaagggcggcaaggggctttctcaaggcggcgcccagcgccaccgcgaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgctcgccgcaagaccgtcaccgccatggatgtcgtctactcgctcaagcgccagggccgcacgctctacggcttcggcggctaggccgcctccccttctgatgctttgatatgacggccgtggtcggttgtgtgtctagttggccggtctactgtagtttgttctgtatcttcgtttcgaggtgttccagtttctagcccatttggtgtaatattttcacagctattatcaatggaaagccctcggttctatcctcaaaaaaaaaagcgcatggtcactcctaatagcaggaggtcttgtg

SEQ ID NO: 3132 - DNA, 566 bp, Zea mays
atcgcacaaatccgcttcctcgagttctcctcaaccaaattacaaagtcacagcgcgcaaactctcagctatgtctggacgcggcaagggcaggaagggtctgggcaagggcggcgccaagcgccaccgcaaggtgctgcgtgacaacatccaaggcatcaccaagcccgccatccgcaggttggcaagaaggggcggcgtcaagcgcatctccgggctcatctaccaggagaccttcggcgtgctcaagatcttcctcgagaacgtcatccgcgacgccgtcacctacaccgagcacgcccgcctcaagactgtgaccgccatggacgttgtctacgctctcaagcgccagggccgcaccctctactgttgcggcggataggtcgcccctctatcggcggcgaattactcggcggccgtggcggacgtgtagtgtgcatggacgagttagtctgtgtagacattatcagagctgtttacggggtgcgtgtaccgcatccgtctagttcgaggccatgtgtcgaaaatctcgctcctgtaataaaggaatgtcatcgggtacagct

SEQ ID NO: 3133 - DNA, 670 bp, Saccharum officinarum
cccacaacttccaagcaggggaggcgaccggcggccgagatgtcggtcaggggcaagggcgggggggggctcgggaagggcggcgcgaagcgtcaccggaaggtgctgcgcgacaacattcagggcataacgaagccggcgatccggaggctggcgaggaggggcggcgtgaagcgcatatccgggctgatctacgaggagacccgcggcgtgctcaagatcttcctcgagaacgtcatccgcgacgccgtcacctacacggagcacgcccgccgcaagaccgtcaccgtcatggacgtcgtctacgccctcaagcgccagggccttaccctgtacaggttcggcagctaggttaagtcagggaacatgcctgtcgaggcgtctcggatcgatgatactagttcgcttaccttcctgtgctcgtctggcagccacagcagtggttgtcactggttgatttgtccgttatgtcccgtgcgtgtgataacaccgctgggttcgatggaattgcaatggttaaccaagacctaaatttgtctactttgggctgccacaaccaaaggtgggttcttcttgtggggcgccgcctttacaatatccaagttttcctacctgggcttgctatgccgataagtgttttatattgtcacctttatttcaataaactggt

SEQ ID NO: 3134 - DNA, 295 bp, Triphysaria pusilla
tgtcaggccgcggcaaaggaggcaagggcttaggaaagggaggagcaaaacgtcatcgtaaggtgctgagggacaatatccagggcatcaccaagcccgcaattcgtcgtctggcccgcagaggtggtgtcaagcgtatcagcgggcttatctatgaggaaacccgtggtgtgttgaagatctttttggagaatgtcatccgtgacgcagtcacctacactgagcacgctcgccggaaaactgtgactgcaatggacgttgtctatgctttgaagaggcagggccgcactctgta

SEQ ID NO: 3135 - DNA, 537 bp, Triphysaria pusilla
  misc_feature (119)..(119): n is a, c, g, or t
  misc_feature (140)..(140): n is a, c, g, or t
  misc_feature (154)..(154): n is a, c, g, or t
  misc_feature (281)..(281): n is a, c, g, or t
  misc_feature (350)..(350): n is a, c, g, or t
  misc_feature (352)..(352): n is a, c, g, or t
  misc_feature (536)..(537): n is a, c, g, or t
ggaagcttcaaaatcatctctctcaattccagtttccaaatctcaaacagcaaaatctgaaaaatgtcaggtcgcggcaaaggaggcaagggcttgggaaagggaggagcaaaacgtcntcgtaaggtgctgagggacancattcagggtatcnccaagcccgcaattcgccgtttggcccgcagaggtggtgtcaagcgtatcagcgggctcatctatgaggaaacccgtggtgtgttgaagatctttttggagaatgtcatccgtgatgctgttacctncactgagcacgctcgccggaaaactgttactgcaatggacgttgtctatgctttgaagaggcaaggccncnctctgtacgggttcggtggttaagcaatttagggttttatatgatttgtaaaaattgttgctttatggttcaggattattggtcaatttgcttagtagcttaaaatggaaattagggtttgttttttatctatcttagatcttgtgttctgttcaattgaaatgaaaatcttgttttggcttcnn

SEQ ID NO: 3136 - DNA, 632 bp, Avena sativa
aagggaggcaaggggctgggcaagggcggcgcgaagcgccaccggaaggtgctccgcgacaacatccagggcatcaccaagcccgccatccgtcgtctcgctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcgggacagagatccgttcggtgctcgcggaatcgtcagatagaagaaggctagcctctctacttagggtttgtcatggtctgtggtgtagttgtagtcggcagtatctcgctgttgtttgctctctctgtcttgtctggtgtttagatctgtacctaggacggaactgttgaccgctggtttggtagaatgcaatgggaatttcacccttgagttctaatgcaatctcttagtactagatctgctgttattgatgataaatctagccaatgtgttctgcaattcgtcattctctgcctcggtattaaacgtacccccaaactacaattgttgtgggcttaactaa

SEQ ID NO: 3137 - DNA, 486 bp, Avena sativa
aagggaggcaaggggctcggcaagggcggcgccaagcgccacaggaaggtgctccgcgacaacatccagggcatcaccaagccggccatccggcgcctcgctcgccgtggcggcgtgaagcgcatctcggggctcatctacgaggagacccgcggcgtcctcaagatcttcctcgagaacgtcatccgcgacgccgtcacctacaccgagcacgcccgccgcaagaccgtcaccgccatggacgtcgtctacgccctcaagcgccagggccgcaccctctacggcttcggtcttcgtcgccgccgcctgctgcagattccgatgtgtcttgtccgcctgtgctcacgagtcttgcggtcaagaatgttttgatgggatgaaatccacccgccctgtttagttccctgtttaaatcgatctgtatcgtgaaatcatggaacaaaattgttcggatctgaatttcggaagtctgacttgtttctgtat

SEQ ID NO: 3138 - DNA, 439 bp, Lactuca sativa
ataaacaaaaatcaaatccagagaaaagtcaagtagaggagaatcggaggtgtcaggaagaggaaaaggaggcaagggattgggaaagggaggagcaaaacgtcatcgtaagattctccgggacaatatccaaggtatcacgaagccggcgtctggctaggcgaggaggtgttaagcgtatcagtggtttaatctacgaggagacgcgtggagttttaaagatctttcttgagaatgttatccgcgacgccgtcacatacactgaacatgctcgccggaaaactgttacggccatggacgtcgtttatgctttgaagcgccagggtcgtactctgtacggttttggtggttagatgaaatttacggatttggggttgtaatcttgaagcgatattttatgtaactaaacctcttaatataatatcagtttatgacccag

SEQ ID NO: 3139 - DNA, 439 bp, Lactuca sativa
  misc_feature (437)..(437): n is a, c, g, or t
ataaacaaaaatcaaatccagagaaaagtcaagtagaggagaatcggaggtgtcaggaagaggaaaaggaggcaagggattgggaaagggaggagcaaaacgtcatcgtaagattctccgggacaatatccaaggtatcacgaagccggcgtctggctaggcgaggaggtgttaagcgtatcagtggtttaatctacgaggagacgcgtggagttttaaagatctttcttgagaatgttatccgcgacgccgtcacatacactgaacatgctcgccggaaaactgttacggccatggacgtcgtttatgctttgaagcgccagggtcgtactctgtacggttttggtggttagatgaaatttacggatttggggttgtaatcttgaagcgatattttatgtaactaaacctcttaatataatatcagtttatgaccnag

SEQ ID NO: 3140 - DNA, 484 bp, Lactuca sativa
cgggaaacaaattcaaattccttccaagagagaaaagcagagagaaaacatgtcaggaagaggatgaggcaagggattgggaaagggaggagccaaacgtcatcgtaaggttctccgggacaacatccaaggtatcaccaagccggcgattcgccgtctggccagacgaggaggtgtcaagcgtatcagtgggctaatctacgaggagacccgtggagttttgagatctttcttgaaacgtcatccgtgacgccgtcacatacaccgaacattctcgccggaaaactgtcaccgccatggatgttgtttatgctttgaagcgccaaggccgtactctctacggatttggtggttaagagaattttacggtttctactttccagggtttttgtttgccaccgaggttttcattgatttgttatctgtaatcggaagtggtattacctgtaattgaagctattaatacaatatcacttatcgaaac

SEQ ID NO: 3141 - DNA, 570 bp, Eragrostis curvula
  misc_feature (62)..(62): n is a, c, g, or t
gcgaaaaactacattcctactctcacaatcaagttcgccgccgtcgtcaaagcaaccatgtncgggccgcggcaccggtagcaagggtctcggcaagggcggcgccaagcgccatcgcaaggtgctccgcgacaacatccagggcatcaccaagccggcgatccggaggttggcgaggaggggcggcgtcaagcgcatctccgggctcatctacgaggagacccgcggcgtgctcaagatcttcctcgagaacgtcatccgcgacgccgtcacctacacggagcacgcacgccgcaagaccttcaccgccatggacgtcgtctactcgctcaagcgccagggccgcaccctctacggcttcggcggctaattgatcctgggtcgctcgcgtctgctagtagggttacagattgttgctaggaaaaggttgcgtgctgtgatgatgtcccgtgtgtagcttcgttgcgttgtgtttgtaaccaattggttgcttatctgttggagcttatctgttggattcgagaactgaaagctaatgaatcgatttaacggatgttatctatgattggc

SEQ ID NO: 3142 - DNA, 529 bp, Helianthus annuus
  misc_feature (31)..(31): n is a, c, g, or t
  misc_feature (34)..(34): n is a, c, g, or t
  misc_feature (54)..(54): n is a, c, g, or t
  misc_feature (74)..(74): n is a, c, g, or t
  misc_feature (93)..(93): n is a, c, g, or t
  misc_feature (98)..(98): n is a, c, g, or t
  misc_feature (127)..(127): n is a, c, g, or t
  misc_feature (167)..(168): n is a, c, g, or t
  misc_feature (268)..(268): n is a, c, g, or t
  misc_feature (280)..(280): n is a, c, g, or t
  misc_feature (283)..(283): n is a, c, g, or t
  misc_feature (301)..(301): n is a, c, g, or t
  misc_feature (391)..(391): n is a, c, g, or t
  misc_feature (397)..(397): n is a, c, g, or t
  misc_feature (406)..(410): n is a, c, g, or t
  misc_feature (415)..(417): n is a, c, g, or t
  misc_feature (422)..(423): n is a, c, g, or t
  misc_feature (425)..(425): n is a, c, g, or t
  misc_feature (427)..(428): n is a, c, g, or t
  misc_feature (435)..(435): n is a, c, g, or t
  misc_feature (438)..(438): n is a, c, g, or t
  misc_feature (442)..(442): n is a, c, g, or t
  misc_feature (445)..(445): n is a, c, g, or t
  misc_feature (447)..(448): n is a, c, g, or t
  misc_feature (453)..(454): n is a, c, g, or t
  misc_feature (458)..(458): n is a, c, g, or t
  misc_feature (460)..(465): n is a, c, g, or t
  misc_feature (468)..(469): n is a, c, g, or t
tggcggggatcaactatttctttcaaatatntanacccgattagctttcgtcanatcgaaatcctactgcacantgtctggtcgcggaaaggnagganaggggctggcaaaggtaggagcaaagcgncaccggaaagttctccgggataatattcagggtatcaccnnacccgccatcaggaggctcgctagaagaggtggagtcaagagaatcagcggtctcatttatgaagagacacgtggcgttctgaagatatttttggagaangtgattcgtgangcngttacctacacggagcangctcgccggaaaacagtgacggcgatggatgttgtctatgctctgaagaggcaaggaaggactttgtacggttttgggggttaattgatntctgcnaacaatttnnnnngaatnnngttanntntnnacatttngtnttgntantnnatatnngagntnnnnnnatnncggtggaatggaagttggttgtccaaaaaacacttttttccggaaaaaaaaaaacatgtt

SEQ ID NO: 3143 - DNA, 419 bp, Panax ginseng
aattctctcccctttgaaaagtcaggccgtggcaagggaggtaaaggactgggcaagggcggagccaagcggcaccgaaaggttctccgggacaatattcagggaatcaccaagccggcgattcgaaggttggcaagaagaggcggagtaaagagaatcagtgggctgatttatgaggaaacaagaggggttttgaagatcttcttggagaatgtgattcgcgatgctgtgacatacacggagcacgccaggaggaagactgtgactgccatggatgttgtttatgctttgaagaggcagggcaggactttatacggctttggtggttgatttctagttttggatgtttgagtttccagatttagtggttgtgtttgttctgaaatgttagtgtaattgcacaatttcgttaaatggaa

SEQ ID NO: 3144 - DNA, 547 bp, Medicago truncatula
tttctcaaattttctcgcgaaaatgtctggccgtggaaagggaggtaagggattgggaaagggaggtgcaaagaggcataggaaagttcttcgtgataacatccagggtatcaccaagcctgcaattcgtcgattggcaagaagaggtggtgtgaagagaatcagcggtttgatctatgaagaaaccagaggtgtcttgaagatcttcttagagaatgtcattcgtgatgctgtgacatacactgagcacgctaggaggaagacagtgacagccatggatgtcgtctatgctttgaagaggcagggaagaaccctctatggattcggaggttgatgctgaagatgaagaagaagcacttttagtttattttttattttattttgccttagactttaatttgaatatgcaattgcaccttagaaagtttcaatgatgtttagggtaatatgttataagtgattctcgagtagatcgaaactttttcagtttcagaaatattgaaatctaatgaaaagtagtacttcgattaatttacagttaaaaaaa

SEQ ID NO: 3145 - DNA, 521 bp, Helianthus annuus
gaaaacacacacaaaaaacaaaatgtcaggaagaggaaaaggtggcaaggggctaggcaaaggcggtgcaaaacgacaccgtaaagttctccgtgacaacattcagggtataaccaaaccggcgatccgtcgtctagcgagacgtggtggcgtgaagcgtatcagtgggttgatatacgaggagacacgtggcgtgttgaagatattcttggagaatgtgataagagatgcggttacgtacacggaacatgcgaggaggaagacggttactgccatggatgttgtgtacgcgttgaagaggcagggccgtacgctttatggatttggtggttaatgggtttattattgttgttaggtttctgttgttattgtgtagtatctttgatgtgttagtggaattcaagcttgattgatgattaagttgaaatatattatgtttctgtgtaaaaaaaacaaacattcactgaatattatcatgtgggccgccttggcccaatcgattcttagactcgagctagctt

SEQ ID NO: 3146 - DNA, 433 bp, Triticum aestivum
cgacctcgtcagccagcgatgtcgggccgcggcaagggaggcaaggggctgggcaagggcggcgccaagcgccaccggaaggtgctgcgcgacaacatccagggcatcaccaagccggccatccggcgtctcgcgcggcggggcggcgtgaagcgcgtctccgggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggacgcaccctctacggattcggaggctgatcccgcgtgttcctccattgttaggggttgccgatgtgatgtaatgtgatgcatatggtttcagattaatcaatggattcgctgttgctgttcaaaaaaaaaa

SEQ ID NO: 3147 - DNA, 613 bp, Phaseolus coccineus
  misc_feature (61)..(61): n is a, c, g, or t
  misc_feature (63)..(63): n is a, c, g, or t
  misc_feature (83)..(83): n is a, c, g, or t
gagacatagtagcttactatctacccatccttcacatacccgcagatccttccatagttgntnatagacaaagagaaaagagnctaccctccgacttctcagcttcacttagaacaacatcatgtctggacgtggtaaaagcggtggtaaaggtcttggcaagggaggcgccaaacgtcaccgtaagattttgcgtgacaacattcaaggcattaccaaacctgccattcgaagattggcccgtcgaggtggtgtcaagcgaatttcaggactgatatacgaagaaacccgcggtgtcctgaagatctttctggaaaatgtcattcgtgattccgtgacttacacagaacatgccaagaggaagacagtgacctctcttgacgttgtttatgctcttaaacgacaaggtcgaactctttatggtttcggagcttagtcctatctctccgctggctgccttattgctcaatgcttctttctcaatttctttctagtttttacattactagttctttttttgctttgtttcatagctcaaatgtgtgagattaagtgtacttttttgtgaatgctataattactcttttcgtgcttgaaaaaaacccaaaaagaa

SEQ ID NO: 3148 - DNA, 553 bp, Pinus taeda
  misc_feature (9)..(9): n is a, c, g, or t
  misc_feature (12)..(12): n is a, c, g, or t
  misc_feature (51)..(51): n is a, c, g, or t
cgcccgccnggncaggtacgcggggaaagaccagatatataaatacccccntcatgctagttggtccacacccaacccacccacattcacataacatccctcgctagtaccctcatatcacctatctcacagtctatcctaccacctcaccctatctcaacccatataatatgtctggacgcggaaaatccggtggtaaaggactcggcaagggcggtgccaagcgtcaccgtaaaattttgcgagacaatatccaaggcatcaccaaacccgcaattcgtcgattggcacgtcgtggtggtgtaaagcgtatctctggtcttatctatgaagaaacaagaggtgtccttaaaattttcctcgaaaacgtcattcgcgactctgtcacttacactgagcatgctaaacgaaaaaccgtaacatcgctggatgtagtctatgcactcaaacgtcagggtcgaacactttatggattcggcgcataactttcgcatctttttttttgtattatttgtattatttgtcttcgtgtaaagcttaaccttcttcacca

SEQ ID NO: 3149 - DNA, 464 bp, Artemisia annua
aggaaagggattaggcaaaggaggagcaaaacgacatcgtaaggtcctccgagacaacatccagggaatcaccaagcctgctattcgtcgtttagcacgtagaggaggtgtgaagaggataagcgggttgatttacgaggagacacgtggcgttctcaagatatttctagagaatgtcatccgtgatgctgtcacctacaccgagcacgcgagaaggaagacagtgaccgcgatggatgttgtttatgctttgaaaagacaaggcaggaccctctacggtttcggtggttagattaaattagctgctgtttggttagatggattagatctggtttattgtgttagattttattattattaagtgttattagatgtttttaagtggatgtacgatattttaatcagtgaacatgaaggtcttattcggtttaattgtttcttgtcactttagaatttgtttattt

SEQ ID NO: 3150 - DNA, 346 bp, Artemisia annua
atatcgcgagcaatcaattaatccaaacacccccaaattcatttaaaatcaataaaatgtcaggaagaggaaagggaggaaagggattgggcaaaggaggagcaaagcgtcatcgcaaggttcttcgcgacaacatccagggtatcaccaagcctgccatccgtcgtctggctcgtcgtggaggtgtgaagcgtatcagcggtctgatttacgaagagacacgtggcgtcctcaagatctttttggagaatgtcatccgtgatgctgtcacctacaccgagcacgctcgccgtaagacagtgactgcaatggatgtggtttatgctttgaagaggcaaggaaggac

SEQ ID NO: 3151 - DNA, 355 bp, Artemisia annua
tacccgacggggacaacacaatccattaatccaaacatccccaaattcattcaaaatcaaaaaatgtcaggaagaggaaagggaggaaagggtttgggcaaaggaggagcaaagcgtcatcgcaaggtgctccgtgacaacatccaaggtatcaccaagcctgccatccgtcgtctggctcgtcgtggtggtgtgaagcgtatcagcggtctgatttacgaggagacacgtggcgtgttgaagatcttttggagaatgtgatccgtgatgccgtcacctacactgagcacgctcgccgtaagacggtcactgcaatggatgtggtttatgctttgaagagacaaggaaggactct

SEQ ID NO: 3152 - DNA, 449 bp, Hordeum vulgare
tccctccaccaaccacgagtcaaacccaccgcagcaaagggacagcggcggtagagtcgggccgtggcaagggaggcaaggggctcggcaagggcggcgccaagcgccaccggaaggtcctccgcgacaacatccagggcatcaccaagccggcgatccgtcgtctcgcgcgcaggggcggcgtgaagcgcatctcggggctcatctacgagacccggggcgtgctcaagatcttcctcgagaacgtcatccgcgacgccgtcacctacaccgagcacgcccgccgcaagaccgtcaccgccatggacgtcgtctacgcactcagcaccctctacggcttcggaggctaccagatttagagagttctagggttcgtggtcgttggtgtaatggcagcatctcgctgttgtttgctgtcttctgtagaatcgaacggaatcgaatggaaa

SEQ ID NO: 3153 - DNA, 605 bp, Avena sativa
gtatacatttagtgagaacgtttgacacatatcaagttttacgtctttctacctttataaacaacaaaccatatacaaaaaatgactggccgtggtaaaggtggtaaaggtctcggaaagggaggtgctaagcgtcaccgaaagattcttcgtgataatattcaaggtataactaagccagctatccgtcgccttgcacgtcgtggtggcgttaagcgtatttcaggtcttatttatgaagagactcgtggtgtcttgaaggttttccttgaaaatgttattcgggatgctgtcacttacactgaacacgctaagcgtaaaacagttacctctcttgacgtcgtttatgcgctcaaacgccaaggccgaaccatttacggttttggtggttaagaacgttcgctctaaaatatcggttctctttgttgtggttcattctaagatttttttttttttcaaatgtgttagcttttctaggactattgtatatttttttcatcatgatattcaattatcctaattatcatttattccctttatgaaggatgtaacagtttctgtaaataaatagtaaacatctttcctagcgtcgaggaatctacttt

SEQ ID NO: 3154 - DNA, 291 bp, Orobanche aegyptiaca
aagatgtcgggaagaggtaagggcggcaagggactgggcaagggcggcgcaaagcgccatcggaaggtgttgagagataacattcagggaatcacgaagccggctatccgtcgtctggcccgccgtggtggcgtgaagcgtatcagcggtctcatctacgaggagacacgtggcgtcctcaagatattcctcgagaatgtcatccgtgatgccgtcacctacactgagcacgctcgccggaagactgtgacggcgatggatgttgtttacgcccttaagaggcagggaagg

SEQ ID NO: 3155 - DNA, 547 bp, Hordeum vulgare
ctttctcttccccccaaccacacctctctgggagctaggcggaggggggatgtctgggcgcggcgagggcggcaaggggctgcgcaagggcggcgccaagcgccaccggaaggtcctccgtgacaacatccagggcatcaccaagccggccatccggaggctggccatgagaggcggtgtgaagcgcatatgcggcctcatatacgaggagacccgcggcgtcctcaagatcttgctcgagaacgtcatccgcgacgccgtcacctacaccgagcacgcccgccgtaagaccgtcaccgctatggacgtcgtttacgcgctcaagcgccagggccggaccctctacggcttgtgcggctaggttccccgattccactggcggctgtagcgagagtacgaatgtgtcgggtgttcttttgtgggaggcgggatgtaccactgagttagcgtgcgttgatgtggtgcatggtcaggtgggtggaagagcgtggtgcgatcaatgaaaccagtttgtgctgaatcctcgaagtatcaagaagatgctctc

SEQ ID NO: 3156 - DNA, 714 bp, Theobroma cacao
  misc_feature (5)..(6): n is a, c, g, or t
  misc_feature (13)..(13): n is a, c, g, or t
  misc_feature (20)..(20): n is a, c, g, or t
  misc_feature (38)..(38): n is a, c, g, or t
  misc_feature (46)..(46): n is a, c, g, or t
  misc_feature (71)..(71): n is a, c, g, or t
  misc_feature (123)..(123): n is a, c, g, or t
  misc_feature (144)..(144): n is a, c, g, or t
  misc_feature (155)..(155): n is a, c, g, or t
  misc_feature (183)..(183): n is a, c, g, or t
  misc_feature (230)..(230): n is a, c, g, or t
  misc_feature (292)..(292): n is a, c, g, or t
  misc_feature (297)..(297): n is a, c, g, or t
  misc_feature (344)..(344): n is a, c, g, or t
  misc_feature (346)..(346): n is a, c, g, or t
  misc_feature (408)..(408): n is a, c, g, or t
  misc_feature (442)..(442): n is a, c, g, or t
  misc_feature (448)..(448): n is a, c, g, or t
  misc_feature (468)..(468): n is a, c, g, or t
cgggnnaaatccnatccaanttaaagaaaacaaagccngcaaaatnttgctttgagaggtagaaaatgtcnggccgtggaaagggaggcaaaggattgggaaagggaggagcgaagaggcacnggaaagtactgagagacaacnttcaagggatnacgaagcctgcaattcgaaggttggctngacgaggtggagtgaagaggattagcggttttatttatgaagaaacncgaggcgttctcaagattttccttgaaaacgtgatccgcgacgcggttacgtatactgagcncgccnggaggaagacggtaactgctatggatgtggtttatgccttgaaaagncngggccgaaccctttatggttttggcggttaattgggtggtttttttttttttttgaaagganttaggtggtcttttacagagaggctttttagatntcgtcngtttttgtgcttttcgatgntgtaatagaagttgaatttttatgggaaaattgtgtttggatttcgatgttactttttggtttctgtttggtttcctagaaaatatgcgtaagaaagtgaaaatgaaacggttggtcttttccattagctacagttttcctgcttactggtaaatgtgaattggtaggactaaccgtttggaacccaaattgtacttgttttttaggatttactctaatgaaatacaaaataagtcatttaagcca

SEQ ID NO: 3157 - DNA, 550 bp, Vigna unguiculata
ggatcttcacctctttcccactactcatcccaacaacccttctcttacttttctttcttcaatcactcagtaaatatgtccggacgtggaaagggtggaaagggcctcggaaagggcggtgccaagcgccatcgcaaaattcttcgtgacaacatccggggtatcactaaacccgctattcgtcgtctcgcacggcgtggaggtgtcaaacgtatctcgggtctcatctatgaggaaacccgtggtgttttgaaaattttcttggagaatgtcatccgtgactctgttacatatactgaacacgccaagcgcaagactgtcactgctctagatgttgtttacgctcttaagcgtagtggtcgcactctctacggtttcggtgcatgattttatcctatcttctccctctcttttatatatgttgtcctgcgatttgtatttactgtattcatacatcagcctaccatattggcctggatatctataaaagctgtccaaaaggcactaaatgattgagaactgtccaattgcgacactgttatttgacctc

SEQ ID NO: 3158 - DNA, 654 bp, Mesembryanthemum crystallinum
  misc_feature (91)..(91): n is a, c, g, or t
cccgcgctgcaggattaggcacgagcgtaaatctaaaccttcaaatctctccgagtgaaaatgtcgggccgtggaaagggcggaaaggggnctgggcaaaggttgcgcaaagcgtcacagggaaggtcctgagagacaacatccagggcatcaccaagcccgccattagaaggctggctcgtcgtggtggtgtcaagcgaatcaacggtctcatctatgaggagaccagacgtgtgttgaagatctttcttgagaatgtcattcgtgatgctgtcacctacacctagcacgctaggaggaagaccgtgactgccatggatgtggtttatcgctcttaagaggcaaggaatgacccttcactgatttggcggctcatttccgtgcttacgttcctagattgcggcgtctggccatcagcgcacctgtctcttctccacaacggctcctcggcccttcgctctcgccgccacaacttcggcgggcgcacctccacatctgtcatctcccctccttctctcaccacacctccgtgctcccctatatccgtccccaccctcctaccaatcacccttagcatacatgcccccctcccatcctcctctcacctccacctcctcctcgtctctcctctaccattcttctcctcttcctcca

SEQ ID NO: 3159 - DNA, 660 bp, Zea mays
  misc_feature (131)..(131): n is a, c, g, or t
accaaagtccaagcaccttcccaaaaaatcccccattttcttcgaggcgaggagagcgtgaaagacagggcaccggcagcgacgatgtcggggcgcggcaagggcggcaaaggtctgggcaagggcggagnaaagcgccaccggaaggtctccgtgacaacatccagggcatcaccaagcccgccatccggaggctggcttggagggggggcgtgaagcgcatttcgggggttattttcgaggagacccgcggggtcctcaagattttccttgagaaagtcattcgggacgccgtcacctacaccgagcacgcacgccgcaagactgttaccgccatggacgttgttttcgcgctcaagcgccagggccgaaccctttacgggtttggagggtagggtggatgccttttttccttgctgtcgtggatgcctgtttgttgttagggttactttgtttagttccttgtttgtgacgggttggactattgttagtagtatttttgaagttgtttgaaagtaatccaattttatcgttcgagaattgaaatgatttctgggcaacattttgcaggcaatttcgttcgagagttaggtccattatatttgttaagattttttttccatacagcattgactaagtatgaagcccattccctcctgg

SEQ ID NO: 3160 - DNA, 422 bp, Zea mays
gatcgaaaaactacgtaaaaatgtcagggcgaggaaaaggaggaaaaggacttggaaaaggaggtgctaaacgtcaccgaaagattctccgtgataacatccaaggaatcaccaaaccagccatcagaagattagcaagaagaggaggtgtcaaacgtatctccggtcttatctacgaagaaaccagaaccgtcttaaaatccttccttgaaggtgttatcagagacgctgttacctacaccgaacatgccaagagaaagaccgtcacttcccttgatgttgtatatgctttgaagagacaaggaagaaccctttatggattcggtggttaatttactgctgctcctttatatattggacttcagactcccaccactactacttagcatcccaaagacacccaataaacagtcaataccact

SEQ ID NO: 3161 - DNA, 573 bp, Zea mays
atcgcacaaatcctcttcctcgagtccttctcaaccacattcaaagtcacagcggcgaaactctcggcgatgtctggccgcggcaagggcgggaagggtctgggcaagggcggcgccaagcgccaccgccaggtgctgcgtgacaacatccagggcatcgccaagccggcgatccgcacgttggcgaggaggggcggcgtcaagcgcatcctccgggctcatctacgaggagacccgcggcgtgctcaagccccccctcgagaacgtcatccgcgacgcccgtcacctacaccgagcacgcccgccgcaagactgtgaccgccatggacgttgtctacgctctcaagcgccccggccgcaccctctacggtttccgcggataggtcgcccccctccccgtggcgaattacctggtggcggtggcggtcgcgttgggttccaggtctaattagtctgtgttggcttggtcggtgctggttcctgtggtgggcgtactgcagccccccagtttccagatcctgtgctcgaatatccccctgccgtcatcgatggaatgtcctcggttctacgccg

SEQ ID NO: 3162 - DNA, 596 bp, Zea mays
gcacaaatcctcttcctccagttctccctcagccaattcaaagtcacagcggccaaactctcggcgatgtctggccgcggcaacggcgggaagggtctgggcaagggcggcgcctagcgccaccgcaaggtgctgcgtgacaacaatccagggcattcaccaagccgtgccatccgcaggttggcgaggaggggcggcgtcaagcgcatctccgggctcatctacgaggagacccgcggcgtgctcaagatcttcctcgagaacgtcatccgcgaccccctcacctacaccgagcacgcccgccgcaagactgttgaccgccatggacgttgtctactctctcaagtcgcgagggccgcaccctctaacggtttcggcggttaggtcgcccctctcccggtggcgaattacctggtggcggtggcagtcgtcgtgtgttcttgggccacttagtctgtgttgtctttctccgctgctgtttccttggtggttggaccgcactgtaccagtttcttgtccatgtgccgtaaaatctccctgttcccctcaactgtattgttcttttttttcagtcacaaaaaaaaaataaaaataag

SEQ ID NO: 3163 - DNA, 604 bp, Zea mays
aaaggtacacatcatctcttccaaatcctttcagaaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcaccgccatggacgtcttcttttttctcaagcgacagggtcgcaccctctactgattcggcggctgagaggcgcttcccccgctgggtgcccgtggaaaaatcctggggtcgcgggccaggaaatcaaaattatcctggaataacctgctttagttccgtattataataatcactagtggctaattggtagccggtttttggggttcaacccactctaaaccccttgcaaaaaagaatatatttgaatccccgcgtttcccggttttcgaactttcaaaaaatacaaaaaccg

SEQ ID NO: 3164 - DNA, 308 bp, Allium cepa
ggtaaaggtcttggaaagggaggcgccaagcgtcatcgcaaggttctccgagataatatccaaggaatcactaagcccgccatccgccgcctcgccagaagaggaggcgtcaagagaatcagcggtttgatttatgaagaaactagaggtgttttgaaaatctttctagagaacgtgattcgtgatgctgttacttacaccgagcacgcaaggaggaagactgttactgccatggatgttgtgtacgctttgaagaggcagggaaggactctttatggatttggaggttaaatgtttcaatcttcatg

SEQ ID NO: 3165 - DNA, 439 bp, Arachis hypogaea
agtgtttgaaaatgtcaggtcgtggaaagggaggaaagggattgggaaagggaggagcgaagaggcacagaaaggtgctttgtgataacattcagggaatcacgaaacccgccatttgccgtttggcttgcaggggaggcgtcaagagaatcagtggtttcatttatgaggagacacgtggcgttttcaagatttttttggagaatgttattcgggatgccgttacctacaccgagcacgctcgccgcaaaaccgttactgccatggatgttgtttatgctttcaagaggcagggaaggactttttacggtttcggtggttgattcattttagggtttagtatttgctcctgcttgtaaatgtttcatggattattgagctcgttgaagtgtagtttggatccagaggaaatagaaataaatactttttttgttttgga

SEQ ID NO: 3166 - DNA, 309 bp, Glycine max
atgccaggaagaggaaaaggaggcaagggtttgggaaagggaggagcgaagcgacaccgtaaggttctgaggaacaacatccaagggatcacaaaacctgcgattcggtgtctcgcgaggcgtggcggcgttaagcgaatcagcggcctcatctacgaggagacacgtggcatcctcaagatattcctcgaaaacgtgattcgtgatgctgtaacctacaccgaacacgctcgccgcaagattgtcattgctatggacgttgtttacgccctcaagagacagggcaaaaccctctatggtttcggtggt

SEQ ID NO: 3167 - DNA, 836 bp, Saccharum officinarum
ctcgcttcctcctgatacgcattccaggttccaggagcaaagctctcggtttcagcgatgtcggggctcggcaatggcggcaaggggctgggcaagggcggtgccaagcgccaccgcaaggtgctgcgcgacaacatccagggcatcactaagcccgggatccggaggctggcgaggagaggaggcgtcaagcgcatctccgggctcatctacgaggagacccgcggcgtgctcaagatcttcctctagaacgtcatccgcgacgccgtcacctacaccgagcacgcccgccgcaagaacgtcaccgccatggacgtcgtctacccgctcaagcgccaaggccgaagcctctacggcttcggcgggtaagtcattcctctaccggtggcgaactggcatgtggtggcggacgtggtcgtattgtatgccgtgtataatgtaatctgtgctctctgtattcgctactgtgtactgtgatggatgtgcatcatacacgcttgggtagtcgtagaaatatacacttctacatatcaccggaaacccaccggttgcaggctcaaagaaaacaaaacaaagggcgggcctcctcaatcatgcaagcaatgtacgggttgctggcaacggcgtaaccggattagctcgaggccaaagtcattgcgcgtgcacagtttcaacatgttctgaatgggaaatacgggtgtgtgcaacttgttccccgtaaaagatatccgcctttggcggtagggttataaccgaaaagagcgttacacgggctctccaaaaaggtgctaccgctaattgggcaatggcccgccacctgtaccgagcgttaatag

SEQ ID NO: 3168 - DNA, 370 bp, Triphysaria pusilla
  misc_feature (134)..(134): n is a, c, g, or t
tccaaaattcaccaaatacaaaccaataatcacctcgaatttcattgatttgtcttgataatcacttctctgctataaaaatgtctggccgtggaaagggaggcaaggggctgggaaagggtggagcaaaacgncaccgtaaagttctccgagataacatccagggcataacgaagccggcgatccgccgtctggcgaggagaggtggagtgaagagaatcagtggtctgatatacgaggagacaagaggagttttgaagatatttcttgagaatgttatcagagacgctgtgacctacaccgagcacgctaggaggaagacggtgactgccatggatgttgtctatgctttgaagaggcagggccgtac

SEQ ID NO: 3169 - DNA, 378 bp, Triticum aestivum
  misc_feature (282)..(282): n is a, c, g, or t
  misc_feature (303)..(303): n is a, c, g, or t
  misc_feature (314)..(314): n is a, c, g, or t
  misc_feature (331)..(331): n is a, c, g, or t
tctgggcgcggcaagggaggcaagggtctcggcaagggcggcgccaagcgccaccggaaggtgctgcgcgacaacatccagggcatcaccaagccggccatccggcgcctggctcggagaggcggcgtgaagcgcatctcggggctcatctacgaggagacccgcggcgtgctcaagatcttcctccgagaacgtcatccgcgacgccgtcacctacacggagcacgcccgccgcaagaccgtcaccgccatggacgtcctctacgcgctcaaagcgccaanggccgcacctctacggttccngcggctaagcnccacttcctcccgcaantcctcgccgctcctcctcaatcaacactccgccccgcttgtggcccc

SEQ ID NO: 3170 - DNA, 453 bp, Triticum aestivum
ccgcggcagggaggaaggggctcggcaagggcggcgccaagcgccaccggaaggtcctccgcgacaacatccagggcatcaccaagccggcgattcgtcgtctggctcgcaggggcggcgtgaagcgcatctcggggctcatctacgaagagacccgcggcgtgctcaagatcttcctcgagaacgtcatccgtgacgccgtcacctacaccgagcacgcccgccgcaagaccgtcacggccatggacgtcgtctacgccctcaagcgccagggacgcaccctctacggattcggaggctaggcgaattcagctcgcaccacttgatcagatattcagattagcagtagctaggcgttgttcagtgttcatggtaatcggtgtaatttatgttgtatgctgcttgttcgttggaatggatcaaatatcagttatttaccctttaaaaaaaaaa

SEQ ID NO: 3171 - DNA, 354 bp, Zinnia violacea
acgcgggaccacatcaccacccaaatcatccaatttcttcaccaatttctcactctcaaatcaaccatgtcaggcagaggaaagggaggcaaaggacttggaaaaggaggagcaaaacgtcaccgtaaggttctccgtgacaacatccaaggtatcacaaaacctgcaattcgcagattggctcgtagaggtggtgtgaagcgtatcagtgggttgatctatgaggagacacgtggcgttctcaagatctttcttgaaaatgtcatcagagatgctgtgacttacactgaacatgctcgtcgtaagactgtcactgctatggatgttgtctatgctctcaaacgtcaaggccgt

SEQ ID NO: 3172 - DNA, 364 bp, Zinnia violacea
acgcggggacacacacacacaccaaaccctcatttcttacagatttgcttgcaggtgatttcaagaagctcgaagaatgtctggcagaggaaaaggaggaaaggggttggggaaaggaggagcaaaacgacaccgtaaggtgctccgtgacaacatccaaggaatcaccaaacctgcaattcgtaggttggctcgtagaggtggagtgaagcgtatcagtgggttgatatatgaggagacacgtggcgttttgaagatattcttggagaatgtgattagggatgcggttacttacacggagcatgctcgtaggaagacggtgactgccatggatgttgtttatgcgttgaagagacagggtcgt

SEQ ID NO: 3173 - DNA, 404 bp, Zinnia violacea
acaattcaacacaaatcttccaatatatgcaatttaatcttttatatctcaacagtttcttgattagatttcatttgttgtcacagatttttgaatcgatttgaaggaattcaacaatgtcaggacgtggaaaaggaggaaagggattaggaaagggaggagcaaaacgacaccgtaaggttctccgtgacaacattcagggaatcacgaagcctgctatccgtaggttggctcgtagaggaggtgtgaagcgtatcagcggcttgatctacgaggagactcgtggcgtgttgaagatctttttggagaatgtcatcagagacgctgtgacttacaccgagcatgctcgcaggaagacggtgactgctatggatgttgtttatgcgttgaagagacagggtcgt

SEQ ID NO: 3174 - DNA, 502 bp, Senecio madagascariensis
gggcgtggtaagggaggaaaaggactaggaaagggaggagcaaaacgacatcgtaaggttctccgcgataacatccagggtatcaccaaacccgctagcagtggtatcaacgcagaggcggtgtgaagcgtatcagtggattgatctatgaagagacacgtggcgtgctcaagatatttctagaaaacgtcatcagagatgctgtcacctacaccgagcacgctcgccgtaaaaccgtcaccgcaatggatgtggtctacgctctcaagagacaaggccgtactctctacggtttcggaggatagggtttgggtttagatttgaggaaactgtgaaagtcttgctgtcaagaaagaaatgggtcgggtttcaatcgggttaaaaaagggggtttttaggtgtatctggttattgtttagttttaatttttagtgatttctactacttgttgaaatggaatgtagttattgttttaatgaaaaaagtttaatcatttttaatt

SEQ ID NO: 3175 - DNA, 566 bp, Raphanus sativus
gagcttcggaatctacttaggagagatgtcgggaagaggaaagggaggaaaaggattggggaagggaggagcgaagaggcacaggaaggtgcttagggataacatccaaggtatcaccaagcctgccattcgtcgtcttgctcgcagaggtggtgtcaagcgtataagcggtctcatctacgaagagaccagaggagtcctcaagatttttctcgagaatgtcatccgtgacgctgtcacctacactgagcacgctaggaggaagactgttactgctatggatgttgtctatgctttgaagaggcaaggacgcactctgtacggattcggcggttaatcgaacggttgagattttagtaggagacggaattagtgtgttgtttctgttatcatccacttgtttagtagtaaaaagtagaacgaaggagtttgtgtgctgtcttgttaagccaatttgatgttccatgtagctagctaaaattcagcaatctctgattggattcttaaatgaaaattctgtttgaaaacgatgatttctactacctaacttaaaatttcactgccga

SEQ ID NO: 3176 - DNA, 501 bp, Triticum aestivum
gttcttctctcaaatccagcggcgatgtccgggcgcggcaagggaggcaaggggctgggcaagggcggcgccaagcgccaccggaaggtcctccgcgacaacatccagggcatcaccaagccggcgatccggaggctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcacagccatggacgtcgtctacgcgctcaagcgccagggccgcaccctctacggcttcggaggctagtagatacgtggtgtgctctgctggtggcggccgtgtttttctgtgttatatgtgccgtggtggatgggatgtacttctctgtcgtgcgtttgtgttcactagtctgcaataccattatccgttcaatgaaaaaactccgatcctgagttctgtcgaaaaaaaaaa

SEQ ID NO: 3177 - DNA, 736 bp, Triticum aestivum
  misc_feature (600)..(601): n is a, c, g, or t
  misc_feature (603)..(603): n is a, c, g, or t
  misc_feature (640)..(640): n is a, c, g, or t
  misc_feature (668)..(668): n is a, c, g, or t
  misc_feature (670)..(670): n is a, c, g, or t
  misc_feature (685)..(686): n is a, c, g, or t
  misc_feature (688)..(688): n is a, c, g, or t
  misc_feature (690)..(691): n is a, c, g, or t
  misc_feature (698)..(699): n is a, c, g, or t
  misc_feature (702)..(702): n is a, c, g, or t
  misc_feature (706)..(706): n is a, c, g, or t
  misc_feature (708)..(711): n is a, c, g, or t
  misc_feature (714)..(714): n is a, c, g, or t
  misc_feature (721)..(721): n is a, c, g, or t
  misc_feature (724)..(724): n is a, c, g, or t
  misc_feature (733)..(733): n is a, c, g, or t
acacacacacacagagaagccaagatgtccggccgcggcaagggagggaagggcctcggcaagggcggcgccaagcgccaccggaaggtgctccgcgacaacatccagggcatcaccaagccggccatccggcgtctggctcgcaggggcggcgtgaagcgcatctcggggctcatctacgaggagacccggggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggattcggcggctgacctgcgcccgctgctccaatctccatgttctcgtgctatggtttcgtttctgaattcagagtgcgtgcgttgttggtccatcggtctgtgtagttagtggatggcgatggatctgaatgcagtcagttcgtcagagtgcgtgcgttgttctaccggtctctgtagtcagttccacagtggaaggcgatgaatatgaacgcaaatgggattgattgatggttctttctacttgaatcgtcaccatcaacttgttatgccacctannanaaaaaaaaaaaaaaaaaaaaaaaaaaaaaaaaaaccnaaaaaaaaaaaggcccacctcggccgcnancaccctaatcccgcnncncnngcggccnngancatncnnnntcnggcccanttngccctatantga

SEQ ID NO: 3178 - DNA, 441 bp, Euphorbia esula
  misc_feature (111)..(111): n is a, c, g, or t
  misc_feature (134)..(134): n is a, c, g, or t
  misc_feature (166)..(166): n is a, c, g, or t
  misc_feature (189)..(189): n is a, c, g, or t
  misc_feature (195)..(195): n is a, c, g, or t
  misc_feature (279)..(279): n is a, c, g, or t
  misc_feature (291)..(291): n is a, c, g, or t
  misc_feature (376)..(376): n is a, c, g, or t
  misc_feature (401)..(401): n is a, c, g, or t
ggcacgaggaaaaaaatgtcaggaagaggaaaaggaggaaagggattgggaaagggcggcgccaagaggcacaggaaagttctccgggataacattcagggcatcactaancctgctattcgccgtttggccanacgtggtggagtcaagcgtatcagcggtctantttacgaggagaccagaggcgtnctcaanatctttttggaaaacgtgattcgtgatgctgtcacttacaccgagcatgctcgccggaaaactgtcaccgccatggatgtggtntatgctttgaanaggcagggccgaactctttacggattcgggggttagaggtttttaaatctaggggttgggatttagggtttctttttgtaatttngggggtttaattttgcttatttgcnaaattggtagtgtgattcgtgcaattatcatctgtgcaaa

SEQ ID NO: 3179 - DNA, 520 bp, Zea mays
acccacttcccccaacccttcaaactcaaccccaagcacaacatgtccggacgtggtaaaagcggaggaaaaggtctcggaaagggcggtgccaaacgtcaccgcaagattcttcgtgataacattcaaggtatcaccaagcctgctatccgaagactggctcgtcgaggtggtgtcaaacgtatctctggcctgatctacgaagagacccgaggagtattgaaaatcttccttgagaacgtgatccgggattcggtcacatataccgaacatgctaagcggaaaaccgtcacttcgctcgatgtcgtatacgccctaaaacgacagggccgaacaatatacggttttggcgcataagacccctccctcatttctccttattacctccgtctcataatgcttgtacacctctgtcctgttgtagtactttcctctgccttctatgttggtgacatcgcttttgccatgagattatgtgccgctagaatagtaattcctcctttccttttggtgccctata

SEQ ID NO: 3180 - DNA, 497 bp, Unknown
  Sequence found in Organisms: Ipomoea nil, Ipomoea batatas
ttacggccggggacgaccacactctgagcctctgctagctctcttctgcaacctccgccttactttactcttcacttcaccacataaaatgtctggccccggaaagggaggaaagggtctcggaaagggaggcgccaagcgtcatcgcaagatcttgcgtgacaacatccagggtatcaccaagcctgccatccgccgtctcgctcgccgtggtggtgtcaagcgtatctctggtcttatctacgaggagactcgtggcgtgctcaagattttcctcgagaacgttatccgtgattccgttacctacaccgagcacgccaagcgtaagaccgttaccgcacttggtgtcgtctatgccctcaagcgctctggtcgcaccctctacggtttcggcgcgtaaacgattgtttggcgatgcgccacaattccatttttatctcgccttgtaattctactgttatagcctggtgtttcaatatatcattgctgtttctcct

SEQ ID NO: 3181 - DNA, 551 bp, Zea mays
  misc_feature (127)..(127): n is a, c, g, or t
  misc_feature (208)..(208): n is a, c, g, or t
  misc_feature (349)..(349): n is a, c, g, or t
atccaactcacacacaggctcaccccaccaacagcaagcgaaaatctcccgatcccctctggtctccgcggcgaagatgtcggggcgcggcaagggcgggaagggcctgggcaagggcggcgcgagncccggaaggtgctccgcgataacatccaggggatcacgaagccggcgatccggcgactggcgcgcaggggcggcgtgaacnattctccgggctcatctacgaggagagccgcggcgtcctcaagatcttcctggagaacgtgatccgcgacgccgtcacttacaccgagcacgcgcgccgcaagaccgtcacagccatggacgtcgtctacgcgctcaagcncagggccgcaccctctatggcttcggcggctaggctaggcgggcccgcgctcgctgtcgtcgctgcggttctattgtttttgcaattcgcaagtagtggctcggtggcgaaaatgctggttactgtggcactagatcaagcatgttgtgcgtgtctgaagaaatgccaattgtgtacttgcttgtttgtacaaaaaaaaaaa

SEQ ID NO: 3182 - DNA, 915 bp, Cucumis melo
  misc_feature (229)..(229): n is a, c, g, or t
  misc_feature (313)..(313): n is a, c, g, or t
agcaaaagatattaggaagcttaatttataacgtgagatgaaattatgttgcaaagattacaacaaaggaaacacaaagaaaaattgtcaacccaattacaaagaaaataaaatgtaccttttttttttgtttgagttacatgaaacaaagtaacaataattaaccaaccttcttccttttctttccccttccttttgtgaaccattacccttcaagaaaagcacacanacctctctatctctgtttcctttcgacaattcccagacccaaaaacagaggagagaaagaggatgagcaaaaaagagaaaaaanattcttcatctcttcactcctttcttcctccaattccttacttattcaaaaaccccattcttcaattctgcacagttatcatcattaaatcacacccaaaaagaattatttatcagtctcttcaattctccaaattatacttcaaaaccctcgtgccgaattcggcacgaggggggaaaggaggagccaagcgtcatcggaaagtcttgagagataacattcaaggtattacaaagcctgcaattcgccgtttggctcgtcgtggcggtgtgaagcgaatcagcggtttgatttatgaagaaaccagaggtgttttaaagatcttcctcgagaatgttattcgtgatgctgtgacttacactgagcacgctaggaggaagacggtgactgccatggatgtggtttatgccttgaaaaggcagggaaggactttgtatggtttcggaggttaggttgtagattaatcgaatggaggattgtagatcttggctttagatctgtttttttctttcttagcgttgataaattttttgtaccctagtctctgttgttcagtaattgaaatattactcgaatcatgatgtgatcttctcatcttattt

SEQ ID NO: 3183 - DNA, 388 bp, Salvia sclarea
ctactagaccttggctgtcactcaaaaacaattcaggattccctctctaaatttcactcccactcaaaaaaacttcacttccaaattagggttccccaaaaatgtcaggaagaggcaagggcggcaagggattgggcaagggcggcgccaagcgtcaccggaaggtgctgagggataacatccagggcatcacgaagccggcgatccgccgtctcgctcgccgtggcggcgtcaagcgcatcagcggcctcatctacgaggagacacgtggcgtgctcaaaatattccttgagaacgtcatccgcgacgccgtcacctacaccgagcacgctcgccgcaagacggtgaccgccatggacgtcgtctacgcgcttaagaggcagggacg

SEQ ID NO: 3184 - DNA, 290 bp, Tragopogon dubius
aaaagatgtctggtagaggcaaaggagggaagggactaggaaagggaggagctaagcgtcaccggaaagttctccgagacaacatccaggggattaccaaaccggcgattcgacgtttggcccggcgaggcggcgttaagcgtatcagcggtcttatctacgaggagactcgaggcgtcctcaagatctttttggaaaatgtcatccgtgacgctgttacatacaccgagcatgctcgccggaaaaccgttaccgccatggatgtcgtctatgctttgaaacgccaggga

SEQ ID NO: 3185 - DNA, 703 bp, Brassica rapa
ccacaaactcctctaccccacacatcttctcacgcgtctcatacatccgcaaacctcactacctcataaaacttctttaaatcaacaactcaattaaacatgtctggacgcggaaagggtggtaagggtcttggaaagggaggcgccaagcgtcatcgcaagatccttcgcgacaacattcagggtatcaccaagcccgccattcgtcgtctcgctcgtcgtggtggtgtcaagcgtatctctgccatgatctacgaggagactcgcggtgttctcaagaccttccttgagggtgttatccgtgatgccgtcacctacaccgagcacgccaagcgcaagaccgtcacctccctcgatgttgtctacgccctcaagcgccagggccgcaccctctacggtttcggtggttaaacaacaacccactgttatcgtttgctttttcgttttcgtcaatcttcttctgcatgggtcttcttcagagtcgtcaattaaattggtagatcgtctcgtttcaacataagcattcgcgacgttcaacaataatgggttactcgcctggtgtggctggtgttcgctttttcctgcaacttgttttacgtgttactttgtttagtctgggattcactttacgggattttgtacattaacactcggggtattcacgatatccgatcatgaagagatgaatataccttagtcactt

SEQ ID NO: 3186 - DNA, 592 bp, Hordeum vulgare
cccattaccatcatcgagcgcctctgtgcctccattccatctctcacacagcccacaaaacactctcctcaccttcaacatgactgggcgcggcaagggcggcaaggggctcggcaagggcggcgccaagcgccaccggaaggttcttcgtgacaacatccagggcatcacgaagccggccattcgccgtcttgcgcgtcgtggtggtgtcaagcgtatctctgccatgatttacgaggagacccgtggtgttctcaagtccttcctcgagggtgtcatccgtgacgctgtcacctacactgagcacgccaagcgcaagactgtcacttctctcgacgtcgtctacgccctcaagcgccagggccgcaccctgtacggtttcggtggttaagcgtcttgctttactaccgtctgggggttgcattcggattgctggtttggggcacatggagttcacgtctgttacgaaagtcattcttcgcgcggaaagccgcctgcgcgtccacacgtgcaatacgcgtcaagcgggcggctcgtcatgatgaatcaacgggatcgggttttgtttttctgggtttacagctacaaacta

SEQ ID NO: 3187 - DNA, 722 bp, Theobroma cacao
cgggggttctctacttgattgtgatattcatcaaaatttggacggccatcattactttttttttttccactcaacttcttttaattatttctcaattctatcataatgtctggacgcggtaagggcggtaagggtcttggaaaaggtggcgccaagcgtcaccgcaagattcttcgtgacaacattcagggtatcaccaagcctgccatccgtcgtctcgctcgtcgtggtggtgtcaagcgtatttctgccatgatctacgaagagactcgtggtgtcctcaagtccttccttgagggtgtcatccgtgacgctgtcacctacaccgagcacgccaagcgcaagaccgttacctcgctcgatgtcgtctatgccctcaagcgccagggccgtaccctctacggtttcggtggttaaaccaacccccgatactatatttacggagtggtttcttcagctttacgggtacttcattattcggtcgtggtcaagcaactctgcgggaataaatcatccctcaatgctctacccacagttattgttttgtgttttgccgaggatgatcgtctttacttggggtttattgatttgatgctctgccccatgggcattgtcttgtctttgtttttatttgcgttctttcacccgacttcactaagtcgtgtccttctctttctggctttcactttcctgcaacacatctaccatcggcgtttacgggg

SEQ ID NO: 3188 - DNA, 580 bp, Saccharum officinarum
  misc_feature (49)..(49): n is a, c, g, or t
  misc_feature (71)..(71): n is a, c, g, or t
  misc_feature (84)..(84): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (114)..(114): n is a, c, g, or t
  misc_feature (119)..(119): n is a, c, g, or t
  misc_feature (140)..(140): n is a, c, g, or t
  misc_feature (147)..(148): n is a, c, g, or t
  misc_feature (198)..(198): n is a, c, g, or t
  misc_feature (471)..(472): n is a, c, g, or t
  misc_feature (488)..(488): n is a, c, g, or t
  misc_feature (518)..(519): n is a, c, g, or t
  misc_feature (533)..(533): n is a, c, g, or t
  misc_feature (558)..(558): n is a, c, g, or t
  misc_feature (561)..(561): n is a, c, g, or t
ctcctcttcacacgagcgcagacacaaccattcgcatactacttccaancaggggaggcgaccggcggcgnagatgtcgggcanaggtaaggncgncanggggctcgggaaggncggcncgaagcgtcaccggaaggtgntgcgcgnnaacatccagggcatcacgaagccggcgatccggaggctggcgaggagggncggcgtgaagcgcatctccgggctgatctacgaggagacccgcggcgttctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctaggttaggtcagggtagttgcctgtcgaggcgtctcggatcggtgttactagtttggttaccttcctgtgttcgtctggtagttgctnnagtggttgtaactggntgatttgtccgtcatgttgtgtacgtctgnnagcaccgctggttngatggaattggaatggatgacgaantangaaagttatccagtttgat

SEQ ID NO: 3189 - DNA, 490 bp, Gossypium hirsutum
gtctcttaattttggttggatatcgaagatgtcaggaagaggaaagggaggcaagggtcttggcaagggaggagctaagcgccaccgtaaggtcctccgcgacaacatccagggtatcacaaagccggcaattcgacgccttgcccgtaggggaggagtgaagcgtatcagcggcttaatctacgaggaaacccgcggggttctcaagatcttcttggagaacgtcattcgcgatgcggtcacatacaccgaacacgccaggagaaagacggtgactgccatggatgtggtttatgcactgaagaggcagggtaggactttgtatggatttggtggttagttgatttaggttctaggttataaaataggggagaattgtaggactcagttaaagttacaaggtgggttttgttgttcgctgttataatttgtaattcgcatcatcaattgcatatttttattgaattttgaaggtcattttgtcaatctt

SEQ ID NO: 3190 - DNA, 502 bp, Taraxacum officinale
attcaactcattcccaaagaaaaagaaaatgtctggaagaggaaaaggaggcaagggtttgggaaagggaggtgcgaagcgtcaccggaaagttctccgtgataacatccagggtatcacgaaaccggcgatccgccgtcttgcgaggcgtggtggcgtcaagcgtattagcggccttatctatgaggagacacgaggcgtcttgaagatcttcctcgagaacgttatccgtgacgcagttacctacaccgagcacgctcgccggaaaacagttactgccatggatgttgtctatgccttgaaacgccaaggccgcacactgtatggctttggtggttaaggtgatctaggtcaaatttgttaggctgtggtgtgttccatttacatttcctatttagttagcttttgtgtagagatgtttgatatatcggtgtaatcgaagcttgactgtgatttaagatgggtttaacttcaatttcaacttggatatttctttgatccg

SEQ ID NO: 3191 - DNA, 507 bp, Raphanus sativus
ttttttcttttaatactttgtgagaagatgtcaggaagaggaaagggaggaaagggattgggaaagggaggagccaagaggcacaggaaggtgctgagggacaacatccaaggtatcaccaagcctgccatccgtcgtcttgctcgtcgtggtggagtcaagcgtattagcggtctgatctacgaagagaccagaggagtcctcaagatcttcctcgagaatgtcatccgcgacgctgtcacctacactgagcacgctaggaggaagaccgtcaccgccatggatgtggtttatgctttgaagaggcaaggacgcactctctacggtttcggcggttaaattaaatcgaaggagttgggaattagggtttcgaaatttggggatctgaaaatttctttgtttctgattagctgaagtgaatccacgactattgtatcgttttttctgctgtgttgttagtcaatattatgttaaatgaagcttatcaagaagaaagttttatatcga

SEQ ID NO: 3192 - DNA, 502 bp, Solanum lycopersicum
cttctctataatttcatcagaaaaatgtcaggcagaggtaagggaggcaaaggattgggcaaaggaggagccaagaggcacaggaaagtgttgagagacaacattcaaggaattacaaagccagctattcgaagactcgctcgtagaggtggtgtgaagcgtatttctgggttgatttacgaagagactcgtggtgttctgaagatctttttggaaaatgtaattcgtgattccgtgacatacacagagcacgctaggagaaagacggttactgctatggatgttgtttatgcgcttaagaggcaaggaaggaccctttacggatttgggggttagggtttgccttaggattgttaattttattctcatctttgatggtgtaattctctgttatactaattcaaagaatagagtttttcttattctctccaattatctatactctttgcttatttaatttcctcttgttatcatctggggatgttattaaaattgttcctat

SEQ ID NO: 3193 - DNA, 475 bp, Triticum aestivum
  misc_feature (147)..(147): n is a, c, g, or t
actcttcgttccgttgggagctcagcatgtcggggcgcggcaagggaggcaaggggctgggcaagggcggcgccaagcgccaccggaaggtgctccgcgacaacatccagggcatcaccaagccggcgatccggcgtctcgcgcgcnggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggattcggcggctaggccgcgctctcgcgtgttagtccggtgccggtgttagccattgttagggttaccgatgtgatgtctcgtggtgtggagtgggatgtgatgcatatggtttcagattgatcaatggattcactgttgctgttccaaaa

SEQ ID NO: 3194 - DNA, 381 bp, Artemisia annua
acgagtgcgtgcagtggtattaacgcagtactccgacggggacaatcaattctcacacacatagtttcagatcccgttaccaaacagaacagtaaaaatgtcaggaagaggaaagggaggaaaaggactaggcaaaggaggagcaaagcgtcacaggaaggttctccgtgacaacatccaaggtatcactaaacccgccatccgtcgtcttgctcgtcgtggtggagtcaagcgtatcagtgggcttatctatgaagagacacgtggcgtgttgaagatctttttggagaatgtgatccgtgatgctgttacctacactgagcatgctaggaggaagactgtgactgctatggatgttgtctatgctctcaagaggcaagg

SEQ ID NO: 3195 - DNA, 570 bp, Brassica napus
ctccatctccatcagcctcaaccgccactccacacataccccaaccttcaactcaacttaactccctcccccccccccacacaacacttcatcatgactggacgcggcaaaggtggcaagggtctcggaaagggtggtgccaagcgtcaccgcaagattcttcgcgacaacatccagggtatcaccaagcccgctatccgccgtctggcgcgtcgtggtggtgtcaagcgtatctcagccatgatctacgaggagacccgtggtgttctcaaggccttccttgagggtgttatccgtgatgctgtcacctacactgagcacgccaagcgcaagactgtcacttcgctcgatgttgtctacgcactcaagcgacaaggccgcaccctgtacggtttcggtggttaagcgtttctcttcacggttttcatgttacgacttctgccggctgcttcggtttacggtcggttttgctgcttggtgggatggtcacagccttgtatagtaggctcggagtttacggtcacatcagtctgggatctgattttcatggaatgataccataatccttcc

SEQ ID NO: 3196 - DNA, 312 bp, Heritiera littoralis
tgtcaggccgtgggaagggtggcaagggttaggcaagggaggaacgaagcgtcaccgcaaggtgctccgagataacatccaaggtatcacgaagccagcgatcagacgtttggcgaggagaggcggagttaaaaggatcagtggcctgatttatgaggaaacccgaggagttttgaagatctttctggaaaatgtgatccgagacgccgttacttacacggaacatgctcggagaaagactgttacagccatggacgttgtttacgcgcttaaaaggcagggcaggactctttatggattcggtggttgaag

SEQ ID NO: 3197 - DNA, 553 bp, Avena sativa
ctcgacaacaacgccaaaaaaatacatctacctcttcaataacctcacttcccccaacaactcttcatcatgactggacgcggaaaaggtggcaagggccttggaaagggtggagcaaagcgtcatcgcaagattcttcgtgacaacatccagggtatcacaaagcctgcgatccgtcgtctcgcgcgtcgtggtggtgtcaagcgtatctcagccatgatctacgaggaaaccagaggtgttctcaagaccttccttgagggtgtcattcgcgatgcagtcacatatacagaacacgccaagcgcaagactgtcacttctctcgatgttgtctatgctctgaagcgacaaggccgtactctctacggtttcggaggttaagctttgggtacttcatggttcttctgcgatgtctgttatgaatttcttccctggctcgggctggaagatggggtatgggtcttgcttttaggtgttcaattgtatcataaggatatggggattttcggcatggttggcgatcaatgagataatcaatccaccattacacacg

SEQ ID NO: 3198 - DNA, 568 bp, Avena sativa
cttcaacgcgtctcaacgtcatctacaacatcgcgataacgcgtcacattcatctcttttcatcaagactttatcaccttcatctatcatcatgactggacgtggcaagggcggcaagggcctcggcaagggcggtgccaagcgtcaccgaaagattttgcgagacaacattcaaggaatcaccaagcccgctatccgacgtctcgctcgtcgtggcggtgtcaagcgtatttctgctatgatctacgaggagacccgtggtgttctcaagaccttcctcgagggtgtcatccgcgacgccgtcacctacactgagcacgccaagcgcaagactgtcacctccctcgacgtagtctacgctctcaagcgccagggacgtaccctctatggtttcggtggttaaacaactttctaccttgatggttcgctcttgagaaggattattcagttgcgcttgtacggcactgggatggatgtatttgactaaggcgttggggaacggatatgatattaccataggcgtcatggaagacgaccttgcaaatgaataccacattgaacattgacc

SEQ ID NO: 3199 - DNA, 831 bp, Hordeum vulgare
gcacgaggaataacatcgcataaccacaacagcaatacgtctcataccaaccatcactactaaaaaacatccacaatttactaaaatttcaatatgactggtcgtggaaaaggtggaaagggtcttggtaagggcggagccaagcgccatcgcaagattcttcgagacaacatccaaggtatcacaaaacctgctattcgccgtctcgctcgtcgtggtggagtgaaacgtatctcagctatgatatatgaagaaacgcgtggtgttctgaagactttcctagaaggcgtcatccgagatgctgtaacgtacactgagcacgcaaaaaggaaaactgtcacatctctcgatgttgtttatgcactgaaaagacaaggtcgcacactatatggtttcggaggctaaactccaattaacaccacctgttaattccatacaactgatcacgaaaatacttcaaagaggatgccaagtaatttttcaggcgtcacggaacagaccgatcccgtccttccagtcataaatttacagcaaatgctctcggttacaatgctgcgttaattcatttttcttgtaaacgttcgctagatatcacatattgaggaggaagactagcctaacgatctagacagtttatctgaaacacagacagcaaaggctaatagactttatggatatactgcgcaggcgttcgatggggaacattgatagggtcgtgaccaaggactgatacgccatgtaattgaactgaattgttcaaattagtttagacgcgaattgatgcagatagaatttaaatcaaataatacagtactactatcaaaaaaaaag

SEQ ID NO: 3200 - DNA, 360 bp, Bruguiera gymnorhiza
cggccaaaaagaaattcaaaatcctcactttcaaattgacggtagctctcttagatattccgtctcattctcgggaaaatgtcaggccgcggaaagggaggcaaggggctgggaaaaggaggagccaagaggcacaggaaggtgctgcgcgataacatccagggcatcacgaagccggccatccgccgcttagcccgtaggggtggtgtcaagaggataagtggccttatctacgaggagacccgtggcgtcctcaagatcttcctcgagaacgtgatccgcgatgccgttacttacaccgagcacgctcgccgcaagaccgttacggccatggacgtcgtgtacgccctcaagaggcag

SEQ ID NO: 3201 - DNA, 504 bp, Adiantum capillus-veneris
ggccttggaaagggaggggccaagcgccacaggaaggttttgcgcgacaatattcagggcattaccaagcccgccattcgcaggcttgctcggaggggtggtgtgaagcgcatcagtggcctaatctacgaggaaaccagaggggttctcaagatcttcttggagaatgtcattcgagatgctgtgacctacacagaacatgctcgccggaaaactgtcactgccatggatgttgtgtatgctctcaagcgtcagggtcgtactctctatggatttggtggttgagcctgcttctacttcctcaagaccaggtttttgtagaggcatttgcctttaatctttaattattgcaacctgatctcttggagcctggaattcccacactgtacagtctgtggttaaaatttagcaatacttctttggtggctatgacgaatgtcttgtcatccttttggtgtactgttctttgtgtccgttctttatctgaaggaaagcttttctggt

SEQ ID NO: 3202 - DNA, 408 bp, Zea mays
gagcttcaaaacaaataagtcaataacacaacatgtctggacgaggaaaaggaggaaaaggtttgggaaaaggtggtgctaaacgtcacggaaaaatcctccgtgataacatccaaggaatcaccaaaccagccatcagaagaccagcaagaagaggaggtgtcaaacgtatctccggtcttatctacgaagaaaccagaaccgtcttaaaatccttccttgaaggtgtcatcagagacgctgttacatacactgaacatgccaaaagaaagaccgtcacttcccttgatgttgtttacgccctaaagagacaaggaagaaccctatatggtttcggtggataaatacacacaaccccccagtagttttagctttagcattacaaatacaacacccaaatacctcccc

SEQ ID NO: 3203 - DNA, 578 bp, Zea mays
atcgcacaaatcctcttcctcgagttctcctcaaccaaattcaaagtcacagcggcgaaactcacagcgatgtctggccgcggcaagggcgggaagggtctgggcaagggcggcgccaagcgccaccgcaaggtgctgcgtgacaacatccagagcatcaccaagcaggcaatccgcacgttggctaggaggggcggcgtcaagcgcatctccgggctcatctaccaggacacccgcggcgtgctcaagatcttccacgagaacgtcatccgcgacgccgtcacctacaccgagcacgcccgccgcaagactgtgaccgccatggacgttgtctactctctcgagcgccagggccgcaccctctacagtttcggcggttaggtcgcccctctcccggaggctaattacatggtggccgtggccgtcaagtagtgttcttagtgctagcacactgtgtacgtctgatcggagctagcttctgcggtggctgtactgcatcgttctacttactagaccacgtgatgcaacatctcgcagcggaaaaaaggggaagtgctcctgcagataataaaaccaga

SEQ ID NO: 3204 - DNA, 539 bp, Zea mays
accaaattcaaagtcacagcggcgaaactctcctttatgtctggccgcggcaagggcgggaagggtctgggcaagggcggcgccaagcgccaccgcaaggtgctgcgtgacaacatccagggcatcaccaagccggcgatccgcaagttggcaaggaggggcggcgtcaagcacatctccgggctcatctacgaggagacccgcggcgtgctcaagatcttcctcgagaacgtcatccacgacgccgtcacctacaccgagcacgcccgccacaagactgtgaccgccatggacgttgtctacactctcaatcgccagggccgcaccctctactgttttttttgttaggtcgcccctctcccggtggcgaagtacgtggtggctgtggcggtcgtgttatattcttggtctagttaggctgtgttgtctttatcggcggtgttatctgggggagttgtactgcatcgttccaaaagcgaattccatgtgctgtaaaatccccgctgctgcaatcaaaggaatgtcctcattccaagcat

SEQ ID NO: 3205 - DNA, 581 bp, Picea glauca
cacaactgcgtttgagattgttcttcatccgacttttatccaactaattatctagcaatatgactggacgcggcaagggcggcaagggtctcggcaagggcggagccaagcgtcaccgcaagatcttgcgtgacaacatccagggtatcactaagcccgctatccgtcgtctcgcacgtcgtggtggtgtcaagcgtatttctgctatgatctacgaagagacccgtggtgtcctgaagaccttcctcgagagcgtcattcgtgatgccgtcacttacactgagcacgccaagcgcaagaccgtcacctccctcgacgttgtctacgcactcaagcgccagggccgtaccctctacggtttcggtggctaagcgtcttctcttcttggcacgacgcgtgctgcgccttcaaccccgctgaggttgttggcgattcacacggtcacggcactttgttcatgggtacgatctggttcacggctatcggtcttcggcgtttttattgtatgggtctggatgcttctgacgagatttgcgtctcttgctggctggcgatagtcaatgctatacatatctcactca

SEQ ID NO: 3206 - DNA, 723 bp, Picea glauca
ggcacgaggcccgcttacgacaaccaaaacaatccgaccttatcagaacacaacccctcacacaacaaccactactaaccatctagcatcatgactggacgtggcaagggcggtaaaggtcttggaaagggtggtgccaagcgtcaccgtaagattcttcgtgacaacatccagggtatcaccaagcctgccatccgtcgtctcgctcgtcgtggaggtgtcaagcgtatctctgctatgatctacgaggagacccgtggtgttctcaagaccttcctcgagggtgtcatccgtgacgctgtcacctacaccgagcacgccaagcgcaagaccgtcacctccctagatgtcgtctacgctctcaaacgccagggacgcaccttgtatggtttcggtggttaaagtctcggagaaatgttggtgggttggccgctacatgtcaaacttggctggagttttgggctaggcttttttgtaacgtcaatggggttgtgctatctgcagcggctttatttgcttttgtccaaagggcaaacgtgtgatacggttatcatgagttgccttgttttagtttcaagcataacgaacatttctacccgtgcgtttcctactgtgctcgtaaaccacctgggcagcttgcgagacaaaaatctagggaggagagtagagtactgtatattgcttctatttttaaggttattagccctcgctcctgataaaaaa

SEQ ID NO: 3207 - DNA, 654 bp, Picea glauca
gcacgaggcaccggtacacttcaccattcgcgttccatcaactatcaacaactctgcattacattcatctaactctatccaccaaccacctcattcatcatgactggacgcggtaaaggcggcaaggggcttggcaaaggcggcgctaaacgtcaccgaaagatcctcagagacaatatccaaggaataaccaagccagccattcgtcgtcttgctcgtcgtggcggtgtcaagcgtatctcggctatgatctacgaagaaactcgtggtgtattgaagagcttcttggaatcagtcattcgtgatgcagtcacctacactgaacacgcaaagcgaaagactgtcacttctctcgatgttgtgtacgccttgaagcgacaaggacgcactctctacggtttcggtggttgagcggatgctttcttttgcacgtttgctatcactatgggatcatggagcttatggttgacacgatttggcgtcatggagtattgcggaatacattcttctgatgtttgagagagaatattgttgggtttttggcctttgcgagaaactgatatgataaatcgcatggaggtattggtgagccttgaagaagagataacaaatcattgaagttattcctcaatacaaatagcagactttgacctt

SEQ ID NO: 3208 - DNA, 597 bp, Picea glauca
  misc_feature (454)..(454): n is a, c, g, or t
  misc_feature (462)..(462): n is a, c, g, or t
  misc_feature (580)..(580): n is a, c, g, or t
cttcctcaaagtttcacgcaaccatcttcgctaaatcaatcgcttcggcttcaatcaatctacttcacttttaaacaactttcacaatgactggacgtggaaagggtggcaagggtctcggaaagggtggtgccaagcgtcatcgcaagattcttcgtgacaacatccagggtatcaccaagcccgctatccgccgtctcgctcgtcgtggtggtgtcaagcgtatctctgctatgatctacgaggagacccgtggtgttctcaagaccttcctcgagggtgtcatccgtgacgctgtcacctacaccgagcacgccaagcgtaagaccgttacctccctcgatgttgtctatgccctcaagcgccagggtcgcaccctttacggtttcggtggttaagtttattgcttttttcgatgtggtgttttgcaatcggtgttcatatgagataatgncttttttntctctctgggttctcttttgaatggggattgggttctttttttcacctcatgggatttgtactatagcggtcttctggttttcacgaggaaatgaatacgggaacagtgttcttcctngtcggactattaaaaaa

SEQ ID NO: 3209 - DNA, 556 bp, Picea glauca
atttcacttctcttcttgttgctacacagacctgatcctctcaggacttcttcaaccaaacccacaacacacacaaactatccaacatgactggacgcggcaagggcggcaagggtctcggcaagggcggtgccaagcgccaccggaagattcttcgtgacaacattcaaggcattacaaagccggctattcgccgtcttgcccgtcgtggtggtgtcaagcgtatttctgctatgatctacgaggagacccgcggtgttctcaagtccttccttgagggtgtcattcgcgacgctgtgacatacactgagcacgctaagcggaagacggttacgtcgctcgatgtggtctatgccctgaagcggcaaggccgcaccctgtacggcttcggcggttaggtttaatgattttatgtttctctggtttcgggctgtgggctgttcggtatcggacgtgatgatacttatgggatttgtttattggtttgcggttactgtaacatatgggcattctggtgtttctacgttaataacgtgatttattttcttcgaaaaaa

SEQ ID NO: 3210 - DNA, 543 bp, Saccharum officinarum
ctcctgatccgcattccaagttccagcagagaaactctcggtttccgcgatgtccgggcgcggcaagggcggcaaggggctgggcaagggcagcaccaagcgccaccgcaaggtgctgcgcgacaacatgcagggcatcaccaagcccgcgatccggatgctggcgaggaggggcggcgtcaagcgcatctccgggctcatctacgaggagacccgcggcgtgctcaagatcttcctcgagaacgtcatacgcgacgccgtcaactacaccgagcacgcccgacgcaagaccgtgaccggcatggacgtcgtctacgcgctcaagcgccagggccgcaccctctacagctatagcggctaggtcattcctcatccggtggcgaactgcatgtggtggcggaggtggtcgtgttgtgtgccgtgtctagtgtagtctgctctctgtatcggtgctgtgttctgaggaggttgtgctctatctacgctatgggtgttgctgtaatattagttgtcattatcaatggaaaaccatcggttctagcc

SEQ ID NO: 3211 - DNA, 665 bp, Saccharum officinarum
caaccatctccatcagcctcatcagctccatcacacaaccacttcccactttccaccaccacacacctcaatcaaaatgactggacgcggcaagggcggcaagggtcttggaaagggcggtgccaagcgccaccgcaagattttgcgcgacaacatccagggtatcaccaagcccgccatccgtcgtctcgctcgtcgtggcggtgtcaagcgtatctctgccatgatctacgaggagacccgcggtgtcctcaagaccttcctcgagggtgtcatccgcgacgccgtcacctacaccgagcacgccaagcgcaagaccgtcacctccctcgacgtcgtctacgccctcaagcgtcaaggccgtaccctctacggtttcggtggttaaacagctcactctctctacgagctgtttccgacaaatcatcaaccttcttcacaatcatcacgacaacacaacatcagatatccacccacatggcgagagctgggcatgcgggtatggcgcgaacggtctgggacacaatgggttttttcttttagggttctgtttttgagtgcgatgcgagcagtagtcaaagggccacggccagactttggaggctttgagtgtaaaatagcccaactatgagtgttcaccacagtgacaccatcaatcaattgat

SEQ ID NO: 3212 - DNA, 487 bp, Tamarix hispida
  misc_feature (457)..(457): n is a, c, g, or t
ggggatcgcattacatcgcacgtatcaatcttcagccgtaccgccaccaaacaacctccacaaccaaacacctccccccctcaatctatcaacatgactggacgcggcaagggcggcaagggtctcggcaagggtggcgccaagcgacaccgaaagattcttcgcgacaacatccagggtattaccaagcccgccatccggcgtctcgctcgccgaggtggtgtcaagcgtatctctgccatgatctacgaggagacccgaggtgttctcaagtctttcctcgagggcgtcatccgtgacgctgtcacctacaccgagcacgccaagcgcaagactgtgacctcgctggatgtcgtctacgcgctcaagcgacaaggccgcactctgtacggtttcggtggttaagtcggtggtcgccattgcatgtctgttatgaactactggggtgcttttgtcntgaagactacgggatcggcttggttttggg

SEQ ID NO: 3213 - DNA, 776 bp, Triticum aestivum
aacagcaatacgtttcataccaaccatcactactaaaaaacatccacaatttactaaaatttcaatatgactggtcgtggaaaaggtggaaagggtcttggtaagggcggagccaagcgccatcgcaagattcttcgagacaacatccaaggtatcacaaaacctgctattcgccgtctcgctcgtcgtggtggagtgaaacgtatctcagctatgatatatgaagaaacgcgtggtgttctgaagactttcctagaaggcgtcatccgagatgctgtaacgtacactgagcacgcaaaaaggaaaactgtcacatctctcgatgttgtttatgcattgaaaagacaaggtcgcacactatatggtttcggaggctaaactccaattaacaccacctgttaattccatacaactgatcacgaaaatacttcaaagaggatgccaagtaatttttcaggcgtcacggaacagaccgatcccgtccttccagtcataaatttacaacaaatgctctcggttacaatgctgcgttaattcatttttcttgtaaacgttcgctagatatcacatattgaggaggaagactagcctaacgatctagacagtttatctgaaacacagacagcagaggctaatagactttatggatatactgcgcaggcgttcgacggtgaacattgatagggtcgtgaccaaggactgacacgccatgtaattgaactgaattgttcaaattagtttagacgcgaattgatgcaggtagaatttaaatcaaa

SEQ ID NO: 3214 - DNA, 1891 bp, Hordeum vulgare
cacctcctcctgccccttcctcccacctccactctcatccccattcgccttcccccacgacgacctcctcgacctctacctccccgccgaccccttcttcctcccacccccaccccccttccccgcccccacaccgcacgccttcctcctccacgacctcaccgaccgcgtcgccgcgctcgagctcgcggcccgcgccgcggccccgcagccggcccgccgcaagtacacctacgccgccgcctccccggggggccgcaaggtgaaatggacggccgaggacaagccccgcggcgggggccggtccctcaaatgggaggcggagctcgcctcccccaacgacgacggattcgaccgcaagtggaagtgggaggccaagtccaagcccggcgccggaggcaagaccaagaccaagtggggcaccgagatcaagggcaagggctcgctcgagccgtggtcccacgcctacacctgggaggaggacttcagcgcctccgacgatgacgaggatgccgactacccggaggagcgccgcaggccggagcagaagaaggagcccaagaagatcaaggccgccgccaaggaggagaagaagccggccaggaagtccgtccacatcgaggagatccccgaggacaacaccgccggctgcgacgccatccgcaaggcgtttgccatggggaacggcaaggggaaggccaaggagctgtcgccgcaggacgccgcgctgctcatccagatgaactacagggcgcacctcgcccaccgttcccaggtgctccgctgcctgcgtgatctcgccgtggccaaggccaagctcaaggagctcaggtccctgttctacaacctctcctacaggcgccgcctctcgcatgaccacgaagagcgccagaggttctctgagaagatcattgtcctgctcctcaccgtcgatgcgctcgagggacctgacttcatggtgaggacggcgaagaaatctatgctggaggaactcgagagcatgcttgagattgtggacccacagccaccagggaagcagaggtcgttcagccgccgcaagtttgatcttccagagggcggggcgatcccgaatgagaaaactgcaggcgtgaacaatgctgtcagagtcatcaacactggcaagggcaagcagtaggcaccgccgcgcgcctagtttagtggtggtaccatggccgattgatggagcttgtagcgccgctttgtctgtgagtggtccggttcatcttagatttccagtacctttgagatttgagaaggattgaacttgtcgtgcaccgttattcaggatgtcgtagcgtgtaatgtatgatccgtaccggtaccatttgctttggatttgttgtaatgtatgttgttgttgaactaaaaaaaaaaaaaaaaaactccaccgtacctcagattccacatccgctctctgctcgctcacaggtcgagataagggaggcaaggggctcggcaagggcggcgccaagcgccaccggaaggtgctgcgcgacaacatccagggcatcaccaagccggcgatccggcggctggctcgccgtggcggcgtgaagcgcatctcggggctcatctacgagacccgcggcgtgctcaagatcttcctcgagaacgtcatccgcgacgccgtcacctacaccgagcacgcccgccgcaagaccgtcaccgccatggacgtcgtctacgcgctcagcaccctctacggattcggcggctcctgcgcccgctgctccagtctccatcgagtaggctctgctagctgctgcggctgtttctggtgctgtggtttcgtttctgaattctgagtgtgtgcgtgcgttgttgttccatctgtccgtgtagctagtggaaggcgatggatctgaatgca

SEQ ID NO: 3215 - DNA, 549 bp, Camellia sinensis
tcgaatcattcagttgaatttcactagaaatgtcgggagaggaaggaggaaggtgggaagggaggagcgagaggccaggaaagtcctcagagacaacatccagggaatcaccaagcccgcgatcaggaggctggctcggaggggaggagtgaagcgtatcagcggtctgatctacgaggagacacgtggagtgctcaagatcttcctagagaacgtgattcgtgatgctgtcacatacactgagcatgctcgccgcaagactgtcacggccatggacgttgtttatgccctcaagaggcaggggagaactctctatgggtttgggggttagggtttttggtcacaaaagtcttgctgtcaagaaagagaggtcatggggatgtttagggttctgggtttgttagggttagttacgagtattggggtttgttttacattcgtgtaattataagttgtttctgatttcttgcatttcgtcttctactactactactacttgtagtgttcttgttaaggcattgttatgaaacttcaatttcagaattactt

SEQ ID NO: 3216 - DNA, 617 bp, Hordeum vulgare
acttcttctcccaaatccagcgacgatgtccgggcgcggcaagggcggcaagggtctgggcaagggcggcgccaagcgccaccggaaggtcctccgggacaacatccagggcatcaccaagccggccatccggaggctggccaggaggggaggcgtcaagcgcatctccggcctcatttacgaggaaacccgaggagtcctaaaaatcttcctgaaaaacgtattccgcaacgccgtaacctacaccgagcacgcccgccgaaagacctgacccgccatggacttggtttacgctctaaagcgccagggccgcaccttttagggtttcagaggctatacgctttgcgtagggagaacaactggctcattagctctgcgagatgtgcgctggggtgaatggggtctaccgatttggcgtgccccgttgtgtctctgtctttgggttcaataggctgtgtaatagcaccatgttctgtaaaatgacaatagttcgattcttgaaaaaaataacaataaaaatccttgggggggggccccgtacccaaattccccttatagagagtgttataacaatacaggggccgtcgtttaacaacgttgtgagtgagaaacccctc

SEQ ID NO: 3217 - DNA, 578 bp, Taraxacum officinale
ttcttcagatctgctaagtttcaggctttggagcatattgcagaactttgagaatgtctggacgtgaaaagggaggaaagggtttggggaaaggaggcgccaagcgtcatcgataaggttctacgagacaacatccaaggaataacgaaaccggcgattcgtcgtctggcgagaagaggatgtgtgaagcgtatcaccggtttgatctacgaggaaactcgcggagttttgaagatctttctagacaatgtcatcatagacgccgttccctacaccgagcacgcacgccagaaaactgtcgccgccatggatgtggtgtatgcgctcaagagacaaggccgaactctgtacggattcagtggatacgttgtctaagtcgtaaatcggagttagttaagtatttgtcttacttttagggatttctacttcttgttgaaatcaaatgttgttagtatcagctttggacatttttatctgatgaaaggcagttgatcttccatgaaatcaggtctttggaatttgcttgtcttgtctgccgcatcagctgaatgaattttaaatgcatgcatgatgaagaa

SEQ ID NO: 3218 - DNA, 919 bp, Arachis hypogaea
gggtatcggccattacggccgggggatcattagcattttgctttacggtggcctggttaacctcacctccgcagagagaaagctagtagccatgtctggaagaggtaagggaggaaaaggtcttttgaccggaggagcaaagcgccaccgcaaggttctgagagataacatccaggggatgcgcgaagcccgccattcgccgtctcgcaaggcgtggtggtgtcaagcgtattagcggcctcatctacgaggagacacgtggcgtcctcaagatcttccttgagaacgtcattcgtgatgccgttacctacactgagcatgctcgcctcattactgtcaccgccatggatgttgtctacgccctcaagaggcatgttttgacactctacggatttggaggctaaacatttcagaattgggaatttgttatcactatgttagaattagttttatgcgcgtcttccttctattctgctctgttttttgtcgataattgtattgtggattagctttccgattagggtctttaattggtctacgcgatgtgtcgacgacatgtaattcgtgggaggtacggcgccccgggtcggcgtgcctgggcccattggaatcatgacgcatgctaagttttgcatgccggcgaaatttatgggtcctttggtcgatgccgcccgatgagggattaaattttgttcgttctgcgagtgagatattctcaccttccggaagatgggagacacctgacaggccgccaataagtcgtccgcgcgggctagtcccccctttgcgaagccggggggttatctgtgcacatatcttgcgctatcacgtttttttgccgctaaatggggtggtatatccgcagccctactaggcgaatactgtccgctttacggtgtgcgggccggcgaggtacagt

SEQ ID NO: 3219 - DNA, 640 bp, Picea glauca
gcacgaggcaacatcttatccgccactactactactactccacatccaaagcttcaagcttcactacaaacacactcaactcacttcacttttctcatccctcaatcaacatgactggacgcggcaaaggtggcaagggtctcggaaagggcggtgcaaagcgtcaccgaaagattcttcgcgacaacatccagggtataactaagccagctatccgccgtctcgctcgtcgtggtggtgtcaagcgtatctcagccatgatttacgaggaaacccgcggcgttctcaaatctttcttggaatcagtcattcgtgacgccgtcacatacactgagcacgcaaagcgaaagacagtcacctctctcgatgtcgtctacgctctcaagcgtcaaggtcgcacattgtacggtttcggtggttaggcgcgcacttcgtttcatctttgtcatgggttttcacgatttttgggggcactgccaactagctttctcaatgggattgagagtatcatgatcgactggctacggcttgggcatggggtcatggggtcatggggttgcagtgtatcatacggattacggagtcattgggtcgccatcagggaatgataccagcataatccaaactgcaaattgctcat

SEQ ID NO: 3220 - DNA, 346 bp, Helianthus annuus
gcggggatcatccaaacaacaccatttactcattcaattcaatttctagagagagagacaatgtcaggaagaggtaagggaggcaaggggttaggaaagggaggagctaaacgacaccgtaaagttctccgtgataacatccagggtatcacgaagcctgcaatccgtcgtcttgcaagacgtggtgtagtgaagcgtattagcggtttgatctacgaggagacacgtggcgtcttaaagatctttttggagaatgtgattcgtgatgcggttacctacacagagcatgctcgccggaagactgttactgccatggatgtcgtttatgctttgaaacgacagggtc

SEQ ID NO: 3221 - DNA, 654 bp, Volvox carteri
atggccggccgtggcaagggtaagactgcaggaaagaaagctgtcagccgcagcgccaaggcagggctacagtttcctgtgggccgtattgcccgttacttgaagaagggcaagtacgctgagcgcatcggtgctggcgctcctgtctacttggctgctgtgctggagtacctgactgccgaggtgctggagctggcaggcaacgcagctcgtgacaacaagaagaatcgcattgttccgcgccatatccagcttgccatccgcaatgatgaggagctgggcaagctcctgggcgatgtgaccattgcgtccggtggtgtgctgcctaacatccacgctgtgctgctgcccaagaagtcgggaggcaagggtcttggcaagggcggcgccaagcgtcatcgcaaggtgctccgcgataacatccagggcattaccaagcccgccatccgtcgtttggctcgccgcggtggcgtgaagcgtatcagtggtctcatctacgaggagacgcgaaccgtgctcaagaactttttggagaacgtcatacgcgattccgtcacctatactgagcacgctcgccgcaagactgtgacagctatggatgtcgtctatgccctcaagcgccagggccgcaccctctacggcttcggtggttaa

SEQ ID NO: 3222 - DNA, 423 bp, Triticum aestivum
  misc_feature (99)..(99): n is a, c, g, or t
  misc_feature (227)..(227): n is a, c, g, or t
  misc_feature (256)..(256): n is a, c, g, or t
  misc_feature (297)..(297): n is a, c, g, or t
  misc_feature (306)..(306): n is a, c, g, or t
  misc_feature (319)..(319): n is a, c, g, or t
  misc_feature (325)..(325): n is a, c, g, or t
  misc_feature (357)..(357): n is a, c, g, or t
  misc_feature (375)..(375): n is a, c, g, or t
  misc_feature (383)..(383): n is a, c, g, or t
  misc_feature (404)..(404): n is a, c, g, or t
  misc_feature (417)..(417): n is a, c, g, or t
gcgactcccattatcccctgttagactgcttccatctcatctccggcgatgtctgggcgtggcaagggcggcaaggggctcggtaagggcggcgccaancgccaccggaaggtgctccgcgacaacatccagggcatcaccaagccggcgatccggaggctggcgaggaggggcggcgtgaagcgcatctcggggctcatctacgaggagacccgcggcgtcctcangatcttcctcgagaacgtcatccgcgacncccgtcacctacaccgagcacgcccgtcgcaagaccgtcancgccatggncgtcgtgtacgcnctcaancgccagggccgcaccctctacggtcttttggncgggctgagcgccatcangctccacntggggttgaccctggctgttnccttgcggttgantccggt

SEQ ID NO: 3223 - DNA, 659 bp, Triticum aestivum
  misc_feature (12)..(12): n is a, c, g, or t
caccactacaantcagcctcatcagctccatcaaacaaccacttcccacttccacaaaccaccaacctcaatcaacatgactggacgcggcaagggcggcaagggtctcggaaagggtggcgccaagcgtcaccgcaagatcttgcgcgacaacatccagggtatcaccaagcccgccatccgccgtctcgcgcgtcgtggtggtgtcaagcgtatctctgccatgatctacgaggagacccgcggtgttctcaagaccttcctcgagggtgtcatccgcgacgctgtcacctacactgagcacgccaagcgcaagaccgtcacctccctcgacgtcgtctacgctctcaagcgtcaaggccgcaccctttacggtttcggtggttaagcagctcatcccactgcttcgacaacaatcaaccttcttcacaacaacaatcatcacgacacaacatcagatatccacccacatggcgagggtatggcgcgatcaggaatgggttcatcggtttttctttttgggttcagtttttgagtgcgatgcgagagagagagcaaagggccacggccagaggcttcaagtgtagaatagcccactatgagtgttcaccacagtgacaccaatcaatcaaatgaatatgcatcaaccaaaaaaaaaa

SEQ ID NO: 3224 - DNA, 578 bp, Triticum aestivum
ggggacaacaccaagcaactcttcagcctcaacaccacaaacaactatccccaccacacatcttcctcccaaacacccccacacttcaacatgactggacgcggcaaaggtggcaagggtctcggcaagggtggagccaagcgtcaccgcaagattctccgcgacaacatccagggtatcaccaagcccgctatccgccgtctcgctcgtcgtggtggtgtcaagcgtatctcagccatgatctacgaggagacccgcggtgttctcaagaccttcctcgagggtgtcatccgtgacgccgtcacctacaccgagcacgccaagcgcaagaccgtcacttcgctcgacgttgtctacgccctcaagcgtcaaggaaggactctctacggtttcggtggttaagcgcatttcattcacggttttcatgttacgactttgccgcctcatcggttcacggcaggctttggtgctcggcgggatggttaggggtcatggccttgtatagtaggcttcggagttcacggtcacatcagtctcatcaggattgttttcatggaatgataccataattcttcatc

SEQ ID NO: 3225 - DNA, 448 bp, Brassica juncea
  misc_feature (378)..(378): n is a, c, g, or t
gactcaaatcatcaacatatttatttttttcataatcagagtttgaatattaaaatttcccgagaaaaatgtctgggcgaggaaagggaggcaaaggattaggaaagggaggagccaagaggcatcggaaagttctccgagacaacatccaaggaatcacgaagccagcgatccgtcgtctcgcgagaagaggaggagtgaagcgtatcagcggtctgatctacgaagagactcgcggcgttctcaagatctttttggagaacgtgatccgcgacgccgttacatacacggagcacgctcgccggaaaacagtcacggccatggacgttgtgtacgctctcaagaggcagggacgaactctttacggattcggcggtnaatttcgatggtttcagtttcagatcttgtaaaatctttttcagaatcaatgggataatatgcatcttat

SEQ ID NO: 3226 - DNA, 468 bp, Beta vulgaris
gcacgaggcaaaaacaaaagaagagagaaaatgtcaggaagaggaaagggaggaaaagggttaggcaaaggaggagcaaagagacacagaaaagtgttaagagacaatattcaaggtattaccaagcctgctattcgtcgtctcgcaagaagaggtggtgttaagagaatcagtgggctgatttatgaagaaactcgcggtgttttgaagatctttttggagaatgttatcagagatgctgttacttacactgagcatgctcgtcgtaagacggttactgccatggatgttgtctatgctcttaagagacaaggtcgtactctctatggttttggtggttaaatagggttgtcaattaattagctaaaaattttagtgttgtttttatatatgcatctatttgatgtatttggatattgtaagttgttcgtatgaaatagtgaaactgcgtttcttgagctgtttaaa

SEQ ID NO: 3227 - DNA, 495 bp, Manihot esculenta
  misc_feature (178)..(178): n is a, c, g, or t
  misc_feature (331)..(331): n is a, c, g, or t
ctctttagctctaatttcgatcaacgagaagatgtcgggccgcggaaagggaggaaaggggctgggaaagggaggagcgaagcggcacaggaaggttcttcgcgataacatccagggaatcactaagcctgcaattcgtcgtctggctcgaagaggtggcgtcaagaggatcagtggnttgatttacgaagagacccgtggagtcttgaaaattttcttggaaaatgtgatccgtgatgccgtgacttacactgagcacgcaagaagaaagacggtgactgccatggatgtggtgtatgcattgaagaggcagggtaggactctgtacggnttcggtggttaaagttgaagctttttgttgtaattagtttttgtattttagggattgttgattattgtgtaggaaagttaatgggtttcgtttaattcatgttttggattgcaatagcaatgaaattggattcagtttcttttataaaaataaaaaaaaaatgc

SEQ ID NO: 3228 - DNA, 479 bp, Cucumis melo
cctttcttcattacttcaaatcaatcaagaaaatgtctggccgtggaaagggaggaaaggggttggggaagggaggagcaaagcgtcaccggaaggttttgagagacaacattcagggcattaccaagcccgccattcgccgtttggctcgtagaggtggtgtgaagcgtatcagtggattgatctatgaggaaaccagaggggttttgaagattttcctcgaaaatgtgattcgtgatgctgttacttacaccgagcatgcaaggaggaagacggtgactgctatggatgttgtttatgccttgaaaaggcagggaaggactttgtatggttttggaggttaggttatggttttggtctagagaatcgttgtataggttgcctcttttctgctgggtctctttgtttctgcaagttcttttcttattgttctgctagaatgataatcgttcattatcaaattatgcttttacctcact

SEQ ID NO: 3229 - DNA, 546 bp, Fragaria vesca
aaagatccgaattcgaaaaccgaatcaaaaatgtcgggtcggggcaagggaggcaagggtttgggcaaaggcggagccaagcggcacaggaaggtcctccgcgacaacatccagggcatcacgaagccggccatacgccgtctcgctcgccgtggcggagtgaagaggatcagcggcctcatctacgaggagacacgtggcgtcctcaagatcttcctggagaatgtgatccgcgacgccgtgacgtacaccgagcacgccaggagaaagacggtgacggccatggacgtcgtctacgcgctcaagaggcaaggcaggactctctatgggttcggcggctagggttgtggtttgggatatggggaattgtaaaggggattttgggttgtggtttcggctgtggttggatttagggtttttcttataaagtagtagtgggctttgaagttgttgttaggtttattttgaatgaagaatcgacttgcttcttttacctgatgttgttaattgaatggtttgcatttgatctgaaatttcaatttgttg

SEQ ID NO: 3230 - DNA, 454 bp, Helianthus annuus
acgcggggaaacccaaattcaccacaaatacaatgtcaggaagaggaaagggaggcaaggggctgggaaagggaggagcaaaacgacaccgtaaagttctacgtgataacatccagggtatcaccaagccggcgatcaggaggctggcgagaagaggaggtgtgaagcgtattagcggtttaatttacgaggagacacgtggcgtcttgaagatctttttggagaatgtgatccgtgatgcggttacctacacagagcatgctcgccggaagactgttactgccatggatgtcgtttatgctttgaaacgacagggccgtaccctctatggctttgggggttgaattatatttagggtttggttgttttttcacagatctattgttttaactttgttcatatatctgtgtaattgaatcttctaatgcaattcagttgtttgattctgcgattc

SEQ ID NO: 3231 - DNA, 436 bp, Helianthus annuus
ccacgcgtccgccaatctacaatcagcaatcatgtcaggaagagggaaaggaggaaaggggttgggaaaaggaggagcaaaacgacaccgtaaggttctccgtgacaacattcagggcatcaccaaaccggcgatccgacggttggcgagacgtgggggagtgaagcgtataagcggtctgatatatgaggagacgcgtggtgttctcaagatctttctagaaaatgtaattcgtgacgccgttacctacaccgagcatgctcgccggaaaactgttactgctatggatgtggtttatgcgttgaagcgtcagggacgcactctgtacggtttcggtggttaggtttggttagtgtgagggaagttggatttggagtgtttggttattgttttgtgatgtatgatagttaatggaatgaaaagttagatttgattt

SEQ ID NO: 3232 - DNA, 544 bp, Helianthus annuus
  misc_feature (2)..(2): n is a, c, g, or t
  misc_feature (511)..(511): n is a, c, g, or t
gnaataaaaacacaacaaaaaagtcaaacacaatgtctggaagaggaaaaggaggaaaggggctgggcaagggcggagcaaagcgtcaccggaaagttctccgtgataacatccagggtatcacgaagccggcgattcggcgtctggctcgccgtggcggcgttaagcgaatcagcgggcttatctacgaggagacacgtggcgtcttgaagatatttttggaaaatgttattcgtgatgcggtaacctacacagagcatgctcgccggaaaacggttactgctatggatgtcgtttatgcgttgaagcgacagggccgtactctctacggttttggtggttaggttaggttagggtttgttggtttgttttctttttcacagatctgttagtttgaatttgtttatacatctgtgtaattgaagcttttaatgcaatgcgattatggtttaggttttgtttgtttttaatttggattttgaattgctagctttgcattttaacatggcgnaaaaaaaaggcccttttgcttaaaaaccttgtc

SEQ ID NO: 3233 - DNA, 491 bp, Beta vulgaris
  misc_feature (170)..(170): n is a, c, g, or t
  misc_feature (207)..(207): n is a, c, g, or t
  misc_feature (327)..(327): n is a, c, g, or t
  misc_feature (356)..(356): n is a, c, g, or t
  misc_feature (361)..(361): n is a, c, g, or t
  misc_feature (381)..(381): n is a, c, g, or t
  misc_feature (396)..(396): n is a, c, g, or t
aaaactgagcaaaagaggagagagaaaatgtcaggaagaggaaagggaggcaagggtttaggaaagggtggtgcaaagagacataggaaggtgttgagggacaatattcagggtatcactaaacccgccattcgtcgattggccagaagaggtggagttaagagaatcantggtcttatttatgaggaaactcgtggtgttttgaanatcttcttggaaaatgttattcgtgatgctgttacttatactgaacacgctcgtcgtaaaactgtcaccgccatggatgttgtctatgctcttaagaggcaaggtcgcactctttacggnttcggtggttaatttattttatttttagngtagntttgtttctatatatagtangttcagttgttttantggaattaaaagagaattttactctgtttgatgtaattgcaaaatccatgatgatatcaaatattagctgacttttggttatcaaaaaaaaaaaa

SEQ ID NO: 3234 - DNA, 835 bp, Picea glauca
cattttggttgagtgcagagaaagaaaggatgtctgggcgtggaaagggaggcaagggtttggggaagggaggtgcaaagaggcacaggaaagttctgagagacaacattcagggcattaccaagcccgccatcaggcgtcttgccaggagaggaggcgttaagcggatcagtggtctcatctatgaagagaccagaggtgtcctcaagatcttcttggaaaatgtgatcagagatgccgtgacatacacagagcacgccaggaggaagactgtgacagccatggatgttgtatactccctgaagaggcagggccgaaccctatatggcttcggaggctgaatatgggaagttttgctatgccagttgttcattccttctataaagtatcattcacttacccacctatggtgtctttcgacaccaccttccacttctctgggatctcttaacctggttactactactgtcagtttcatcactcgttagtctatatgaattatcttttctaagcaggttgctagttagttatatttggtctatttagttgctgttttcaatttttggtatatttttttataccaatatgatgcttcccttagggctttgaatccagttggagtttggtaagacacagttcctgtatttttggagaatgaacacgcaggtctattatgtgtaatgtgggaaaaaatgttcactggctgtgaatccagttggggtttggtaagacacaattccttttgttttggagaatgaacacgcaggtctattttgtgtaatgtgcgaggaattgttcactggctgtgaatccagttggggtttggtgggacaca

SEQ ID NO: 3235 - DNA, 581 bp, Solanum tuberosum
  misc_feature (61)..(61): n is a, c, g, or t
cgtgtacgaggaaaacttctcaaaaaatgtctggccgtggaaagggtggcaagggattagncaagggtggagcaaaacgtcatcgcaaggtgcttcgtgacaacatccagggaatcaccaagcctgctattaggaggttggcgagaagaggtggagtcaagagaatcagtgggttgatttatgaagagacaagaggtgttcttaagatctttttggaaaatgtgattcgtgattctgttacctacacagagcatgctaggaggaagactgttactgctatggatgttgtttatgctttgaagagacaaggaaggactctctatggtttcggtggttaagaccttagatctgggttattgggtattagtagtattttagttttgttgatgtaattggttatgtttctgaatctatgaaatatcttgtttctgtgtttcgaatttggtcgttttatggctatgaatgtgaagaatggttttatttaatggaaaatatatcttatttctgtgtttcaattgcttcaaaattggttcttttcatctcttgataatgagaaactgtctaattagttgttttgaacc

SEQ ID NO: 3236 - DNA, 545 bp, Volvox carteri
ttcatttctcaccaagtaaccatgtcgggacgtggcaagggcggaaagggcttgggcaagggaggagctaagcgccatcgcaaggtgcttcgcgacaacattcagggtatcacgaagcctgctatccgtcgtctggcacgtcgtggcggtgtgaagcgtatcagcggcctcatctacgaggagacccgcaccgtgctgaagaacttccttgagaatgtcatccgtgactcggtcacgtacactgagcacgctcgccgcaagactgtgactgccatggacgtcgtgtatgctctgaagcgccagggccgcaccctctacggcttcggtggttaagctggaggtggcgtcgatgggttctgcaagcccaccataaaacccggtgtttttaaacaccaccaacgttcattcaatttcgtttcacttccgctgctcctgcttttttttattttccgccattgcttctgcgaagtgaagtgctagcgagtcatgtccgattccgtacaggcagggaatgtcgaacaggaaagggacaccctacctgttca

SEQ ID NO: 3237 - DNA, 540 bp, Avena sativa
taacttttaaagcacaacttcaatcaaacaaaatgagcacagtaactggtggacgaggaaaaggaggaaagggactcggaaaaggaggagccaaacgacatcgaaaagtctttcgtgacaacattcaaggcatcacgaaaccagccattcgaagacttgccagaagaggaggagtgaaacgaatctctggactcatttacgaagaaactcgaactgttttgaaatccttcttggaaaacgtgattcgagacgcagtgacatacacagaacatgccagaagaaaaacagtgacttcgatggatgttgtttatgctctgaaacgacaaggaagaaccctttacggctttggtggataaattcaaatttgctaagaaggaaaatagatgtgcgagaccaacaacacttctaaacagaaaaacttcttttctcttacactttcaatgcattgaacattgattgatgtttgaagttgtgttttttatctcaagcaaaaagatatataattttgtacaaataaaatgcaatattcattgctccgat

SEQ ID NO: 3238 - DNA, 494 bp, Brassica rapa
aaatcatctaaattttcctagaaagttcaaaaaaatgtcaggaagaggaaaaggaggaaagggattgggaaaaggaggagcgaagaggcacaggaaagttctcagagacaacatccaagggatcacgaaacctgcgattaggcgactcgctcgcagaggaggcgtgaagcggatcagcggcttgatctacgaagagacgagaggagttttgaagatctttctcgagaatgtgatcagagacgccgtgacttacactgagcacgcgaggaggaagacggttacggcgatggatgttgtttacgctctgaagaggcaaggtcgcactctctacggattcggtggttaaaatcggttattttcggtttggtttatgggtggtgctgttgctgctgattaagtcggttctttcggtttacttttttgttggttcgtttcttggtttgtgattagcgtttgggtaattgcaatattgtattaaatttatcttttggtat

SEQ ID NO: 3239 - DNA, 482 bp, Taraxacum officinale
gaacagatccatttctagaaaacaaaagcgaaaaaatgtcaggaaggggaaagggaggcaagggactaggaaagggtggagccaagcgtcatcgtaaggttctccgggacaacattcaaggtatcaccaagccggcaattcgccgtttggccagacgaggaggtgtaaagcgtatcagtggcctaatctacgaggagacccgtggagttttgaagatctttcttgaaaatgtcatccgtgacgctgtaacatacaccgaacatgctcgacggaaaactgttaccgccatggacgtcgtttatgctttgaagcgccaaggccgtactctttacggatttggtggttaagagaaatttacggtttctagggttcttattagttcagttagtttcgctaatctgaagtgatgttatatgtaattgaatctattaatacattctctgatagttactatcaagttatggtgtaattcatctttctcg

SEQ ID NO: 3240 - DNA, 523 bp, Elaeis guineensis
  misc_feature (41)..(41): n is a, c, g, or t
tgttgttgtcttcgtattccttctccatcgacgccatgtcnggccgcggcaagggagggaaggggctgggcaagggtggggcgaagcgccaccgcaaggttctccgcgacaacatccagggcatcaccaagccggcgatccgccgccttgctcgtcgaggtggcgtgaagcggatcagcggcctcatctacgaggagactcggggggtcctcaagatcttcctcgagaacgtcatccgcgacgctgtcacctataccgagcacgctcgccggaagaccgtcacggccatggatgtcgtgtacgctctcaagcgccagggtcgcactctctatggcttcggtggctgagttcctgttggatgtttttggaattaggtggggtgagggtatgtgcgagggctggggtttcttgttggatttggctttgtttaggttgtaaatcttcccgggtcttgttttgggatagaaaaaggtgtaatctttttcaattatgaaatgaaaatttaaagctttgctggaagaat

SEQ ID NO: 3241 - DNA, 568 bp, Triticum aestivum
  misc_feature (527)..(527): n is a, c, g, or t
  misc_feature (546)..(546): n is a, c, g, or t
  misc_feature (566)..(566): n is a, c, g, or t
  misc_feature (568)..(568): n is a, c, g, or t
ccaattccatctgcccggagctccaagccgccgtcatgtccggccgcggcaagggcgggaagggtctgggcaagggcggcgccaagcgccaccggaaggtgctgcgggacaacatccagggcatcacgaagccggcgatccggcgtctggctcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacaggggcgcaccctctacggcttcggcggctgatctgctgctgctgcctcgtccagtctcttcaagccgctgttccatctgtcagtgcgtgtgttgttccgttcgtctgtgtagtggacgccatgaatacgaatgcaatgaaatcagagttcttgcggtgttaattatcttggatgcaaagtttctgtaagcttgttaaattcttccggcganaaagattaggaataatgtnctactgaggtaaatatcggnan

SEQ ID NO: 3242 - DNA, 455 bp, Triticum aestivum
caaattccccagcgacgacctcaacggccagcaatgtcgggccgcggcaagggaggcaaggggctgggcaagggcggcgccaagcgccaccggaaggtgctgcgtgacaacatccagggcatcaccaagccggcgatccggcgtctggcgcggcgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggccgcaccctctacggattcggcggctgatctgatcccgcgtgttcctccgttgttaggggttgccgatgtgatgtaatgtgatgcgcattgtttcagattaatcaatggattcgctgttgctgttcaaaaaaaaaaaa

SEQ ID NO: 3243 - DNA, 384 bp, Triticum aestivum
  misc_feature (2)..(2): n is a, c, g, or t
  misc_feature (315)..(315): n is a, c, g, or t
tnacacttcatctgtcctctgcctccaaacctcaaactccttaacaaactcacctcatcacaaaatgtctggaccgtggtaaaagcggtggaaaaggcctcggaaagggcgggggtaaacgtcaccgtaagattctacgagacaacattcaaaggtatcaccaaacctgctatccgaagattggctcgtcgaggtggtgtcaaggcgtatctctggcctgatttacgaggagacccgaggtgttctaaagattttccttgaaaacgtcatcagggattcgggcacctacactgaacacgccaaacggaaaacagncacctctctcgatgttgtctacgctcttaaacgacagggccgaacactttacgggttcggggccttgta

SEQ ID NO: 3244 - DNA, 371 bp, Artemisia annua
agtggtatcaacgcagtactccgacggggacaatcaattctaacacacatagtttcagatctcgttactacacaaaaccatacgaaaatgtcaggaagaggaaagggaggaaaaggactaggcaaaggaggagcaaagcgtcacaggaaggttctccgtgacaacattcaaggtatcactaaacccgccatccgtcgtctggctcgtagaggtggagtgaagcgtatcagtgggcttatctatgaagagacacgtggcgttctcaagatctttttggagaatgtgattcgtgatgctgttacctacactgagcacgctaggaggaagactgttactgttatggatgttgtctatgctctcaagaggcaagg

SEQ ID NO: 3245 - DNA, 508 bp, Brassica napus
gtttgggcaaaggaggagccaagcgtcacaggaaggttctgagagacaacatccaagggatcaccaagccggcgattcggagactggctcgtagaggtggagtcaaacgtatcagtggtctcatctacgaggagacacgtggcgtcctcaagatctttttggagaacgtcatccgtgatgccgttacttacaccgagcacgccaggaggaagacggtgaccgccatggacgtcgtctatgctctgaagaggcaggggaggactctctacgggttcggcggttaagggtcttcttagattcgcgtttgcgtttctgggtttcttttccggaaatttctaatcaaatcatgttctacttagcgtttgcgtttgaattatgtctgggtacggcgtttatgtgttgcggtagcgtttcgttttatatgtaattgcgccttttatcttatgtttttagcgatgcaatgtcgaagtaatccaaggttaagtttctggtaaaatatattcgaatt

SEQ ID NO: 3246 - DNA, 422 bp, Eschscholzia californica
ttaggaaagggaggagcaaagagacatcgtaaggttttgagagataatattcagggtattactaaaccagcaattcgtcgtctagctagaagaggtggagtcaaacgtataagtggtttgatctatgaagaaaccagaggtgttcttaagatctttcttgaaaatgtcatcagagatgctgttacttacactgaacatgctcgccggaaaactgttacagccatggatgttgtttatgctttgaaaagacaaggacgaactctctatggttttgggggttagggttttgttttgttatttctttaatattgtaaaatttcagaatgatctagggtttttatctcaatttggtcaatttgtgttgggtatggattatctgttcaaatctattccgatggtggtaacgaatcaatttgagatct

SEQ ID NO: 3247 - DNA, 528 bp, Hordeum vulgare
tcagtatacagcgagcgtgtataactttatcatcacaaccgttactacacacctcaaacaatcaacatgactggacgcggcaagggcggaaagggtctcagcaagggtggtgccaagcgtcaccgaaagatcttgcgagacaacatccagggtatcacaaagccgggcatccgacgtctcgctcgtcgtggtggtgtcaagcgtatctctgccatgatctacgaggagacccgcggtgtcctcaagatcttcctcgagggtgtcatccgcgacgccgtcacctacacggagcacgccaagcgaaagaccgtcacatctcttgacgttgtctacgccctcaagcgacagggacgcaccctctacggtttcggtggttaagctctttttgttttacatgcctgttacaaatctttgcggtcgactgcttgcagcgcaagaccttgtagggtgtgccatgatgacattgggtccgggaatagattatgggggcagggatcataaggaatgcgggggaagacattgggggga

SEQ ID NO: 3248 - DNA, 433 bp, Theobroma cacao
  misc_feature (14)..(14): n is a, c, g, or t
  misc_feature (52)..(52): n is a, c, g, or t
cgggtacgcggggnaagcagataagctaacaaattaactaataaatataatntaataaaatgtccggtagaggtaaaggtggtaaaggtttaggaaaaggtggttccaagagacacagaaaagttttaagagataacatccaaggtataactaagccagctattagaagattagcaagaagaggtggtgtcaagagaatttttggtttaatttatgaagaagtcagaactgtcttgaagtccttcttggaaagtgtcatcaaggatgctgttacttacactgaacacgctaagagaaaaaccgttacttctttagatgtcgtttacgctttgaagagacaaggtagaactttatacggtttcggtggttaaaaaatttattcccaaatataattctagtataatatatatgtgatttttttaaattttaggca

SEQ ID NO: 3249 - DNA, 718 bp, Cucumis melo
acacctcttttctaaaatcagaatcagcaggaacgattagatcacgctgcagccttatttttgcaacccaccatttttagactagtgcatttttctccccaactcacaatcagtaacagcctgcaccgcaaatctcagtgacagataaatccctttctcccccccctaaccggcttcgcccatttctactcttttcctgttttatacatccacaatctgccacatcttctagtcaactttcgaccatcgagtcatcagcattttcatcaatctccatcaccaaaacacatttacaacatccctaaacctcattcaagatgactggacgcggcaagggcggaaagggtctcggcaagggcggtgccaagcgccaccgaaagattcttcgtgacaacatccagggtatcaccaaacctgccatccgacgtctcgcccgtcgtggtggtgtcaagcgtatctcggctatgatctacgaggagacccgtggtgtcctcaagtccttcctcgagggtgtcattcgtgacgccgtcacatacactgagcacgccaagcgcaagaccgtcacctcactggacgtcatctatgccctgaagcgacagggccgcaccctgtacggtttcggtggttaagcgcgtcttcagtacagctcatactgcaaatatacccctcctacggtccattgtctttaacctagttggacgggcggccgcaagcagcg

SEQ ID NO: 3250 - DNA, 853 bp, Carica papaya
accattcgaagcgagaaaattatagaggcgtgaagcgaatcaaaggaagattaattagttacttgagaaaaaggaaatgtcaggtagaggaaagggaggtgcgaagaggcacaggaaggtgttgagggacaacatccagggcatcaccaaaccagccatccgcaggctcgctcgtaggggaggtgtgaagcgaatcagtggtctgatctatgaggagacacgaggtgttctcaagatcttcctcgagaacgttatccgtgatgcggtcacttatactgagcacgcgaggaggaagactgtcactgccatggatgttgtctatgctctcaagaggcaaggccgtactctctacggctttggtggttaatatctctattgtgtttttctccttcctttgtttgtttagtaggtgagttgttgaatgtatatcaggtgttattcctattaaggtgtttgatctcttgttgatgttcataattgaaatggtggatctgggtttgtaatgaaactatctattctctatttcaatgtctatttcacctgaggttgacttgtcgcatctgttcgttttcttattctctgcttttctatagtaagttgaacatatctgtttccttgctgaagtggccagaatcttcaccttgatgcttgattggcttgtaatcgtttaattgtcaaaacgggtgtccccttatttgctggattttattggggttaaatttatttagagatctgaggttgcttcagtggaaaccagcggagttttagctggtaaattctgttgtagccaaaatgttcgatgagttgtctttgtgagaactggaattacactaacatggtttaacctttgttt

SEQ ID NO: 3251 - DNA, 421 bp, Solanum tuberosum
gcatttcttctcaaaaatttcttcagaaaaatgtcaggcagaggtaaaggaggcaaaggattgggcaaaggaggagccaagaggcacagaaaagtgttgagagataatattcagggaataacaaagccagctattcgaagactcgctcgtagaggtggtgtgaagcgtatttctgggttgatttatgaggagactcgtggggttctgaagatctttttggaaaatgtgattcgtgattctgtgacttacacagagcacgctaggagaaagacggttactgctatggatgttgtttatgcacttaagaggcaaggaaggaccctttacggatttgggggttagggtttgttgggttttttttttaatttgtgctttgatggtgtaattctctgttacatattcatggaatagaaatgtgctt

SEQ ID NO: 3252 - DNA, 602 bp, Picea glauca
  misc_feature (172)..(172): n is a, c, g, or t
  misc_feature (289)..(289): n is a, c, g, or t
gggtttgggaaagggaggtgccaagaggcacaggaaggtcttgagagataacattcagggcatcaccaaacctgccatcaggcgtctcgccaggagaggaggtgttaagcgcatcagtggcctcatctatgaagagaccagaggcgtcctcaagatcttcttggagaatgtnatcagagatgccgtgacctacacagagcacgccaggagaaagaccgtgacagccatggatgtcgtctactccttgaaaaggcagggccgaaccctatacggcttcggaggctgaatntgaggaatctgacttcttgttacttgttctcgctcgcttatggtgtcttttgacaccaccttccacttctcttggaaatcttaacctggttactatggccgagtgtcgaatgcatgcggtgcgagctagtcatatttttcactgaagtattttagttgcctatttttattcaatgtgatgttttctttagggttttgaattcaattggggtttggtaacacatagttcttgaacctttccagaacgaaacctgtttggtcagttgtattttgtgcaatttaataggaatcactcactgcgtaatttggttact

SEQ ID NO: 3253 - DNA, 395 bp, Helianthus annuus
ggcaacgggaattcgatctcgagcgcccgcccgtacaggtacgcggggaatcttctcttcgcaaacctttgaaatcgaaaaatccttcaatcaagtttcaaaatgtgtggtcgtggaaagggaggaaaggggctgggaaagggaggagcaaagcgtcatcggaaagttctccgggataacattcagggtattaccaaacctgcaatcaggaggctggctagaagaggcggagtcaagaggatcagcggtctgatatatgaagagacacgtggcgttttgaagatattcttggagaatgtgattggtgacgccgttacctacacggagcacgctcggcggaagacggtggcggcgatggatgttgtctatgcttggaagaggcaaggaaggacttt

SEQ ID NO: 3254 - DNA, 414 bp, Artemisia annua
attaggcaaaggaaggagcaaagcgtcacaggaaggttcttcgtgacaacatccaaggtatcaccaagcctgccatccgtcgtctggctcgtcgtggtggtgtgaagcgtatcagcggtttgatttacgaggagacacgtggcgtattgaagatctttttggagaatgtcatccgtgatgccgtcacctacactgagcacgctcgccgtaagacagtgactgcaatggatgtggtttatgctttgaagaggcaaggaaggaccctctacgggtttgggggttagagttgaaattagggtttgttgttatggtatggttagggtgctagtattgggaagatcttgttgatatatctttgtgtaattgcaatttggaatggaatatcagtttaattttcatgtaaaacgcactcgt

SEQ ID NO: 3255 - DNA, 640 bp, Ipomoea batatas
  misc_feature (79)..(79): n is a, c, g, or t
gtacctcttgagacgcgccccgccttcgacctcgtggatccacagaattccgcaccaggtctaagctctaccacttctnatatttaggaatttgtagttgagcctctgttcataatgtccggtccgggaaaaggaggtaagggattgggaaagggaggagcctagcgtcacaggaaggtcctccccgataacatccagggtattacccaagccggcgatccctaggcttgcccgtagaggcggcgtgaagcgtgtgaggcggctcatatactaggagactcgcggcgttttgaagatctttctggagaatgtgattagggatgcccttacctacaccgagcacgctcgccgcaagacggttactgccctggacgtggtttatgccctgaagaggcagggtaggactctctatgggttcggcggttgagcgttttgggctgaatcgtttgtactggtctttgttatgagtcttgctgtcaagaaaattagaactgttaacaatggctgggctttttttttacttacttttttgtaaatactcattgctgggtattgtcttcttaagtatgtagttgaatgcttcatgttttgttatggggatgttgtccttgaattcatgaattgatctttatatgatcta

SEQ ID NO: 3256 - DNA, 648 bp, Ipomoea nil
  misc_feature (79)..(79): n is a, c, g, or t
gtacctcttgagacgcgccccgccttcgacctcgtggatccacagaattccgcaccaggtctaagctctaccacttctnatatttaggaatttgtagttgagcctctgttcataatgtccggtccgggaaaaggaggtaagggattgggaaagggaggagcctagcgtcacaggaaggtcctccccgataacatccagggtattacccaagccggcgatccctaggcttgcccgtagaggcggcgtgaagcgtgtgaggcggctcatatactaggagactcgcggcgttttgaagatctttctggagaatgtgattagggatgcccttacctacaccgagcacgctcgccgcaagacggttactgccctggacgtggtttatgccctgaagaggcagggtaggactctctatgggttcggcggttgagcgttttgggctgaatcgtttgtactggtctttgttatgagtcttgctgtcaagaaaattagaactgttaacaatggctgggctttttttttacttacttttttgtaaatactcattgctgggtattgtcttcttaagtatgtagttgaatgcttcatgttttgttatggggatgttgtccttgaattcatgaattgatctttatatgatctattttaatt

SEQ ID NO: 3257 - DNA, 562 bp, Helianthus annuus
  misc_feature (53)..(53): n is a, c, g, or t
  misc_feature (56)..(56): n is a, c, g, or t
  misc_feature (100)..(100): n is a, c, g, or t
  misc_feature (121)..(121): n is a, c, g, or t
acttaacaatctacaatcagcaatcatgtcaggaagagggaaaggaggtaagnggntgggaaaaggaggagcaaaacgacaccgtaaagttctccggganaacattcagggcatcaccaanccggcgatccgacggttggcgagacgtgggggagtgaagcgtataagcggtctgatatatgaggagacgcgtggtgttctcaagatctttctagaaaatgttattcgtgatgccgttacctacacagagcatgctcgccggaaaactgttactgctatggatgtggtttatgcgttgaagcgtcagggacgcactctgtacggtttcggtggttagtgtgagggaagttggatctggagtgtttggttattgttttgatatgtagatagttaatgaaatgaaaagttagatttgatttcatgatatctgcaatttatattttggttaatagtgagcttttttagcatgaatttgaggttttggaaatgcatatgattataggttttgaccaacagaaggttggttaaatttctgctcgaccaaaaaaagaatacattaaag

SEQ ID NO: 3258 - DNA, 442 bp, Artemisia annua
acgctcgacaaacagtggtatcaacgcagtactccgacgggggacacacaaataacaatcaattaatccaaacaccccccaaattcaaaatcataaaatgtcaggaagaggaaagggaggaaagggattgggcaaaggaggagcaaagcgtcatcgcaaggttcttcgcgacaacatccagggtatcaccaagcctgccatccgtcgtttggctcgtcgtggtggtgtgaagcgtatcagcggtctgatttacgaagagacacgtggcgtcctcaagatctttttggagaatgtgatccgtgatgccgtcacctacactgagcatgctcgccgtaagacggtgaccgctatggatgtggtttatgctttgaagaggcaaggaaggactctgtatgggtttggtggttgggtgtgtttgggattgggttttaagtcttgctgt

SEQ ID NO: 3259 - DNA, 498 bp, Arabidopsis thaliana
aaaacacaaatcttaaaactttctggaaaaacaaaaatgtcaggaagaggaaaaggaggaaaagggttaggcaaaggaggagcaaagagacacagaaaggttctaagagacaacattcaaggaatcacaaagccagcgattcgtcgtcttgctcgtagaggaggtgtgaagagaatcagtggattgatctatgaagaaacgagaggtgtgttgaagatttttctggagaatgtgattagagatgctgttacttacactgagcatgcgaggaggaagacggtgactgctatggatgttgtttatgccttgaagagacaaggaagaactctatatggatttggtggttgatcaatttgagatctgggttttctggtgaatgatgataatttaagtcttgcgatcaagaaattccagaaattgggttgaattttagggtttcgttttgtgttgtaattagggcagcattgtaatggattaatgataagtaccatttgctct

SEQ ID NO: 3260 - DNA, 576 bp, Vigna unguiculata
cagttctgtgtcagagaagaaagaaaaatcgtcagccatgtctggaagaggaaagggtggcaaggggctcggaaagggaggtgccaaacgacaccgtaaggttctgagggataacattcagggaatcaccaagcccgctattcgccgtcttgctagacgtggtggtgttaaacgtatcagtggtctcatctacgaagaaacccgtggtgttctcaagatctttctcgagaacgtgattcgcgacgctgtcacctacaccgagcacgctcgccgcaagaccgtcactgccatggacgttgtctacgctctcaagaggcaaggcaggaccctctacggtttcggtggttagagaattgggggtttgtacaatggctcggaaattagggtttcttataatgtcaattttgctgtcgatattgcttagtgtttcaagaactgttcttgtttggctttgagttgtagcccagggaattattggttttagtaagtatgaattggacgtttcgaagggaaattcgttgtgcatttgtgttttcttgttacctaaacagcactaaattaaaaattaaaagtatt

SEQ ID NO: 3261 - DNA, 535 bp, Festuca arundinacea
ccaaatcctccaccagccacctccaacctcagcaacaatgtcaggccgcggcaagggaggcaagggcctgggcaagggcggcgccaagcgccaccggaaggtgctccgcgacaacatccagggcatcaccaagccggccatccgccgcctggcccgccgcggcggcgtcaagcgcatctcgggcctcatctacgaggagacccgcggcgtgctcaagatcttcctcgagaacgtcatccgcgacgccgtcacctacaccgagcacgcgcgacgcaagaccgtcaccgccatggacgtcgtctacgcgctcaagcggcaggggcgcacactctacgggttcggaggctgatctgatcgagcccctgcgtcccgtctctgtgttgggtgctggtgtttggtagggttgacgatgcttctactagttcttagatctgtgtgggttgtactactgtgatgaagtgaagttgtgtaatgtgttgcgtatcggttatgattaatgagattcggtgccgcttctcatggcactcgcgttgct

SEQ ID NO: 3262 - DNA, 464 bp, Lactuca sativa
caaacgaaatcaatttcatttctagagacaaaaaaaaaatgtcaggaagaggaaagggaggcaagggattgggaaagggaggagctaaacgacatcgtaaggttctccgggacaacatccaaggtatcaccaagccggcgatccgccgtctggccagacgaggaggtgttaagcgtatcagtgggctaatctacgaggagacccgtggagttttgaagatctttctggagaacgtcatccgtgacgccgtcacatacaccgaacatgctcgccggaaaactgttacagccatggatgtcgtctatgctttgaagcgccaaggccgtactctctacggatttggtggttaataaaattttagggtttctatggttcttgtttgacaccggagtttaatctgaagtgatattacttgtaattgaagttcttaatataatatcagatagcaagtcaatttatggttt

SEQ ID NO: 3263 - DNA, 435 bp, Lactuca sativa
  misc_feature (221)..(221): n is a, c, g, or t
caacaaaaaccaaaaccagagaaatttctgtctacgagatgtcaggaagaggaaaaggaggcaagggattgggaaagggaggagcaaaacgacatcgtaaggttctccgggacaatattcaaggcatcaccaagccggcgatccgtcgtctggctagacgaggaggtgttaagcgtatcagtggtttaatctacgaggagacgcgtggagttttgaagatntttcttgagaacgtcatccgtgacgccgtcacatacaccgaacatgctcgccggaaaactgttaccgccatggatgtcgtttatgctttgaagcgccagggtcgtactctctacgggtttggtggttagatggaatttttggatttatgaagttataatttatgtaactaaatctcttagtataatatcagttaatgagcacttcattttcttg

SEQ ID NO: 3264 - DNA, 503 bp, Lactuca sativa
acgaaaatcaaattcatttccattgacaaaaaaaaaatgtcaggaagaggaaagggaggcaagggattgggaaagggaggagctaaacgacatcgtaaggttctccgggacaacatccaaggcatcaccaagccggcgatccgccgtctggcaagacgaggaggtgttaagcgtatcagtgggttaatctacgaggaaacccgtggagttttgaagatctttcttgaaaacgtcatccgcgacgccgtcacatacaccgaacatgctcgccggaaaactgttacggccatggatgtggtatatgctttgaagcgccaaggtcgtactctatacggatttggtggttgatagaatttagggtttctagtgttcttgtttgacaccggattttagtgtgaagtgattctacttgtaattgaatttcttaatacaatatcggatagttgtcaatttattgtttaatatttatctttcctctaatgatagtacatggaatttagttc

SEQ ID NO: 3265 - DNA, 509 bp, Medicago truncatula
atcccaaattcaaagtttttcaaaagtctcgattgaaaatgtcaggtcgtggaaagggaggtaagggattaggaaagggaggtgcaaagagacatcgcaaagtgcttcgtgacaacatccaaggaatcacaaagccagcgattcggcgattagcgagaagaggaggtgtgaagagaatcagcgggttgatttatgaagaaactcgcggtgtgttgaagattttcttggagaatgtgataagagatgctgttacgtatactgaacatgcgaggaggaagacggttactgctatggatgttgtttatgcgttgaagagacaaggaaggactttgtatggtttcggaggttgaagaagatgatgaagaagttgatttagggttatggttatgaattatgtgtattttgaatgttagtttatttcgtaatgtttaatggtgaattagattgatgtatattcagtttttagctgaatttgaaatttgaattcaatgaaagagtaatgtttgggt

SEQ ID NO: 3266 - DNA, 522 bp, Triticum aestivum
cagcagtcaagcgcagctcgccggagagagaagcgaagatgtcgggccgcggcaagggagggaagggcctcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacacggagcacgcccgtcgcaagaccgtcaccgccatggacgtcgtctacgccctcaagcgccagggccgcaccctctacggattcggcggctaggccaagcgaatcggcccccgccatcagatttgtgctcgtagctagctatggttgtgtagtgttcatggtcttcggtgtaatggccgcatctcgctgctgtatgtcttggccttgactgttgtttggatgtagctctgagatggaatggaaattgaagcagcttacccttgaa

SEQ ID NO: 3267 - DNA, 980 bp, Triphysaria pusilla
  misc_feature (777)..(777): n is a, c, g, or t
acgtccctgcctcttaagagcatatacgacgtccatagcagtgacggtcttacggcgagcgtgctcagtgtaggtaacggcatcacggatgacgttttctaggaagatcttgaggacgccgcgagtctcttcgtagatcaaaccgctgattcgtttaactccgccacggcgagctaaccggcgaatggctggcttggtgatgccttggatgttgtcgcggaggactttgcgatggcgcttggcaccgccctttcccaaacccttgccgcccttacctcttcacctgcccgggcggccgcccgggcaggtgaaactagtagatggacaccaccattttcaactttgcttatcatctgacatacaaatttccccctaaccaatcatctttgtagccaaaccaaaaatggaagctactccaaaggcaaagaagggagctgctggaagaaaggccggtggcccaaagaagaagtccgtttcccgatccgtgaaagccggtctccagttccccgtcggcaggatcggccggtttctcaaaaagggtcgctactctcagcgtgtcggttccggtgcaccggtttacatggccgcggttctagaataccttgctgctgaggtattggagttggctggaaatgcagcaagagacaacaagaaaagcaggattatcccaaggcacttgttgctggccgtgaggaacgatgaggagcttggtaaacttctggctggagtgacaattgctcatggtggtgttataccaaacataaacccggttctgtngcccaagaaatctgacaaggtggctgagaaggcacccaaatcaccatcgaaggctactaagtctccgagaaaggcatagactgaaatttttctttctgaatgtcggattgggataaaataacctttattcagttattggtttgtagggattgtgttatcttagggctatgtaggtgatgatgtttataactgcagtaattgta

SEQ ID NO: 3268 - DNA, 557 bp, Solanum tuberosum
gaaacttcttcttcatcaaatttctctgtgaaaatgtctggtcgtggaaagggaggcaagggattgggaaagggaggagccaagaggcacaggaaggttctaagagataacatccaaggtatcactaagccagctattcgcaggcttgctcgtaggggtggtgtgaagcgtatctctggtctcatctatgaggagactcgtggagtgttgaagatctttttggagaatgtgattcgtgattctgtcacctacactgagcacgccaggaggaagactgttactgctatggatgttgtctatgctttgaagagacagggaaggactctctatggatttggcggttagattgggggttgtatgttggtgctatggtggtagtaaatgtaggttttagtttacaattgcgtataagtctgtgttggatctctgtagtgtagtgttgttcttatgctctagatcttgtaatttctcattacattatcaatgaacagagttaggttttgtgtacattgatcatcttcctgctgttgatttatttttattaatttgttgctctt

SEQ ID NO: 3269 - DNA, 644 bp, Pseudoroegneria spicata
  misc_feature (31)..(35): n is a, c, g, or t
  misc_feature (396)..(396): n is a, c, g, or t
ctcatcagcagctcgaagaggatcgtcggcnnnnntgtctgggcgcggcaagggaggcaagggtctcggcaagggcggcgccaagaggcacaggaaggtgctccgcgacaacatccaaggcatcaccaagccggccatccggcgcctggccaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggctctttctcgcccccctgcagatcccaaaagcttgatagaaccgcgacntgtttagttcagtacttcctctgtagttcgaagagaatcgtgaaacaaagctattcgcatctggagttggaagtcaaacccgtgtctgtgcaagtaccgtgtttctgaattttgtgtcgctggttggcctgctacttctctgtttgtgtgcaattgctgtttcttctgtgatgcaaaattgtgtgcgcttcggagttactagtagattttacagtagaccctgacgaatcgtacttggcagaaaaaaa

SEQ ID NO: 3270 - DNA, 494 bp, Triticum aestivum
gtttccatctcagtcagctccaagccgtcaaccatgtccggccgtggcaagggcgggaaggggctgggcaagggcggcgccaagcgtcatcggaaggtgctgcgcgacaacatccagggcatcaccaagccggccatccgtcgtctggcgcggcggggcggcgtgaagcgcatctcggggctcatctacgaggagacccgcggcgtgctcaagatcttcctggagaacgtcatccgcgacgccgtcacctacaccgagcacgcccaccgcaagaccgtcaccgccatggacgtcgtctacgcgctcaagcgccagggccgcaccctctacggattcggcggctgacctgcgcccgctgctgctccatcgagtcgactctgccagctgctgctgctgctgttctggtgctatggtttcgtttctgagttcgtgcgttgctgttccatcagtctgtgtagttagtggaaggtgatggatctgaatgtaatgggatt

SEQ ID NO: 3271 - DNA, 388 bp, Eucalyptus gunnii
cgggagagagaactagtctggagaagggaggcgcgaagcggcaccggaaggtgctgcgggacaacatccagggcatcaccaagccggccatccggcggctggcccgccggggcggggtcaaacgcatcagcggcctcatctacgaggagacccgcggggtgctcaagatcttcttggagaacgtgatccgcgacgccgtgacctacaccgagcacgcccggcgcaagaccgtgacggccatggacgtggtgtacgcgctcaagcggcagggccggaccctgtacgggttcggaggctgacgaggctcggcgttgggtttctgctatgtattgttgttgcttgttagtattctgttgaatcaaatgcagtaattttagggattgctgtc

SEQ ID NO: 3272 - DNA, 996 bp, Hordeum vulgare
aagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgagacccgcggcgtgctcaagatcttcctcgagaacgtcatccgcgacgccgtcacctacaccgagcacgcccgccgcaagaccgtcaccgccatggacgtcgtgtacgcgctcagcaccctctacggcttcggcggcttggctgaccgtggcgcacaagccctggctcgcggtcaagaaactgccggaggggagaaatctgtagttcatctaggtcctgtgccttgtatgcttggtagtaggaccctatgtttagtagtttgcttccgtgttctgaacctgatgggcaaatactgtgtttgccgagttgtatggttccagagttaacaaaattgtccttctgttatgaaattatgctaccgactacgctgttcttgtttaaaaaaaaaaaaaaaaataaaacctcgaagagcaatcctcaccccgcgccccagcaaagcaagtcctcccgccccgatggcccgcacgaagcagacggcgaggaagtccaccggcggcaaggccccgcggaagcagctggcgacgaaggcggcccgcaagtccgcgccggccaccggcggcgccgcaccgcttccgccccggcaccgtcgcgctccgggagatccgcaagtaccagaagagcacggagctgctcatccgcaagctccccttccagcgcctggtgcgggagatcgcgcaggacttcaagaccgacctccgcttccagagctccgccgtctccgcgctccaggaggccgccgaggcctacctcgtcggcctcttcgaggacaccaacctctgcgccatccacgccaagcgcgtcaccatcatgcccaaggacatccagctcgcccgccgcatccgtggcgagagggc

SEQ ID NO: 3273 - DNA, 609 bp, Solanum phureja
gttcttgattgggaaagggaggagcaaagcgtcaccgtaaggtgctccgtgataacattcaaggtatcactaagcctgctattaggcgtttggctcgtagaggaggagtaaagcgtatcagtggactaatctatgaggagactcgtggagttttgaagatctttttggagaatgtgattcgtgattctgttacctacactgagcatgctaggaggaagacggtcactgctatggatgttgtttatgcactcaagaggcaaggaaggactctatacggatttggtggttaaaagaatgtgtgttgcttttaactgatttagtgttgtttttgaagtaacagagttgcttaatcaatgaaattgcacaatcttcttataatcgatttctcaatttctctgtttgagtccctattttttgttttttttaaagtaatcactgagattatgtatatagaaactctaaaattgaatcctccaagatgcaatagtattagtccaattagatatatattgatttatgttcgttggatgtacaaatgtaggtgtatttcttttgttttgattagtcgttgttgaatcccattctagaagatgactgctaggggtggag

SEQ ID NO: 3274 - DNA, 446 bp, Triticum aestivum
  misc_feature (349)..(349): n is a, c, g, or t
  misc_feature (355)..(355): n is a, c, g, or t
  misc_feature (432)..(432): n is a, c, g, or t
cgttcccctccaaatccacccgatccaatctgcccgctcgcagctccaaggaaggaggaagccgtcgaccatgtccggccgcggcaagggcgggaaggggctgggcaagggcggcgccaagcgccaccggaaggtgctccgcgacaacatccagggcatcaccaagccggccatccgccgtctggcccgcaggggcggcgtgaagcgcatctccgggctcatctacgaggagacccgcggcgtgctcaagatcttccctgggagaactcatccggcgacgccgtcacctacaccgagcaccccggcccgcaagaccgtcaccgccatggacttcgtctacccctcaaancgccangccgcaccctctacggttcggcggtagcccctgtccttcatctttctctcccggtgttaatcttcccacgctgtgtngtcaaccttgggga

SEQ ID NO: 3275 - DNA, 497 bp, Hordeum vulgare
ctccaatctcaccctcggagcagcagagccatccagcgagcgtcgccagcggtgtctggccgcggcaagggaggcaagggcctgggaaagggcggcgcgaagcggcacaggaaggtgctgcgagacaacatccaggggatcacgaagccggcgatccggcggctggctcggcggggcggcgtgaagcgcatctccgggctcatctacgaggagacccgcggcgtgctcaagatcttcctggagaacgtcatccgcaacgccgtcacctacacggaccacgcgcgccggaagaccgtccccgccatggacgtactttacacacttaatcgccatggctatacggtatacggaaaaggagggtaggcccctcgcgccctgtttggcctttctggcttagggggcaacttatttgggctggagagtaatggaaaagaatggaaaggaggggacagggatgggatgcggtaggacacacaaagggtgagactgtgcccccg

SEQ ID NO: 3276 - DNA, 559 bp, Hordeum vulgare
cccattaccatcatcgagcgcctctgtgcctccattccatctctcacacagcccacaaaacactctcctcaccttcaacatgactggacgcgaggcaagggcggcaagggcctcggcaagggcggtgccaagcgccaccgcaagattcttcgtgacaacatccagggcatcacgaagcccgccattcgccgtcttgcgcgtcgtggtggtgtcaagcgtatctctgccatgatttacgaggagacccgtggtgttctcaagtccttcctcgagggtgtcatccgtgacgctgtcacctacactgagcacgccaagcgcaagactgtcacttctctcgacgtcgtctacgccctgaagcgccagggccgcaccctgtacggtttcggtggttaagcgtcttgctttactaccgtctgggggttgcattcggattgctggtttggggcacatggagttcacgtctgttacgaaagtcattcttcgcgcggaaagccgcctgcgcgtccacacgtgcaatacgcgtcaagcgggcggctcgtcatgatgaatcaacgggatc

SEQ ID NO: 3277 - DNA, 491 bp, Lactuca sativa
tcatgttcatttcgtgcgaaagataagtagagagataacatgtcagtaagaggaaaaggagtccagggtattggcgaaaggttggagccaaacgtcatcgtatggttctccgggacaacatcgaaggcatcatcaagccggcgattcaccgtctggtcagacgaggagatgtcaagcgtatcagtgggttaatctacgaggagacccgtggagttttgaagatctttcttgagaacgtcatctgtgacgccgtcacatacactgaacatgctcgccggaaaacagtcaccgccatggatgttgtttatgctttgaagcgccaaggccgtactctctacggatttggcggttaagagaattttacgtttctactttccagggttcttgtttggcatcgagagtttcattgatttgtgatctgtgatcgcaggtgggattacatgtgattgaaacgctaaatacactatcacttatcccctattctccttctc

SEQ ID NO: 3278 - DNA, 531 bp, Zea mays
ggaacaaatcctcttcctcgaggtctcctcaaccaaattcaaagtcaatggggcaaagctctcggcgaggtctggactcggcaagggcgggaagggtctgggcaagggcggcgccaagcgccaccgcaaggtgctgcgtgacaacatccagggcatcaccaagcccgcgatcctcacgttggcgagggggggcgagctcaagcgcatctccgggctcatctacgacgagacccgcggcgtgctcaagatcttcctcgagaacgtcatccgcgacgccatcacctacaccgagcacgcccgccgcaagactgtgaccgccatggacgttgtctacgctctaaagcgccagggctgcaccctctacggattccgcggacaggtcgcccctctcccggtggcataattacctggtggcggtgacggtcgtatagggatcttaggcaaagtaggctgagccgtctttataggtgctgtctgctgtgatgcttgcactgcatcggtccactgtctagtccatgtgctgtaatatct

SEQ ID NO: 3279 - DNA, 451 bp, Fragaria vesca
  misc_feature (134)..(134): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (146)..(147): n is a, c, g, or t
  misc_feature (150)..(150): n is a, c, g, or t
  misc_feature (153)..(154): n is a, c, g, or t
  misc_feature (156)..(156): n is a, c, g, or t
  misc_feature (160)..(160): n is a, c, g, or t
  misc_feature (166)..(166): n is a, c, g, or t
  misc_feature (173)..(173): n is a, c, g, or t
  misc_feature (181)..(182): n is a, c, g, or t
  misc_feature (184)..(184): n is a, c, g, or t
  misc_feature (202)..(202): n is a, c, g, or t
  misc_feature (207)..(207): n is a, c, g, or t
  misc_feature (230)..(231): n is a, c, g, or t
  misc_feature (234)..(234): n is a, c, g, or t
  misc_feature (333)..(333): n is a, c, g, or t
  misc_feature (407)..(407): n is a, c, g, or t
  misc_feature (438)..(438): n is a, c, g, or t
aaattctccggtgaaaaatgtcagggcgcggcaagggaggcaagggattgggcaaaggaggagccaagcgtcacaggaaggttctccgggacaacatccagggcatcaccaagcccgccattcgccgtttggcncncngnggcggnntcngcnnanctcnggtctnatctatnaagagacnngnggtgtcctcaagatcttnctcgngaacgtcatccgtgacgccgtcnnttncactgagcacgctcgcaggaagaccgtcaccgccatggatgttgtctatgctttgaagaggcagggaaggactctctatggatttgggggttaaatcgntgggtgttagtttagaatttgggtgtaatgaatattttgtggttaaatattatgttcatgtaatctgcacctcnttcgtgaagtaatggaagtttgatatttcgntgaaaaaaaaaaa

SEQ ID NO: 3280 - DNA, 325 bp, Triphysaria pusilla
tttccaatcacagctaacaagtttcagaagaaaaaaatgtcaggacgcggcaaaggcggcaagggtttgggaaagggcggcgccaagcgccatcgcaaagttctccgcgacaacatccaaggcatcaccaagccagccattcgccggttagctcgccgtggcggagttaaacgaatcagcggtttgatctacgaggagactcgcggcgtcctcaagatcttcctagagaacgtcatccgtgacgccgtcacctacactgagcacgctcgtcgtaagatggttttccaggtcggacgttgtatatgctctcaagaggcaaggccgt

SEQ ID NO: 3281 - DNA, 391 bp, Triticum aestivum
  misc_feature (337)..(337): n is a, c, g, or t
  misc_feature (385)..(385): n is a, c, g, or t
caaagacagggtcaacctcaccgaggagaagaagggagaagcgagaagatgtcgggccgcggcaagggaggaaaggggctcggcaagggcggcgccaagcgccaccggaaggtcctccgcgacaacatccagggcatcaccaagccggcgatccgtcgtctggctcgcaggggcggcgtgaaacgcatctcggggctcatctacgaggaagacccgcggcggtgctcaagatcttcctcgagaattttattttttatttcctcacctacaccgagcacgcccgccgcaagaccgtcaccgccatggacgtctctaagccctcaaagcgccaaggaancaacctctacggattcggggggtaagcctccgccaaattaaagtgtcnaaggtt

SEQ ID NO: 3282 - DNA, 293 bp, Artemisia annua
attcaaaataaaaaaatgtcaggaagaggaaagggaggaaagggattgggcaaaggaggagcaaagcgtcatcgcaaggttcttcgcgataacatccagggtatcaccaagcctgccatccgtcgtttggctcgtcgtggaggagtgaagcgtatcagcggtctgatttacgaggagacacgtggcgtcctcaagatatttttggagaatgtcatccgtgatgctgtcacctacaccgagcacgctcgccgtaagacagtgactgcaatggatgtggtttatgctttgaagag

SEQ ID NO: 3283 - DNA, 280 bp, Hordeum vulgare
aagggaggcaaggggctgggcaagggcggcgccaagcgccaccggaaggtgctccgcgacaacatccagggcatcaccaagccggcgatccggcgcctggcgcgtcgcggcggcgtgaagcgcatctcggggctcatctacgagacccgcggcgtgctcaagatcttcctcgagaacgtcatccgcgacgccgtcacctacaccgagcacgcccgccgcaagaccgtcaccgccatggacgtcgtctacgccctcagcaccctctacggcttcggaggct

SEQ ID NO: 3284 - DNA, 280 bp, Hordeum vulgare
aagggcgggaagggcctcggcaagggcggcgccaagcgtcaccggaaggtgctccgggacaacatccagggcatcaccaaaccggccatccgccgtctggctcgccgtggcggcgtgaagcgcatctcggggctgatctacgagacccgcggcgtgctcaagatcttcctcgagaacgtcatccgcgacgccgtcacctacaccgagcacgcccgccgcaagaccgtcaccgccatggacgtcgtctacgccctcagcaccctctacggcttcggcggct

SEQ ID NO: 3285 - DNA, 356 bp, Malus domestica
cttcttcgcccaaaattttccgagaaatgacaggccgtggaaagggaggcatgggcttgggcaagggaggagcgaaaccacatcgtaaggtgctgagggacaacatccaaggcatcaccaagcctgcgattcgccgtcttgctctcataggtggcgtgaagcgtatcaccggtctgatctacgaggagaccagaggggttcttaagatctttttggagaacgtgattcttgatgccgtgacctacaccgagcacgccatgaggaataccgtgaccgccatggacgtggtgtatgctctgaacaggcagggaatgaccctctacggtttcgggggttaaattgggaattttatgcct

SEQ ID NO: 3286 - DNA, 564 bp, Phaseolus coccineus
ctgagaaaatgtcaggtcgtggaaaaggtggaaagggtttgggcaagggaggggccaagaggcccaggaaggtgtttcgcgataacatccagggaataaccaagcctcccattcgtaggttgccaagaagaggtggcgtcaagaggatcagcggtttgatatatgaggagcccagaggtgttctcaaatttttcttggagaatgtaattcgtgatgcagttacctccactgaccatgttaggaggaagactgttactgctatggatgttgtttatccactcaaaagccaaggaaggactctttacggtttcggaggatgaagaattgttagatctattccattgtgtttcagagtaaaacttcttgttctgctaatttcatgtgatgtttagcttcagggatccctgtaaactttggtcattttctgttcaggtatgaacgagccctgtgcaagttcaattgaagttaaacgaagggtattgttttgttcatgttggggcgtaaagatttattctctatatttagttgtcaagaacgaaagtataatattgatctatttttatt

SEQ ID NO: 3287 - DNA, 459 bp, Festuca arundinacea
ggcacgaggcaagggcggcgccaagcgccaccggaaggtgctccgcgacaacatccagggcatcaccaagccggccatccggcgcctggctcgccgtggcggcgtgaagcgcatctccggcctcatctacgaggagacccgcggcgtgctcaagatcttcctcgagaacgtcatccgcgacgccgtcacctacaccgagcacgcccgccgcaagactgtcaccgccatggacgtcgtctacgcgctcaagcgacagggacgcaccctctacggcttcggaggctgatcgagtcgtccctcgaccgtcgggtcgggcccctgtgtcgagtgctggtgttgacgatgcttctagttcaggattctgtgtgggttgtgtactgtgaagtgaagttgtggaatgtgttgcgtatcggttatgagtaatgagattcggtgccacttctcatggcactttcgttg

SEQ ID NO: 3288 - DNA, 531 bp, Avena sativa
ccccaatctccacctgttcttctccgagctcctctggcaagggaggcaagggtctgggcaagggcggcgccaagcgccaccgcaaggtcctccgcgacaacatccagggcatcaccaagccggcgatccggcgcctcgctcgccgtggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggtctgtgttagcgagccagcagtgttgttgttagggttactgatgcttgttgttcttagatctgttgtgttggtactgtgaagtcgaaggtcggcatgtaatgcatctagtttcagtttaatgaattcggtgccacttctcgtggcacctgtgttgttctatctctttgattcagtataacttgaatgttcgatctgcctcaaa

SEQ ID NO: 3289 - DNA, 576 bp, Medicago truncatula
cggggagaaccaacaacaactacaacacaccaaaatcaaaatttccaagttcgaaacaagatcttgcaatcaacaatgtcaggaagaggcaaaggaggaaagggtttaggaaagggtggtgcaaagcgtcatcgcaaagttcttcgagataacattcaaggaattaccaaacccgcgattcgtcgtcttgcaaggcgtggtggtgtaaagcgtatcagtggtctcatctatgaagaaactcgcggtgttcttaagatatttcttgagaatgttattcgtgatgccgtcacttacactgaacatgctcgtcgcaaaacggttactgctatggatgttgtttatgcgctcaagaggcaaggaaggacccttatggtttcggcggttaggagattattgttattagaataagagattagaatttagtaatagcttttagagtttaatctcagtagtaatgtattacctccattctggttatatataattgtatctcaattaatgtttttagcttatctttgtttgtttagttaactctgttcagtatttgttgattgatttctaatataacggagtttc

SEQ ID NO: 3290 - DNA, 1350 bp, Lactuca sativa
ataagtgatattgtattaatagcttcaattacaggtaataccacttccgattacagataacaaaacaaagaaaacctcggtgccaaacgagagaaaccgcaaaattctattaaccaccaaatccgtaaagagtacggccttggcgcttcaaagcataaacgacatccatagcggtaacagttttccggcgagcatgttctgtgtatgtgacagcgtcacggatgacattttcaagaaaaatcttcaaaactccacgggtctcctcgtagattaacccactgatacgcttgacacctcctcgtctggccagacggcggatcgccggcttggtgataccctgaatgttgtcccggagaaccttacgatgacgtttggctcctccttgcccaaaaccctagcctccccattcctctctgcactccgatctcgcagaaatggccgccgctcgtcccctcgtcaccgttcaatccttggagtccgacatggccaccgacagtgctgggattcctcttccccaagtcatgaaggcttctatccggcccgatatcgtcaatttcgttcactccaatatctccaaaaactcccgtcaaccctacgccgtttcccgaaaggccggccaccagacctccgccgagtcatggggtactggacgtgcagtatcccgtattcctcgtgttcctggtggcggaactcaccgtgccggacaaggagctttcggtaacatgtgtcgtggtggacgcatgttcgcaccgaccaggatctggcgccgctggcacaggaagatcaatgtcaaccagaagaggtacgctgtggtttcagccatcgctgcttctgctgtgccgtcgctcgtgatggctcgtggtcaccgtattgagtcggtgcctgagcttcctttggttgttagcgactctgcagagggcgttgagaagactcagaacgctatcaaggttttgaagcagatcggtgcttatgctgatgcggagaaagctaaggattcagttggtattcgtcccggaaagggaaaaatgaggaaccgcaggtacatttctcgtaagggaccattgattgtgtacggcactgaaggtgccaagctcgtgaaggcttttaggaacattcctggtgtcgaaatcgcgaatgttgagaggttgaatttgttgaagcttgctcctggtggacatctaggaaggttcatcatctggactaaatctgcttttgaaaagttggattccatctacggatcatttgataagactagtgagaagaagaggggttatgttttgccgagggcaaaaatggagaatgccgacttagctcggatcatcaattctgatgaggtccagtctgtggtta

SEQ ID NO: 3291 - DNA, 529 bp, Brassica juncea
  misc_feature (376)..(376): n is a, c, g, or t
  misc_feature (474)..(474): n is a, c, g, or t
  misc_feature (487)..(487): n is a, c, g, or t
cggggaaatcatctaaattttcctagaaagttcaaaaaaatgtcaggaagaggaaaaggaggaaagggattgggaaaaggaggagcgaagaggcacaggaaagttctcagagacaacatccaagggatcacgaagcctgcgattaggcgactcgctcgcagaggaggcgtgaagcggatcagcggcttgatctacgaagagacgagaggagttttgaagatctttctcgagaatgtgatcagagacgccgtgacttacactgagcacgcgaggaggaagacggttacggcgatggatgttgtttacgctctgaagaggcaaggtcgcactctctacggattcggtggttaaaatcggttattttcggtttggtttntgggtggtgctgttgctgctgattaagtcggttcttttcggtttacttttttagttggttcgtttcttggtttgtgattagcgtttgggtaattgcantattgtattaaanttatcttttggtataatgaaagttcgattactaattaaaaaa

SEQ ID NO: 3292 - DNA, 519 bp, Gossypium hirsutum
ggcacgagtttgggagagagaagaaaaaggagggaacgaaaatgtcaggtcgtgggaagggaggcaaaggattgggaaagggaggtgcgaagagacacaggaaagtactaagagacaatattcaagggatcacgaagccggccattcggaggttggctagaagaggtggagtgaagaggattagcggtctcatttacgaggaaacgcgtggcgttctcaagattttccttgaaaatgtgatccgtgatgcggtcacttacactgagcacgctaggaggaagacggttactgcaatggatgtagtttatgctctgaaaagacagggccgaactctttacggctttggaggctaacttttcttttacaaaagcagctggatttagatctcgttgttccttttttttgggggggggtcaagtagcataagttgatttttgattcaaatcattggcgtttgtattgtcggtttccttgtttggcttctaagaaaatatagtaagaaagtaaatttgaaaatgg

SEQ ID NO: 3293 - DNA, 452 bp, Festuca arundinacea
ggcacgaggcaaccacacaagtcaacctcaccggagaagatgtcgggacgcggcaagggaggcaaggggctcggcaagggcggcgccaagcgccaccggaaggtgctccgcgacaacatccagggcatcaccaagccggccatccgccgcctggcgcgccgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggctctgctgccgtcccccagactagatgagtcgctagcggatgatgtttagggttcgtcgtttgttgttgggtgtagtctcctgtgatggttggatgtact

SEQ ID NO: 3294 - DNA, 501 bp, Lactuca sativa
  misc_feature (25)..(25): n is a, c, g, or t
  misc_feature (46)..(46): n is a, c, g, or t
  misc_feature (223)..(223): n is a, c, g, or t
  misc_feature (360)..(360): n is a, c, g, or t
  misc_feature (403)..(403): n is a, c, g, or t
cacaacaaagaaaatcaaatccatntacgaagagaagaatatgtcnggaagaggaaaaggaggtaagggattgggaaagggaggagccaagcgtcatcgcaaggttctccgggacaacattcaaggtatcaccaagccggcgatccgccgtctggccaggcgaggaggtgttaagcgtatcagtggcttaatctacgaagaaacacgtggggttttgaagatntttctcgagaatgtcatccgtgacgccgtcacctacaccgagcatgctcgccggaaaactgttacggccatggacgtcgtttacgctttgaagcgccagggacgcactctctacggatttggtgggtagatgaatcnttctctttttagggttcttgttttgcagcgaggtcttcattgngtttttgtttagttagcttctctaaatctgaagtgatattacgtgtaattggatctcttaatacaaaatcacttagtttatcaattttcttgttcagc

SEQ ID NO: 3295 - DNA, 729 bp, Medicago truncatula
gggatctcatctcaatcgcagagagagaaactcaaagccatgtcaggaagaggcaaaggaggaaagggtttaggaaagggtggagcgaaacgacaccgtaaggttctgcgcgataacatccagggaatcacaaagcctgcgattcgtcgtctcgcaagacgtggtggtgtgaagcgtatcagtggcttaatctatgaagaaactcgtggcgttctcaagatctttcttgagaatgtgattcgtgatgctgtcacatacacagagcatgctcgccgtaagactgttactgcaatggatgttgtttacgctctcaagaggcagggaaggactctttacggtttcgggggttagggtttcttgtattgaaattttcaaatttgatatatatattttgtaaccgcacttgagctctagcattaacgatgattaattgctttgataagagttgttaaacgttgatttgaattttcaatccagtaattaatttcatgaaaaaaaaaaaaaaaaaaactcgagggggggcccgggtaccccaattccccctatagtgagtcgttattacaatttcactggcccgtacgttttacaacgtcgtgactggggaaaacccttggaccgttacccaaactttaatccgcccttggcaagcacaattcccccttttcactccaacttggcgcgtaatagtcgaaaaaggccccataccggatcgcccctttaccaacaaat

SEQ ID NO: 3296 - DNA, 545 bp, Secale cereale
tccccttcttcctaatcacatccctcggagaggagcggcaatgtctggacgcggcaagggcggcaaggggctgggaaagggcggcgccaagcgccacaggaaggtcctccgcgacaacatccagggcatcaccaagccggcgatccggaggctggcgaggaggggcggcgtgaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagattcctgacgtcctgtgctggtggtagtcgtgtgacctgtgtgatatgtgtcgtgatggatgggatatacttctctggcgtgcgtttgtgttcagtagtctgtaatgaaatgcgttcaatgaaactaccccgaccctgaattctaatgaaatgcttcagtgatgaatcgtgttttcgttttcccaggacttgc

SEQ ID NO: 3297 - DNA, 448 bp, Secale cereale
agtcaacatcaccggaggaagaaagagagaagcgagaagatgtcgggccgcggcaagggaggcaaggggctcggcaagggcggcgccaagcgccaccggaaggtgctgcgcgacaacatccagggcatcaccaagccggcgatccggcgtctggcgcgccggggcggcgtgaagcgcatctcggggctcatctacgaggagacccgcggcgtgctcaagatcttcctcgagaacgtcatccgcgacgccgtcacatacaccgagcacgcccgccgcaagaccgtcaccgccatggacgtcgtctacgccctcaagcgccaggggcgcaccctctacggattcggaggctaggccgccgccagattagagtgtctagggttcgtcgtcgttgatgtaatcgcagtatctcgctgttgttcgctatcttctgtagaatggaaattgaact

SEQ ID NO: 3298 - DNA, 457 bp, Helianthus annuus
  misc_feature (6)..(6): n is a, c, g, or t
ttatcnggccggggacaacccattattcaaacccaaatacaatgtcagggagaggaaagggaggcaaggggctgggaaagggaggagcaaaacgacaccgtaaagttctccgtgataacatccagggtatcaccaagccggcgatccgtcgtcttgcaagacgtggtggggtgaagcgtattagcggtttaatctacgaggagacacgtggcgtcttgaagatctttttggagaatgtgattcgtgatgcggttacctacacagagcatgctcgccggaagactgttactgccatggacgttgtttatgctttgaaacgacagggccgtaccctctatggctttgggggttgaattatatttagggttttgttgtttcttcacagatctaaaagtttgttcatatatctgtgtaattgaagcttctaatgcaattcagttgtttgattatgtgagaa

SEQ ID NO: 3299 - DNA, 382 bp, Triphysaria pusilla
ttcaaatcaaaacagtttttacaatttttgcagaacaaaaatgtcaggacgtggcaagggcggtaagggtttgggaaagggcggtgccaagcgccaccgaaaagtcctccgtgacaacatccaaggtatcaccaagccggccattcgccggttggctcgtcgtggtggagttaagcgaatcagcggtttgatctacgaggaaacacgaggtgtcctcaagatatttttggagaacgtcatccgtgacgcagtcacctacactgagcacgctcgccgcaagactgtcaccgccatggacgttgtctatgctctcaagaggcagggtcgcactctctatggctttggtggttgaggtcgtctctagggttagggcttttgtgta

SEQ ID NO: 3300 - DNA, 571 bp, Raphanus sativus
tttttcagcaccaaactttctcaatcgaaaaataaaaatgtcgggccgtggaaagggaggaaagggtttgggcaaaggaggagccaagcgtcacaggaaggttctgagagacaacatccagggaatcaccaagcctgccattcggaggttggctcgtagaggtggagtcaagcgtatcagcggtctcatctacgaggagacgcgtggcgtcctcaagatctttttggagaacgtcatccgtgacgcagtcacatgcaccgagcacgctaggaggaagacggtgaccgccatggatgtcgtctatgctctgaagaggcaagggaggactctctacgggttcggcggttaaggggcgttttagattcgcgtttgcgtttctgtgtttcttttctgggaatttctaatcgagtcatgtttctctttagcgtttgcgtttgaattatgtttgggtacgggcgtttatgtgttacggtagcgtttcgttttatatgtaattaggctttttattagcgatgcaatgtcgaatcaatccatggttaagtttctggggaaatataattcgaattttttt

SEQ ID NO: 3301 - DNA, 709 bp, Picea glauca
gtctttttataatttggttcattgcagagaaaggaagaatgtctggccgtggaaagggagggaagggtttggggaagggaggtgccaagaggcacaggaaagttcttagagacaatattcagggcattaccaagcccgccatcaggcgtctggccaggaggggaggagtcaagcgcatcagtgggctcatctatgaagagaccagaggcgtcctcaagatcttcttggagaatgtcatcagagatgccgtgacatatacagagcacgccagaagaaagaccgtgacagccatggatgtcgtctattccctaaagaggcagggccgaacactctatggtttcggaggctgaggagtctctctgtagttcattatttctcttggccatcaatcatttactcattcatggtgtttttcgacaccaccctctgtctctttgggagattgtgaccttcgttctacccgctgattgtatactgcggtgcttttctttgaggtctgcatatgtgggttgttggcaggtatgttctccgaattgtagttgttatatgcttaatctattattttatctgaaatgatgcggttttaggggtttctttttggcttcagcagggtctagcagggataaaactgttctgtattttcaccattctagattttgtaaaactgttctatagaatttgtaggatattctaataatctttacaacca

SEQ ID NO: 3302 - DNA, 482 bp, Solanum lycopersicum
ctagaaactacatcttcttcaaatttctctgtgaaaatgtctggtcgtggaaagggaggcaagggattgggaaagggaggagccaagaggcacaggaaggttctaagggacaacatccaaggtatcactaagccagctattcgcaggcttgctcgtaggggtggtgtgaagcgtatctctggtctcatctatgaggagacccgtggagtgttgaagatctttttggagaatgtgattcgtgattctgtcacctacactgagcacgccaggaggaagactgtcactgctatggatgttgtctatgctcttaagagacagggaaggactctctatgggtttggcggttagattggggtttgaatgttggtggtaaatgtaggtttagtttacaattgcgtataagtctgtcttggatctctgtagtgttgttcttatgctctagatgttgtaatttctcattacagtatcaatgaacagtagat

SEQ ID NO: 3303 - DNA, 416 bp, Artemisia annua
aaagaaaaagaaagaaaaaatgtcaggaagaggcaaaggaggaaaaggattaggcaaaggaggagcgaaacgacatcgtaaagtcctccgagacaacatccagggaatcaccaagcccgctattcgtcgtttagcgagaagaggcggcgtgaagaggataagcgggttgatttacgaagagacacgtggcgttttgaagatctttctagagaatgtgataagagatgcggtgacgtacactgagcatgcgagaaggaagactgtcactgctatggatgttgtttatgttctcaagaaggcaaggcaggactctttatggttttgggggttaatttaattaattaggtggtgtttttgtttatgttttaagtggatgtatgtatgatgtttaatcaatgataatgatgtctattgga

SEQ ID NO: 3304 - DNA, 471 bp, Helianthus annuus
  misc_feature (121)..(121): n is a, c, g, or t
  misc_feature (152)..(152): n is a, c, g, or t
  misc_feature (189)..(190): n is a, c, g, or t
  misc_feature (199)..(199): n is a, c, g, or t
  misc_feature (205)..(205): n is a, c, g, or t
  misc_feature (233)..(233): n is a, c, g, or t
  misc_feature (394)..(394): n is a, c, g, or t
tcaatctcaatctcaatttcatttcacaacaatgtcaggccgtggaaagggaggcaagggattgggaaagggaggagcaaaacgacaccgtaaggttcttcgtgacaacattcagggaatnaccaagccagctatccgtagattggctcgcngaggaggtgtgaagcgtatcagcggtttgatctatgnngagacacgnggcgtnctcaagatctttttggagaatgttatcngagatgctgtcacctacactgagcacgctcgcaggaagactgtgaccgccatggatgtggtgtatgcgctcaagagacagggccgtaccctgtacggtttcggcggttagggtttagggtgttgattgtagatctgttggatttgtgctttgttttgtttnagtgttggtgttgttgttctccatctcggagtcattgtttcgtgttaagaattgttctaattaatggaattaaattg

SEQ ID NO: 3305 - DNA, 447 bp, Triticum aestivum
  misc_feature (418)..(418): n is a, c, g, or t
  misc_feature (434)..(434): n is a, c, g, or t
gcgactccaagtttccctcggtaggcagcttccatctcatctccggcgatgtctgggcgcggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgccgcaagaccgtcaccggccatggacttcgtctacgccctcaaagcgccaagggccgcaccctctacggtttcggcggttgagcgccgtttagcttccccggttacctgcttttcctgcttgttcctggcgttggcntgccgtttgctcctgntaatccgtaccct

SEQ ID NO: 3306 - DNA, 806 bp, Hordeum vulgare
accaccaccgctcctcatattcaacatccgctcgcagctcgaagaggatcaatcgtcagccatgtctgggcggggcaagggaggcaaggggctcggcaagggcggcgccaagcgccacaggaaggtgctccgcgacaacatccagggcatcaccaagccggcgatccggcggctggcgcggaggggcggcgtgaagcgcatctcggggctcatctacgaggagacccgcggcgtgctcaagatcttcctcgagaacgtcatccacgacaccgacacctacaccgaacacgcacaccgcaagaccggaaccgctatggacgttgagtacaccctaaaacgacatggccaaaccctatacagattaagcggttatggccttaaagctttatctcgtctgcagtctcccgcacctttctgaagccaccacttgtcgggctagagtgattcttagtcactgacataaatattggacggatttatcaaattttaatttaaaaaaaatatcatcagacgaatcgtcttattgaacctaccacattcaaggatacgcggatcagtcaagattaaaatcttttaatactcatccatattttctcccacatgcgttgcagaacagaacatgtaccccttggcacccaaactatcgaacctaattgtctaaatacgttctttctttagttctataactcctattaccgggaaaagtgttaaaaaattattgacttattatttatattttaccgatatgtactctatttttactattacctaacaacgtacctgtttccttaatccacaataaatat

SEQ ID NO: 3307 - DNA, 373 bp, Hordeum vulgare
gcacctccaccactcccaggcccgacaccagcgaaccccaccggacagaccgacagaacccgcggcggcgtcggcgaagatgtccgggagaggcaagggcggcaacgggctggggaacggctgaaccgcacgcctccggaaagtgctgcgcgacaacatccaggggatcacgaagccggcgatccggcggctggcgcggcggggcggcgtgaatcgcatctccgggctcatctacgaagagacccgcggcgtgctcaagatcttcctcgagaacgtcatccgcgacgccgtcacctacaccgagcacgcccgccgcaagaccgtcaccgccatggacgtcgtctacgcgctcaagcgccaaggccgcaccctc

SEQ ID NO: 3308 - DNA, 476 bp, Hordeum vulgare
gggggagtggcgctaaccggagagaagcgagacgatgtcgcgccctggaagggccggcaaggggctcggcaagggcggcgccaagcgccaccggtaggtgctccggaacaacattcagggcatcaccaagccggacatccgtggtctcgcgcgcaggggcggcgccaagcgcatctcggggctcatctacgaggagacccgcggcgtgctcaaaatcttactagagaacgtcatccgcgacgccgtcacctacaccgagcacgcccgccgcaagaccgtcaccgccatggacgtcgtctacgcactcaagcgccaggggcgcaccctctacggacttggacgctaggccaccaaccaaatccagagagttttagtggttgcggtcgttggtgtaactcgagcatctcgtttgccggtgctgtttaatgtagaagctaacggaatcgaatggaaattggtgtggattatgcctgaaa

SEQ ID NO: 3309 - DNA, 448 bp, Theobroma cacao
cgaaacaaaaaccgttgtcagactttcagcctctggaaaccaattttctcaggaaaatgtctgtccgtggaaagggaggtaagggattgggaaagggtggagccaagaggcacaggagggtgcttcgagatgacattcggggtatctccaagccggcgattggaaggttggttcgtagaggtggtgtgaagaggttcagcggcttgttttaggaggagccacgtggcgtccttaagatctttttggaaaatgtgatccgtgacgccgttacctatacggagcacgctaggcgcaagactgttaccgccatggacgtcgtgtacgctttcaagaggcagggcaggactctttacggtttcggtggttaggttgatttagccgggttgattggttttaaaaattgggatttgtttcagaatttcatgttgaaatccactttgagttcgta

SEQ ID NO: 3310 - DNA, 573 bp, Zea mays
agaacaacaacaacccgcacaacggcacgattctcctcctgcgtccgcgtagctctcggtttcggcgatgtcggggcacggcaagggcggcaaggggctgggcaagggcggcgccaagcgacacagcgaggtgctgcgcgacaacatccagagcatcacgaagccggctatccttacgctggccagaaggggcggcgtcaagcgcatttctgggctcatctacgaggagacccgcggcgtgctccaagatcttcctcgagaacgtcatccgagacgccgtcgcctacaccgagcacgctcaccgcaagaccgtcaccgccgaggatgtcgtctacgctctcaagcgccagggccagcaagctctacggcttccgcggctaagccacctccccttctgatgattcgatatgacggccgtggtcggtcgtgtgtctagctggacagtctactgtattttgttctgtatcttcacttcgaggtgttcaagttgctaacgcatttggcgtaatattttcacagatattatcaatggaaagcactccgttctatgcctaaaagagagaaaaaacacaa

SEQ ID NO: 3311 - DNA, 565 bp, Zea mays
cgagccagcttcagctacccgcactacccctctttatatatgttcctgctacgtacacgtagttctacgtttccgccacgtccgggcgcgccaagggcggcaaggggcatgggcaagggccgcgccaagcgccgccgcaaggtgctgcacgacaacatccagggcatctcgaagccggctcatccgtcggctggtcagcaggggcggcgtcaagcgcatttctgggctcatctacgaggaaacccgcggcgtgctcaagatcttcctcgagaacgtcatccgccacgccgtcacctacaccgagcacgcccgccgcaagactgtcaccgccatggatgtcgtctacacgctcaagcgccagggccggacgctctacggcttcggctgctacgccgcctccccttctgatgctttgatatcacggccgtggtcggttgtgcgtctagtcggcctgtctatagtattttgttctgcatcttcccttcgaggtgttcccatttctagcccatttaggtgtaatatttttccacctattatcaattgaaaacccctcggttctatccac

SEQ ID NO: 3312 - DNA, 700 bp, Saccharum officinarum
ccaattcttcttatccgtcagagaagagggcccgtgcgaggcggcggcggcggcggcgatgtcggggcgcggcaagggaggcaagggtctgggcaagggcggcgcgaagcggcaccagaaggtgctccgcgacaacatccacggcatcaccaagccggcgatccggaggctggcgctgaggggcggcgtgaagcgcatctcggggctcatctactaggagacccgcggcgtgctcaagatcttgctcgagaacgtcatccgcgaggccaggatctacaccgaacacgcgcgccagaggaccgtcaccgccatggacgtcgactacgcgctcaagcgcgctggccgcaccctctacgggttcggaggctacgcgcctcttcacatcttgggaaccgctgggggaaagcactctgtgccgatgcgggtcgaacgttgctagcgctgctgcgcacgctgatgtaaacctacaatctgttcatgccatgaagaaacgcgagccatgatgctctggcacggggttacaacaaaaaaaaaaaaagggccggctactctatcaagagtgcaaagcttacagcacggatggcatgccgacatgggtaccttttcaaaataaggcaaccctaaagttgcaggtaaccgggccctgtgtttttaaaaggggcggaggaatggtgaaaaccccttggtgggtgccccaacc

SEQ ID NO: 3313 - DNA, 546 bp, Saccharum officinarum
  misc_feature (69)..(70): n is a, c, g, or t
  misc_feature (97)..(97): n is a, c, g, or t
  misc_feature (99)..(99): n is a, c, g, or t
  misc_feature (111)..(111): n is a, c, g, or t
  misc_feature (115)..(115): n is a, c, g, or t
  misc_feature (117)..(117): n is a, c, g, or t
  misc_feature (123)..(123): n is a, c, g, or t
  misc_feature (132)..(132): n is a, c, g, or t
  misc_feature (139)..(139): n is a, c, g, or t
  misc_feature (144)..(145): n is a, c, g, or t
  misc_feature (149)..(149): n is a, c, g, or t
  misc_feature (151)..(151): n is a, c, g, or t
  misc_feature (154)..(154): n is a, c, g, or t
  misc_feature (159)..(159): n is a, c, g, or t
  misc_feature (162)..(162): n is a, c, g, or t
  misc_feature (167)..(167): n is a, c, g, or t
  misc_feature (170)..(170): n is a, c, g, or t
  misc_feature (190)..(190): n is a, c, g, or t
  misc_feature (193)..(193): n is a, c, g, or t
  misc_feature (353)..(353): n is a, c, g, or t
  misc_feature (396)..(396): n is a, c, g, or t
  misc_feature (414)..(414): n is a, c, g, or t
  misc_feature (420)..(420): n is a, c, g, or t
  misc_feature (434)..(434): n is a, c, g, or t
  misc_feature (444)..(445): n is a, c, g, or t
  misc_feature (449)..(449): n is a, c, g, or t
  misc_feature (465)..(465): n is a, c, g, or t
  misc_feature (479)..(479): n is a, c, g, or t
  misc_feature (483)..(483): n is a, c, g, or t
  misc_feature (503)..(503): n is a, c, g, or t
  misc_feature (505)..(505): n is a, c, g, or t
  misc_feature (524)..(524): n is a, c, g, or t
  misc_feature (536)..(536): n is a, c, g, or t
cggcgaattcgaatcccacaatttttgtagcacacaccaccgtcactcgagtcttctttcctcttcggnngcgatgtctgggcgcggcaagggcggnanggggctggcaanggcngngcgaancgccaccgnaaggtcntccgnnacancntcnagggnatnacaanccngcgatccggaggctggcgangangggcggcgtgaagcgcatctccgggctcatctatgaggagacccgcggcgttctcaagatcttcctcgagaacgtcatccgcgacgccgtcacctacaccgagcacgcgcgccgcaagaccgtcaccgccatggacgtcgtctacgcgctcaagcgccanggccgcaccctctacgggttcggcggctgagcgcgtgcgcgtntccttcgtcctctgcagntgctgntcgttcgccttacntactcctttnngatncctgttccgtgctttncttgatgagacagntatnggattctaagtctctgccgngnctcgttattaagtggaatnatgtgtccctantacccctgaa

SEQ ID NO: 3314 - DNA, 822 bp, Saccharum officinarum
  misc_feature (15)..(15): n is a, c, g, or t
  misc_feature (608)..(609): n is a, c, g, or t
ctgcctagagatggntacgccatgcagagtaccaggtccgcgaattcccggcgatcgactcacgccatctcctatagctgactgatcgtgttcaaccatgtctggccgccgcaagggatgcaaaggtctgggcaatggctgagcaaagcacctacgaatagtgctccatcatcacatccaatgtatcacgaagccggcgatccggaggctggcgcgcaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctgtacggcttctgcggctatgcgcgtcccgccccctatctccgctcaggcgtcatctctggttcgtggtccccgttcggggcagtggtgaactgttatggtctcgtaccgactgtagtctgtaggctcgtggtgtgaacgaataatgtaaagtgaatgaaatgcgtctgtgttctcaaacaacgaatggttagtggtcggccgctctaaaggatccaannctgggctgcgcgctctatgacgatccaatatcttcgtctatcgtgtatgcgaagatcatagcttcttcggatcagtgtcacctcaaatgtcaatgacactgggaccgatcgcttgtaacaaacactccatggaactagtggaacaaacccctgggccggttaccccaaacttttaaatccggcccgtgttgcaagacaaacattccacacaca

SEQ ID NO: 3315 - DNA, 872 bp, Saccharum officinarum
  misc_feature (15)..(15): n is a, c, g, or t
  misc_feature (608)..(609): n is a, c, g, or t
ctgcctagagatggntacgccatgcagagtaccaggtccgcgaattcccggcgatcgactcacgccatctcctatagctgactgatcgtgttcaaccatgtctggccgccgcaagggatgcaaaggtctgggcaatggctgagcaaagcacctacgaatagtgctccatcatcacatccaatgtatcacgaagccggcgatccggaggctggcgcgcaggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctgtacggcttctgcggctatgcgcgtcccgccccctatctccgctcaggcgtcatctctggttcgtggtccccgttcggggcagtggtgaactgttatggtctcgtaccgactgtagtctgtaggctcgtggtgtgaacgaataatgtaaagtgaatgaaatgcgtctgtgttctcaaacaacgaatggttagtggtcggccgctctaaaggatccaannctgggctgcgcgctctatgacgatccaatatcttcgtctatcgtgtatgcgaagatcatagcttcttcggatcagtgtcacctcaaatgtcaatgacactgggaccgatcgcttgtaacaaacactccatggaactagtggaacaaacccctgggccggttaccccaaacttttaaatccggcccgtgttgcaagacaaacattccacacacatttttccgccccaagccttgggcccgtttaatttagcccaaaaagaaagg

SEQ ID NO: 3316 - DNA, 448 bp, Triticum aestivum
  misc_feature (17)..(17): n is a, c, g, or t
aagccaatctcgccggnagaaagaagcgtcgacgatgtccggccgcggcaagggagggaaggggctgggcaagggcggcgccaagcgccaccggaaggtgctgcgcgacaacatccagggcatcaccaagccggccatccgtcgtctggctcggcgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccagattcactagctagccatcggtcgtccgtgttcatggtctttgttgtaatggaacggccgcatctcgctgctgtctgttgtttcgatgtagtactactagcatggaatggaaatctcagcgtttttacccctgaaaaaaaaaa

SEQ ID NO: 3317 - DNA, 390 bp, Triticum aestivum
  misc_feature (357)..(357): n is a, c, g, or t
  misc_feature (360)..(360): n is a, c, g, or t
acaaagacaagtcaacctcaccgaggagaagagaagaaaagagaagcgagaagatgtcgggccgtggcaagggaggcaaggggctcggcaagggcggcgccaagcgccaccggaaggtgctgcgcgacaacatccagggcatcaccaagccggcgatccgccgtctggcgaaggaggggcggcgtgaagcgcatctcggggctcatctacgaggagacccgcggcgtgctcaagatcttcctcgagaacgtcatccgcgacgccgtcacctacaccgacaccccccggcaagacctcaccgccatggactcctctacctctcaaacgccaaggacgcaccctctacggttccggagntangccgcacaacaacaagattaggactaccca

SEQ ID NO: 3318 - DNA, 783 bp, Triticum aestivum
  misc_feature (767)..(767): n is a, c, g, or t
gcgtgttcgcggccgaggtttttgatatctcaaactcccaaaacaacccacatcaatcatcatgactggacgtaagtaacttcctatttttacttgcctcatccatgcttggcgatgctggtccatcgtcgtcgctgtctccagtcttcagctgctgtcgccttaagccttgcggcttgcatggtgccttagcttcgaagcttcagcctcggccttgacgcgtctgccagctacctccatcgccacttcaagatcatcttgattaacaatctacaatacaggcggcaaaggtggcaagggcctcggcaagggtggtgccaagcgtcaccgcaagattcttcgtgacaacattcagggtattaccaagcccgctatccgacgtctcgctcgtcgtggtggtgtcaagcgtatttctgccatgatctacgaggagacccgtggtgtcctcaagtccttcctcgagggtgtcatccgtgatgccgtcacatacactgagcacgccaagcgcaagaccgtcacatcactagacgttgtctatgccctgaaacgacagggccgcaccctgtacggtttcggtggttaagcgatctgccaccaggtcgggtcgacataatgtgttattcgcgtgtttgttacgattgggcttttcactatgggcgcgggtcattgctttttgagattttgtactgtacaacgtactgggaaatgggtgacttccgaaagggggtaattgagacttattcagtggtgaccttgaaaacctcggncgcgaccacgctaatc

SEQ ID NO: 3319 - DNA, 455 bp, Hordeum vulgare
agcgtgtataactttatcatcacaaccgttactacacacctcaaacaatcaacatgactggacgcggcaagggcggaaagggtctcagcaagggtggtgccaagcgtcaccgaaagatcttgcgagacaacatccagggtatcacaaagcgcggcatccgacgtctcgctcgtcgtggtggtgtcaagcgtatctctgccatgatctacgaggagacccgcggtgtcctgaagaccttcctcgagggtgtcatccgtgacgccgttacctacacggagcacgccaagcgaaagaccgtcacatctcttgacgttgtctacgccctgaagcgacagggacgtaccctctacggtttcggtggttaagctctttttgttttacatgcctgttacaaatctttgcggtcgactgcttgcagcgcaagaccttgtagggtgtgccatgatgacattggg

SEQ ID NO: 3320 - DNA, 728 bp, Hordeum vulgare
gtggaaaaggtggaaagggtcttggtaagggcggagccaagcgccatcgcaagattcttcgagacaacatccaaggtatcacaaaacctgctattcgccgtctcgctcgtcgtggtggagtgaaacgtatctcagctatgatatatgaagaaacgcgtggtgttctgaagactttcctagaaggcgtcatccgagatgctgtaacgtacactgagcacgcaaaaaggaaaactgtcacatctctcgatgttgtttatgcactgaaaagacaaggtcgcacactatatggtttcggaggctaaactccaattaacaccacctgttaattccatacaactgatcacgaaaatacttcaaagaggatgccaagtaatttttcaggcgtcacggaacagaccgatcccgtccttccagtcataaatttacagcaaatgctctcggttacaatgctgcgttaattcatttttcttgtaaacgttcgctagatatcacatattgaggaggaagactagcctaacgatctagacagtttatctgaaacacagacagcaaaggctaatagactttatggatatactgcgcaggcgttcgatggggaacattgatagggtcgtgaccaaggactgatacgccatgtaattgaactgaattgttcaaattagtttagacgcgaattgatgcagatagaatttaaatcaaataatacagtactactatcaaaaaaaaag

SEQ ID NO: 3321 - DNA, 631 bp, Manihot esculenta
gactggagccagcagtctctttccctcagcttcgctctacaaagtccgacacgtaaggtactgaagcttcccctttttcccactacttctattatccatttaatcgtataattttttttctcattttccctcaattttatcgaacgatcgctagttcttccctttctctaccccccttcaactttggtggttgtttggtcaacgagaaactgctggaaaaataaagaaaatttagttcatacggtgtgttcatttctttattacttgttgcaaaagtgtctagctcagataaatttgattatgtgggttctaattcatcaattgaatcaaatttacagatccttcctgtgaacaaaaatgtctggccgtggcaagggaggcaagggactaggaaagggaggggccaaacgtcaccgcaaagtccttcgcgataacatccaaggcatcacaaagccagcaattcggcgattggctcgcagaggtggtgtaaagcgtatcagtggattgatctatgaagagacccgtggagtgctcaagatcttccttgagaatgtgattagagatgctgtgacctacacagaacacgctcgccggaagactgttacggccatggatgtggtgtatgcattga

SEQ ID NO: 3322 - DNA, 543 bp, Cenchrus ciliaris
gggcgcggcaagggcggcaaggggctcggcaaggggggcgccaagcgccaccggaaggtgctccgcgacaacatccagggcatcacgaagccggcgatccggaggctggcgaggaggggcggcctgaagcgcttttccgggttcatttacggggggggcgggggggtgataaagattttcctcgagaacgtcatccgggacgccgtcacctacacggagcacgcccgccgcaagaccgtcacccccatggacgttgtttacgcgctcaagcgccagggccgccccctttacggatttggggggtgagggcgtccccttccacgtttgcagctgttggtggtggtgggggggttgctgtgtttttttgcgttccctgtgctgtgcttttcccttggggatgtagagaggtcaggttcctagatgatagatctgtggagtgcttttttcttaagtggtgggcgctatgtaatggtttaattaaagttgaactcccaatttcagcttccgtccatgcaatcaaatgttaatcccggtcagctagta

SEQ ID NO: 3323 - DNA, 336 bp, Eucalyptus gunnii
  misc_feature (280)..(280): n is a, c, g, or t
  misc_feature (325)..(325): n is a, c, g, or t
ggaagggaggcgcgaagcggcaccggaaggtgctgcgggacaacatccagggcatcaccaagccggccatccggcggctggcccgccggggcggggtcaagcgcatcagcggcctcatctacgaggagacccgcggggtgctcaagatcttcctggagaacgtgatccgcgacgccgtgacctacaccgagcacgcccggcggaagaccgtgacggccatggacgtggtgtacgcgctcaagcggcagggccggaccctgtacgggttcggaggctgacnaggctcggcgtcggggttgggtttctgctatgtattgttgttgcntgttagtattc

SEQ ID NO: 3324 - DNA, 440 bp, Prunus persica
gcaaaggggggagccaaacgacatcgtaaggtcctcagagataacatccagggcatcaccaagcctgcgattcgtcgtctggctcgcagaggtggtgtgaagcgtatcagtggtctgatctacgaggagaccagaggcgtcctcaagatctttctcgagaatgtgattcgtgatgcagtgacttacactgagcacgccaggaggaagactgtgaccgccatggatgtggtgtatgctttgaagaggcagggaaggaccctctatggttttgggggttagattgggaatttttcatgctgtgtatcgcgtatattaggtttagggtggtttcagatcttgtctttagatctcttagcttattaggtaatttgtggttaagaattagctttgatgtaatttgcacccttattttgaagtaatacaagttcaatttgttagca

SEQ ID NO: 3325 - DNA, 545 bp, Persea americana
ccagagagaggcgcagagaagaagagcgagcgaagaaagcagagatgtcaggccgtggaaagggaggaaaggggctgggcaagggaggagcgaagaggcacaggaaagtcctgcgggacaacatccagggaatcacgaagcccgccatcagaagactcgcacgcagagggggcgtgaagcgcatcagcggcctcatctatgaggagactcggggggtcttgaagatctttctggaaaatgtcatcagagatgctgtgacctacacagagcatgccaggaggaagactgtgactgctatggatgttgtctatgctctcaagaggcaggggaggactctctatggctttggtggttgaggtttctctgtctgtgtctttatgcctcctcctgtgcatgatagatagcagctgctaggttctgtcaatgcttgcttgcttgcttcctttcttttgtttgtcctcttattcttctcttctcttgttgcttgtaaaaattttctatttctatcttggtacttgatgtttgttatggatggtgctgaaatg

SEQ ID NO: 3326 - DNA, 504 bp, Brassica rapa
acagtcttcaaaactctctcttacattcaaaagcaaagaaaaaaatgtctggacgaggcaaaggaggaaagggactgggaaagggaggagccaagaggcacaggaaggtcctccgcgacaacatccaggggatcaccaagcctgcgattcgtcgtttagctaggagaggtggtgtgaagcgtatcagcggtttgatctacgaggagactcgcggcgttctcaagatcttcctcgagaacgttattcgtgacgctgtgacttacactgagcacgctaggaggaagactgtgacggcgatggatgttgtgtacgctttgaagaggcagggaaggactctgtacgggttcggcggctgaggggattgaattagggatttgtaaatcgcgtttgttgtttttagggtttggttaatttggggagattaagatctctataagctgtctgaagggttttatctgaatgttttaagtggtttttaattgaatgagaaaaggcttttatctg

SEQ ID NO: 3327 - DNA, 777 bp, Vigna unguiculata
cagatcgtgagtgttgctgtcatcgcgattttgcaaggaagaagatgtctgggcgtggaaagggaggtaaaggtttgggaaagggaggagcaaaacgacaccgtaaggtattgcgcgacaacatacagggaattacgaagcctgcaattcggcgtttggctcgtagaggtggcgtgaagcgtatcagtggtctcatatacgaagagactcgcggcgttctcaagatctttctggagaacgtgattcgcgacgccgttacttacaccgagcacgccagaagaaagaccgttacggcaatggacgttgtctatgccctcaagagacagggaagaacgctttacggatttgggggttagggtttttcttttcgctgttatgtttcttctgacttgtttttgtttggttttagtggttatcgattttgtttgtcgttattataaattttagttgtgaatcgtgatccatgaataggtttggttgtttgtgagaaatgtagcactaggaaagtgtgtttgtgaataactacaaagtatacttgggaatttggtgattttagcgttctgtgtcagccaaggtcctttttgactcaacattccacaacgttgttcagtgaatggttaaccagtgcttaagtgtcttgttgagaagattgagttgacctacactaaccccatttcattacaaaaagcctattaatttgggtaggttaaggttttcttgtttcattgtttccatgaatgaataaatgatgaataagcacttgctagatgaaaacga

SEQ ID NO: 3328 - DNA, 892 bp, Festuca arundinacea
ggcacgaggaagaaatccccctcttctccgaaggagcagcagccatgtccgggcgcggcaagggcggcaaggggctcggcaagggcggcgccaagcgccaccgcaaggtcctccgcgacaacatccagggcatcaccaagccggccatccgcaggctcgccaggaggggcggcgtcaagcgcatctcggggctcatctacgaggagacccgcggcgtgctcaagatcttcctcgagaacgtcatccgcgacgccgtcacctacaccgagcacgcacgccgcaagaccgtcaccgccatggacgtcgtctacgcgctcaagcgccagggacgcaccctctacggattcggcggctgagcagagcagtcgcggcgccggatggcctggccggaagtcttggctcccggtcaagaaattgagcagacgagaaaaccgtattagtagttgatttgggttccctgctttagttccatgggtagtagttgtagcagcatcgtcagcagtactaagtgttggcagtgcaaagtttgttctgtgttatcattcttgttgtcaacttcagatgggcaaatatggtgtttgccgagttatatgatttcagcagtaaaaggttgtagtacttcggctttgaattaggctatcaacattctgttcatttggtgttttaattttcgctaccccatttcatctaaagcaactctcaaaatttggatggttgtggttcagggcagtattcagatgggctgtggttggtactgttcagctcttctcattgatttctgctgcaaatcttgccttggcttgattatagagctagcaatttgctgcgatatttgaatgttctcctacaaatcttgctgtgtagtgggatattttctcactttgcaagctgt

SEQ ID NO: 3329 - DNA, 611 bp, Festuca arundinacea
  misc_feature (459)..(459): n is a, c, g, or t
ggcacgaggcagccacacaagtcaacctcgccggagaagaagatgtcgggccgcggcaagggaggcaaggggctcggcaagggcggcgcgaagcgccaccggaaggtgctccgcgacaacatccagggcatcaccaagccggcgatccggcgcctggcgcgccgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctttacggcttcggaggctaggcctctctctgctgccggtccacccccagattagagaagttgctactaggtttagggttcgtcgtttgttgttgggtgtagtcgttcgtgtgtcgctgttgtttnctgttgtcctgtgatgcgttgggtgtattaggtcgagctgaacccctggttcggtagaatggaatggaaatttcactagttaatccttcaatttccctgcaatttttcttctgttgatgtcgatttgtgcaagcaagtactgctaaccgttg

SEQ ID NO: 3330 - DNA, 776 bp, Zingiber officinale
  misc_feature (78)..(78): n is a, c, g, or t
  misc_feature (141)..(141): n is a, c, g, or t
  misc_feature (168)..(168): n is a, c, g, or t
  misc_feature (249)..(249): n is a, c, g, or t
  misc_feature (369)..(369): n is a, c, g, or t
  misc_feature (381)..(381): n is a, c, g, or t
  misc_feature (399)..(399): n is a, c, g, or t
  misc_feature (405)..(405): n is a, c, g, or t
  misc_feature (477)..(477): n is a, c, g, or t
gcgcgaggcccaaatcgattacaactcagaatcagatcgattatgtcgggccgcgggaagggaggcaaagggttgggnaagggcggcgccaagcgccaccgcaaggtcctccgcgataacatccagggcatcaccaagccngccatccgccgcctggcgaggaggggnggcgtcaagcgcatctccggcctcatctacgaggagacccgcggtgtccttaagatttttctcgagaacgtcatccgtgangccgtcacctatactgagcatgcccgccgcaaaactgtcactgccatggatgtcgtctacgccctcaagcgccaaggccgcactctctacggcttcggcggctaaacgtcaatatggcanaaaggtagtgcntgatagaattgtaatcanaatctntcagtgttagatacaaaatattgaatattgccgttgctgaacttcatcacattgcctcctgtggaaatccangcatttgtgtcaccttatcccatccggcattttcgtccaacgcaggttcatgatgcagatgcacccctacacccctactgcgttcaagcggcgaccatagggttacgaattggaggtggcaatgtattttcttttcttttatttttttggtaatgcatgtatcagttcatcgtattaatcggggatgtgattgatccggtctcaaaataaagtttcttatggactattatgtaaactgcagatgagtttaagtggatattttatgtgtggggttcacattctcatgctaaaaaaaaggg

SEQ ID NO: 3331 - DNA, 461 bp, Lactuca sativa
  misc_feature (251)..(251): n is a, c, g, or t
cggggatcgtattagcatacacagaaaacataaacacaaacaaaatgtctggaagaggaaaaggaggcaaaggattgggaaagggaggagcaaaacgtcaccggaaagttctccgtgacaacatccagggtatcacaaagccggcgattcgccgtcttgcgaggcgtggcggtgttaagcgtataagcggtcttatctacgaggagacacgtggtgtgttgaagatcttcctcgagaacgttattcgtgangctgttacttacaccgagcacgctcgccggaaaactgttactgcgatggacgttgtctatgcattgaagcgtcagggtcgtacactgtacggattcggtggttaagttaacttaggatatttattgttaggttctttagattttcgatttgcttcgttttttattgaaatgtatggtatatcagctgaatcgaaggtcgattgtgacttg

SEQ ID NO: 3332 - DNA, 516 bp, Medicago truncatula
cccaaattttatatttcttttctcgaattttcatcttttgaaaatgtcagggcgtggaaaaggaggtaagggactaggaaagggaggtgcaaagaggcataggaaagttcttcgtgataacatccagggtatcaccaagcctgctattcgtcgattggcaagaagaggtggtgttaagagaatcagtggtttgatatatgaagaaaccagaggtgtcttgaagatcttcttggagaatgtcatccgtgatgcagttacatacactgagcacgctaggaggaagactgttaccgccatggatgttgtctatgctttgaagagacaaggaagaaccctctatggtttcggtggttgaagaagaagtaacactatattctgttttatgctttaactgtgtaatttgaacatgtgattgttctttaaaatgcttatttggattgttcctttgtaagtttcaacaagatttgaatctaatgaattaaactgttctttaatattttctggtgaaaaaaaaaa

SEQ ID NO: 3333 - DNA, 552 bp, Raphanus sativus
  misc_feature (111)..(111): n is a, c, g, or t
  misc_feature (507)..(507): n is a, c, g, or t
aaactacaactgagaatcttctttattttctcaaaggaaaaaaaatgtcgggtcgtggaaagggaggaaagggtttgggcaaaggaggagccaagcgtcacaggaaggttntgagagacaacatccagggaatcaccaagcctgctattcggaggttggctcgtagaggtggagtcaaacgtatcagtggtctgatctacgaggagacacgtggagtcctcaagatctttttggagaacgtcatccgtgacgccgtgacctacaccgagcacgccaggaggaagacggtgacggccatggatgtcgtctatgcgttgaagaggcaagggaggacgctttacgggtttgggggttaagggtcttttgagattcgcgtttgcgtttctgggtttcttttaggtgttgttcttctggaaatttctaatcaaatcgtgttatccagtgtgtgcgtttttaattctgtttgggtacggtcttttgtgtgtcgcggtagcgtttcgttctatntaatgtaattacgcattttatcaatgaagctgttcgagtttatga

SEQ ID NO: 3334 - DNA, 460 bp, Helianthus annuus
  misc_feature (440)..(440): n is a, c, g, or t
accacaaatcaatactttgtcaaatcgaaatctcactgcaacaatgtctggacgcggaaagggaggaaaggggctgggaaagggaggagcaaagcgtcaccggaaagttctccgggataacattcagggtatcaccaaacctgcaatcaggaggctcgctagaagaggtggagtcaagagaatcagcggtctcatatacgaagagactcgtggcgttctgaagatatttttggagaatgtgattcgtgacgctgttacctacacggagcacgctcgccggaaaacagtgacggcgatggatgtcgtctatgctttgaagaggcaaggaagaactttgtacggtttcggaggttaatggtcaagtctgtgatgatattatatggaatatgtaattgttgaagttaatctgatgttaatggaatcaatgctcaagttttatnatcgaaaaaaaaaggttaaa

SEQ ID NO: 3335 - DNA, 452 bp, Helianthus annuus
  misc_feature (329)..(329): n is a, c, g, or t
  misc_feature (391)..(391): n is a, c, g, or t
  misc_feature (406)..(406): n is a, c, g, or t
caaaccattcctattacaacaagatcttattattggaaccaacgatgtctgggcgtggaaaaggcgggaaagggctaggaaaggggggagcaaagcgtcacaggaaagttctacgtgataatattcagggtatcactaaaccggctatcaggaggctcgctagaagaggtggagtgaagaggatcagtggtctgatatacgaagagacacgtggggttttgaagatatttttggagaatgtgatccgtgacgctgttacctacacggagcacgctcgccggaaaacagtgacggcgatggatgttgtctatgctttgaagaggcaaggnagaactttgtatggattcggaggttaataataaactggtagtgagtattgctgttaaatcantgtaatcaacatganaaaggttgaacttattgttgtggaatgaaagtgaattgttcacaaa

SEQ ID NO: 3336 - DNA, 716 bp, Triticum aestivum
attcggcacgagcacccttcctcccagtcccattccacagccatgtccgggcgcggcaagggaggcaagggtctcggcaagggcggcgccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctagggccgtccggccgacggtcgtcgctctttgtcgccgcctgcagattccaaaagcctgatgagaccctgacttgtttagttcgctatttcctctgtagctcgaactgaatcgtggaccaaagttattcgcatgtgttgttggaaatgaaacctgtctctgttgtgataccgtgtttctgattttgtctcgctggtcggtctctgttattgaagcggcaacgagttgatttgccataatttaccaggagccccggatgagtcgtagtactacttgtttgcagtctattttgtaatgccatagtgactgaacaattgtgtgtcccgattcagcaacatcatttgctcaccattgatgttacttct

SEQ ID NO: 3337 - DNA, 561 bp, Triticum aestivum
gaccaccagcagcaacacaccaccacaccgaggccaagcgaagatgtcgggccgcggcaagggagggaaggggctgggcaagggcggcgccaagcgccaccggaaggtgctccgggacaacatccagggcatcaccaagccggccatccggcggctggcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggattcggcggctaggccacgcgaatcgacccccccaccaccagatttgtgctagtagctagctaatggctgtgtagtgttcgtgggctttggtttaatggccgcatcttgctgctgtatgtcctggccttgattgctgtttggatgtagttctggggtggaattgaaattgaagtggtttaccttgaattcttctgcgacctcccactcttttgatattg

SEQ ID NO: 3338 - DNA, 535 bp, Triticum aestivum
ccgctcctcctccatttccatctccgtcagctccaaggaagccatgtccggccgcggcaagggagggaagggcctcggcaagggcggcgcgaagcgccaccggaaggtgctgcgggacaacatccagggcatcaccaagccggcgatccgtcgtctggctcggaggggcggcgtgaagcgcatctcggggctcatctacgaggagacccgcggcgtgctcaagatcttcctcgagaacgtcatccgcgatgcggtcacctacaccgagcatgcccgccgcaagaccgtcaccgccatggacgtcgtctacgcgctcaagcgccagggacgcaccctctacggcttcggcggctgacctgcacctcctgctgatgctccagccagtcgactctgctacctgctgctgttccatcggtctgtgtagttagtggaaggtgatggatctgaatgcaattgaaattgttggttcttgcaacaaatgaatctgaatgcaatggaaatatattgtgctgcatctcgctatgattgtaccttc

SEQ ID NO: 3339 - DNA, 476 bp, Triticum aestivum
agacaagtcaacctccccgcagagaagaagggagaagcgaagatgtcggggcgcggcaagggagggaagggtctgggcaagggcggcgccaagcgccacaggaaggtgctccgggacaacatccagggcatcaccaagccggcgatccggaggctggcccggcggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctttacggattcggaggctaggccgccaccaccagattagagtgtctagggttcgtggtcgttgatgtattcgcagtaactcgctgttgtttgctatcttctgtagaatggaatggaattggaattggagcagttttttttga

SEQ ID NO: 3340 - DNA, 495 bp, Triticum aestivum
ctccaatcccaccttcggagcagccagctagcatcgccagccatgtcgggccgcggcaagggaggcaagggcctgggaaagggcggggcgaagcggcacaggaaggtgctgcgcgacaacatccaggggatcacgaagccggcgatccggcggctggcgcggcggggcggcgtgaagcgcatctccgggctgatctacgaggagacccgcggcgtgctcaagatcttcctagagaacgtcatccgcgacgccgtcacctacacggagcacgcccgccgcaagaccgtcaccgccatggacgtcgtctacgcgctcaagcgccagggccgcactctctacggctttggcggctgagcccggatcgatttagatgtggttaggcgggtcgtcgttctgtggtgtgtgctgtcctgtgtgtgcagctgcgagctgcgtgctggtgcttgtaatgagttccagaatctaatatgggtgttcatctcgcattggattgaa

SEQ ID NO: 3341 - DNA, 484 bp, Triticum aestivum
  misc_feature (308)..(308): n is a, c, g, or t
  misc_feature (324)..(324): n is a, c, g, or t
  misc_feature (346)..(346): n is a, c, g, or t
  misc_feature (351)..(351): n is a, c, g, or t
  misc_feature (370)..(370): n is a, c, g, or t
  misc_feature (423)..(423): n is a, c, g, or t
gttcctccggttccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctccggggctcatctacgaggagaccccgcggcgtgctcaagatcttcctcgagaacgtcatccgcgacgccgtcacctacaccgagcacgccccgcccgcaaagaccgtcaccgccatggacncctctacgcctcaaancgcaaaggggcacctcctacgnttccngcggtaagcccgccgacgncccattctctctcgccgcctgcagattccaaaacttgatggacccgactgtcnattcgctttcctgtgtactccattgtttgttgggaacaaatctctctgcaaaaaaaaaaaa

SEQ ID NO: 3342 - DNA, 339 bp, Artemisia annua
ctccacatttcactaaaaacatcaaactttttcattcaatcaaaaactcaaaaacccaaaaagaaaaaaatgtcaggacgtgggaagggaggaaagggactaggcaaaggcggagcaaagcgtcacaggaaagtgctaagagacaacattcaaggaatcacaaaacccgcgataagacggttggcgagacgaggaggagtgaagaggataagcgggttgatttacgaagagaccagaggtgttttgaagatctttttggagaatgttatccgtgatgctgttacgtatactgagcatgctagaaggaagactgttactgctatggatgttgtttatgct

SEQ ID NO: 3343 - DNA, 499 bp, Artemisia annua
tactccgacggggacacacaaacaacaatcaattaatacataaacccccaaattcaaaatcaataaaatgtcaggaagaggaaagggaggaaagggattaggcaaaggaggagcaaagcgtcacaggaaagttctccgtgacaacatccaaggtatcaccaagcctgccatccgtcgtttggctcgtcgtggtggtgtgaagcgtatcagcggtctgatttacgaagagacacgtggcgtcctcaagatatttttggagaatgtcatccgtgatgccgtcacctacaccgagcacgctcgccgtaagacagtgactgcaatggatgtggtttatgcttagaagaggcaaggaaggactctctatggatttgggggttagagttgaaattagggtttggttatggtgtttgttaatctttcagatgtggttatgttttttctgttgaattttagttttcgtgtgtaatttgctaatgtgatttcaaaaccagcctttcta

SEQ ID NO: 3344 - DNA, 322 bp, Actinidia deliciosa
ctccttcaaaccctaacaagcatccctccctccctgtctctctctcgatatgtctggtcgcggcaagggcggcaagggcctgggcaagggcggagcgaatcggcacaggaaggtgctccgggacaacatccagggcatcaccaagccggcgatccgccgcctggctcgccgtggtggagtcaagcgtatcagcggcctcatctacgaggagactcgcggcgtcctcaagatctttctcgagaacgtcattcgcgacgccgttacctacacagagcatgctcggaggaaaacggtgaccgccatggacgtggtctatgctctc

SEQ ID NO: 3345 - DNA, 433 bp, Nuphar advena
  misc_feature (399)..(399): n is a, c, g, or t
tggctgggaggggcgaagcgccaccggaaggttcttagggacaacatccaggggatcacgaagccggcgatccggcggttggcccggcgtggtggggtgaagcgcataagtgggctgatatacgaggagacaaggggcgtcctcaagatcttcctagagaatgtcatccgcgacgccgtcacttacacagagcacgcccgccgaaagaccgtcactgctatggacgtcgtctacgctctcaagcgccagggacgcaccctctacggcttcggaggttgatccacctcacctcccccacatcccttcttcgtttctcccttgctttttttattttcttttagggctttgttttgttttggagttttaggattccttccaacatgtaaatctttctctggnaatgttatgaatcaaaatgacttcttttctttga

SEQ ID NO: 3346 - DNA, 354 bp, Pinus taeda
cggccggggacgatccttcttcattttaccttattgctaaccattgtggttgggagaagagcaggagaaaggaaggatgtctggccgcggaaagggagggaagggtttgggaaagggaggtgccaagaggcacagaaaagtgctgagagataacattcagggtatcaccaaaccagccatcagacgccttgccaggagaggaggcgtcaagcgcatcatcgggctcatctatgaggagaccagaggcgtcttgaagatcttcttggagaatgttattagagatgcagtaacatacacagaacacgccaggagaaagactgtcactgctatggatgttgtctactcactcaagag

SEQ ID NO: 3347 - DNA, 440 bp, Sesamum indicum
ggcggagcgaagcggcacaggaaggtgctgcgggacaacatccagggcattaccaagccggcgattcgccgcctggctcgccgtggtggcgttaagcgcatcagcggcctcatctacgaggagactcgtggtgttttgaagattttcctagagaacgtgattcgtgacgccgtcacctataccgagcacgctcgtcgcaagactgtgaccgcgatggatgtcgtttacgcgctgaagaggcagggtcgaactctgtacggtttcggaggatagggttttctagggctaggattgggggttgtgaaatttgtataaactggcgcgttttgggtgggggaaatggtaacttttagcagttagggatttgtgtggttgtgaagctctgttctgaaacgttagcttgtcatcttaatgaaaggagttcaatcccattgctcctc

SEQ ID NO: 3348 - DNA, 615 bp, Saccharum officinarum
ctcttcccacgagcgcagacacaaccatacacctactacttccaagcaggggaggcgaccggcggcggagatgtcgggcaggggcaagggcggcaaggggctcgggaagggcggcgcgaagcgtcaccggaaggtgctgcgcgacaacatccagggcatcacgaagccggcgatccggaggctggcgaggaggggcggcgtgaagcgcatctccgggctgatctacgaggagacccgcggcgtcacctacacggagcacgcccgccgcaagaccgtcaccgccatggacgtcgtctacgccctcaagcgccagggccgcaccctctacggcttcggcggctaggttaggtcagggtagttacctgtcgaggcgtctcggatcggtgttactagtttggttaccttcctgtgttcgtctggtagttgctgtagtggttgtaactggttgatttgtcatgttgtgtgcgtctgtaagcaccgctggttcgatggaattggaatggatgacgaagtaagaaagttatccagtttgatttgaaacatgctccaatgttgcgttgcctctaatgggatatctcgcaattggttttcaattgtgcagctttgatttggttt

SEQ ID NO: 3349 - DNA, 589 bp, Saccharum officinarum
  misc_feature (515)..(515): n is a, c, g, or t
ctcttcccacgagcgcagacacaaccatacacctactacttccaagcaggggaggcgaccggcggcggagatgtcgggcaggggcaagggcggcaaggggctcgggaagggcggcgcgaagcgtcaccggaaggtgctgcgcgacaacatccagggcatcacgaagccggcgatccggaggctggcgaggaggggcggcgtgaagcgcatctccgggctgatctacgaggagacccgcggcgtcacctacacggagcacgcccgccgcaagaccgtcaccgccatggacgtcgtctacgccctcaagcgccagggccgcaccctctacggcttcggcggctaggttaggtcagggtagttacctgtcgaggcgtctcggatcggtgttactagtttggttaccttcctgtgttcgtctggtagttgctgtagtggttgtaactggttgatttgtcatgttgtgtgcgtctgtaagcaccgctggttcgatggaattggaatggatgacgaagtangaaagttatccagtttgatttgaaacatgctccaatgttgcgttgcctctaatgggatatctcgcaattggttt

SEQ ID NO: 3350 - DNA, 615 bp, Saccharum officinarum
gcctgggcaagggcggcgccaagcgccaccggaaggtgctccgcgataacatccagggcatcacgaagccagcgatccggaggctggcgaggaggggcggcgtgaagcgcatctccgggctgatctacgaggagactcgcggcgtgctcaagatcttcctcgagaacgtcatccgcgacgccgtcacctacacggagcacgcccgccgcaagacccgcaccgtcatggatgtcgtctacgcgctcaagcgccagggcccgaccctctacggtttcggcgggtgagccttggctccgtccgcgtcctttggccatgtggttggggtcaggtgctagctagggttgttgatggattaggggaggttggtacattgtgttggagttgcactgtgcttagtgtttatggttgtaaccggcaatggcaccctataatctgagggatgggggtctaccttttcattatccacactttccaacgctcactcaactttttcttacttcccgataacctcatcttgctcctctttaccattatctcggggggggggggatctctctccctatccctctcctcattcctcctctctatcttcaaccccctcttcttaacatcatc

SEQ ID NO: 3351 - DNA, 722 bp, Saccharum officinarum
  misc_feature (684)..(684): n is a, c, g, or t
cggcgaattcgaatcccacaatttttgtagcacacaccaccgtcactcgagtcttctttcctcttcgggcgcgatgtctgggcgcggcaaggggcggaagggggctggcaaaggccgggcgaaacgccaccggaagggtcttccggaacaccttcaagggaataacaaacccgcgatccggaggctggcgaagaagggcggcgtgaagcgcatctccgggctcatctatgaggagacccgcggcgttctcaagatcttcctcgagaacgtcatccgcgacgccgtcacctacaccgagcacgcgcgccgcaagaccgtcaccgccatggacgtcgtctacgcgctcaagcgccacggccgcaccctctacgggttcggcggctgagcgcgtgcgcgtttccttcgtcctctgcagatgctgtttcgttcgccttacatactcctttcggatacctgttccgtgcttttcttgatgtagacagttattggattcttaagtctctgccgcgtctcgttattaagtggaatcatgtgtccctattacccctgaagttcaccacccacctgtattttcctttgccgccatgaaaagttaaactctgattggccttttctcaccccaccaatctctctcacttattcacccacatctcttttccgtgtctccttacgcttgcctccctnttcctttgctccgcacttcttccgccctatcttggact

SEQ ID NO: 3352 - DNA, 286 bp, Helianthus annuus
tgcccggaggaaagggactgggaaagggaggagcaaaacgacaccgtaaggttctccgggacaacattcagggcatcaccaaacctgcgatccgacggctggcaagacgtgggggagtgaagcgtataagcggtctgatatatgacgagacgcgtggcgttctcaagatctttctagaaaatgtaattcgtgacgccgttacctacactgagcatgctcgtaggaaaactgttaccgctatggatgtggtttatgcgttgaagtgtcatggacgtactctgtatgg

SEQ ID NO: 3353 - DNA, 495 bp, Triticum aestivum
  misc_feature (450)..(450): n is a, c, g, or t
cttcttcctaatcaccctctcgtagcggaccggagcggcgatgtctgggcgcggcaagggcgccaaggggctgggcaagggcggcgccaagcgccaccggaagatcctccgcgacaacatccagggcatcaccaagccggcgatccggaggctggcgaggaggggcggcgtgaagcgcatcgccggcctcgtctacggggagacccgcggcgtcctccatatcttcctcgaggaagtcatccgtgacgtcgtcgcctacacccagcacgcccgccgcaagaccgtcaccgccatggacgtcgtcttcgcgctcaagcgccatggccgaaccctctacggcttcggagtctagattcctgctgtgctgtgctggtgacggtcgtgtttctcttgtgtgatatgtgccgtggtagatgggatttacttcttctggcgtgcgtttgtgttcantatgcgttcaataaaactactctgatcccgaatccaaaaaaaaaa

SEQ ID NO: 3354 - DNA, 1436 bp, Hordeum vulgare
aaggggctgggcaagggcggcgccaagcgccaccggaaggtcctccgcgacaacatccagggcatcaccaagccggccatccggaggctggccaggaggggcggtgtgaagcgcatctccggcctcatctacgaggagacccgcggcgtcctcaagatcttcctcgagaacgtcatccgcgacgccgtcacctacaccgagcacgcccgccgcaagaccgtcaccgccatggacgtcgtctacgcgctcagcaccctctacggcttcggcggctttccccgattccgctggcggcagtagcagtagtacgaatgtatcgggtgtcctctgtggtaggtgggatgtaccactgatttcgcgtgcgttgttgtgttccatgttcagttggctgtaataccttgttgcggtcaatgaaaccagttatgttctgaaaaaaaaaaaaaaaaaactcgagactagttctctctctcgttttgggattttagcctccccgccgccgccgccgcccagcgaattcgacaagctcccgagctcgccggatccgatggccgtcaccttctccgacctccactccgccgacgggctcaaggccctcgaggcgcacctcgccggcaagacctacatctccggcgatgcgatcaccaaggacgacgtcaaggtgttcgcggcagtgcccgtgaagcccagcgcggagttcccaaacgctgcccgctggtacgacgccgttgccgcggctgtttctccgaggttccctggccaggcctctggggtgagtgcatcatcggctcctgctgcagctgctcctgctgcttccaaggatgaagatgatgatgatgacatggatctgttcggcgatgagaccgaggaggacaagaaagcagcagctgagcgtgaggctgccaagcctgcaaagaagaaagaaagtggcaaatcctctgtcctcatggacatcaagccatgggacgatgagactgacatgaagaagttggaggaggctgtccgcggtgttcaaatggagggtctcacctggggtgcatctaagctcatgcctgtgggttatggcatcaagaagctccagatcatgctgacgatcattgatgacctcgtgtctgtcgacactctcattgaggaagtgctctgcgaggcgcccatcaacgagtacgtccagtcgtgtgacatcgttgccttcaacaagatctagaatctttgtccgctcacctgttgctgctggattcttggtactgggattggtctgtctctgtcgtcccatttagttacccctcttacagaaatgctactggttttgtttttgagtcaagccctggtcttgaatgtctgttacctttaaatagttgaattgctgagcagtttgtaatggcgaaacatctatcatggggagtaaactcagtcttttctaactgtgataggattattca

SEQ ID NO: 3355 - DNA, 487 bp, Brassica juncea
gacacaactcttctctaatttcaataacttatcgagcagagagaaaatgtctgggcgtggaaagggaggaaagggattggggaagggaggagccaagaggcacaggaaggttctccgtgacaacatccaggggatcaccaagccggcgattcgtcgtcttgctaggagaggcggcgtgaagcgtatcagcgggttgatctacgaggagactcgcggtgttctcaagatcttcctcgagaatgtgattcgcgacgccgttacttacaccgagcacgctcgtaggaagactgtgacggcgatggatgttgtgtacgcgttgaagaggcagggaaggactttgtacgggttcggcggctgaggcggatttgaaatcgagactaatgtaaatcgtcgcgtctgtttgttttaagacttttaaggtgttgttagggtttcgtttctaatgtttcggtgattttgaattgaatgaaaacgcttttatcttaat

SEQ ID NO: 3356 - DNA, 548 bp, Festuca arundinacea
ggcacgaggcaaaaaatccccatcatcccaaggagcagctagcagccatgtccggccgcggcaagggcggcaaggggctcggcaagggcggcgccaagcgccaccgcaaggtcctccgcgacaacatccagggaatcaccaagccggccatccgcaggctcgcccgccgcggcggcgtcaagcgcatctcgggcctcatctacgaggagacccgcggcgtgctcaagatcttcctcgagaacgtcatccgcgacgccgtcacctacaccgagcacgcccgacgcaagactgtcaccgccatggacgtcgtctacgcgctcaagcgccagggacgcaccctctacggcttcggcggctgagcagagcagtcgtggcgccggatggccgtgccggaagtcttggctcgcggtcaagaaattgtaggagacgagaaactgtggttgatctgtgttcggttcctagttccatgggtagtagtagtagctttgttagcagtagtagatggttgtttgttcagtgtttgctttgatttatgttctcaacttctg

SEQ ID NO: 3357 - DNA, 493 bp, Lotus japonicus
  misc_feature (482)..(483): n is a, c, g, or t
ggtacgggcccccaaatttcgaaatccccaaaattttctcgggaaaatgtctggtcgtggaaagggtggcaagggactcggcaagggaggagccaagaggcacaggaaggtgctgcgcgacaacatccagggcatcacgaagccggcgattcggaggttggcgaggagaggtggcgtgaagaggatcagtgggttgatctatgaggagactaggggtgtgttgaagatcttcttggagaatgtgattcgtgatgcggtgacgtacacggagcatgctaggaggaagactgtgactgctatggatgttgtttatgctctcaagaggcagggaaggactctctatggattcggaggttgaagaatgttgttacttgttgttttgtgatatgtaaatctgaatgaaatggaagcataactgaatctttgtatgcttaattggaaattagtgttttctgatgaatgatagttcaagtttctgttcnnaaaaaaaaaa

SEQ ID NO: 3358 - DNA, 559 bp, Raphanus sativus
ggaaaactacaactgagaatcttctttattttcttaaaggaaaaaaaatgtctggtcgtggaaagggaggaaagggtttgggcaaaggaggagccaagcgtcacaggaaggttctgagagacaacatccagggaatcaccaagcctgctattcggaggttggctcgcaggggtggagtcaagcgtatcagtggtctgatctacgaggagacacgtggagtcctcaagatctttttggagaacgtcatccgtgacgccgtgacctacaccgagcacgccaggaggaagactgtgacggccatggatgtcgtctatgcgttgaagaggcaagggaggacgctttacggatttggcggttgagggtcttttgagattcgcgtttgcgtttctgggtttcttttaggtgttgttctggaaatttctaatcaaatcgtgttatttgcgtttttaattctgtttggttacggtctttgtgtgttgcggtagcgtttcgttacatgtaatgtaattacgcattttatctatgaagctgttcgagtttatgaatctggactttcttt

SEQ ID NO: 3359 - DNA, 371 bp, Rosa hybrid cultivar
ttccatcaaattcagagttcctctccttcaaattttccggtgaaaatgtcaggccgcggtaagggaggcaaggggttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgtcacctacactgagcacgcccggaggaagaccgtcaccgccatggatgtcgtctatgctctcaagaggcagggaaggaccctttatggatttgggggttaaatggttgggtatta

SEQ ID NO: 3360 - DNA, 531 bp, Secale cereale
ccacgcgtccgcaacaaaccaagctcgtcggagagagaatcgaagatgtccggccgcggcaagggagggaagggcctcggcaagggcggcgccaagcgccaccggaaggtgctccgcgacaacatccagggcatcaccaagccggccatccggcgtctggcgaggcgtggcggcgtgaagcgcatctcggggctcatctacgaggagacccgcggcgtgctcaagatcttccttgagaacgtgatccgcgacgccgtcacctacaccgagcacgcccgccgcaagactgtcaccgccatggacgtcgtctacgccctcaagcgccagggacgcacgctctacggattcggcggctaggccacgcgaaccgactcccccaccaccagattggtaccggtagctagctatggttgtgtagtgttcacgggatttggtgtaatggccgcatctcgctgctgtgtgtcctgtccatggttgttgtttggatgtagttctgggatggaattgacattgacgtggtttacccttgaa

SEQ ID NO: 3361 - DNA, 585 bp, Helianthus annuus
tttcaaattaaatctcaatttcaatttcatttcatttcaacaacaatgtcaggccgtggtaagggaggcaagggattgggaaagggaggagcaaaacgacaccgtaaggttcttcgtgacaacatccaggggatcaccaagccagctatccgcagattggctcgcagaggaggtgtgaagcgtatcagcggtttgatctatgaggagacacgtggcgttctgaagatctttttggaaaatgttatcagagatgctgtcacctacactgagcacgctcgcaggaagactgtgaccgccatggatgtggtgtatgcgctcaagagacagggccgtaccctgtacggtttcggcggttagggtttagggtgttgattgtagatctgttggatttgtgttttgttttagtgttggtgttgttgttctccatctcggagtcattgtttcgtgttaagaattgttctaatggaattaaaatgtgttgggtttcgaaaaaaaacacacaaaattaaaataaatttgccccctttttttcggttccatcttttacatctatttcaacttccacactttccttgtcttcgcccc

SEQ ID NO: 3362 - DNA, 516 bp, Triticum aestivum
caaagacaagtcaacctcaccgaggagaagcagagagaagggagaagatgtcggggcgcggcaagggaggcaaggggctcggcaagggcggcgccaagcgccatcggaaggtgctccgggacaacatccagggcatcaccaagccggcgattcgacgtctggcacgtcggggcggcgtgaagcgcatctcggggctcatctacgaggagacccgcggcgtgctcaagatcttcctcgagaacgtcatccgcgacgccgtcacctacaccgagcacgcccgccgcaagactgtcactgccatggacgtcgtctacgcactcaagcgccagggacgcaccctctatggattcggaggctaggctccggcgaggcgaatccagctcgcacctgctgatcagatattcagattagcagtagctaggcgttgttcagtgttcatggtgatcgatgtaatttatgatgtatggtgcctgttcgttggaatggataaatcgctgttatttacccttaaaaaaa

SEQ ID NO: 3363 - DNA, 568 bp, Triticum aestivum
caaaacaatccaatccaatcccccaagagagagaagaggaggaagatgtcgggccgcggcaagggaggcaaggggctcggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccgagggcccagccgtccagctcgccacgccgccgtccgaccgagagtagtagtggtatctatctagttgctgtctagggttcgtggctctccgtgtatgcgcagtgtttcgctggtgtgtgtctgctcccgtcttgtgagctggtgttgtactggaagaaatctggaatggaaattgcagtagcttatccacctcgggcgcggacacgc

SEQ ID NO: 3364 - DNA, 735 bp, Triticum aestivum
  misc_feature (717)..(717): n is a, c, g, or t
  misc_feature (719)..(719): n is a, c, g, or t
gcgtccctccgattccacatccgctcgcagctcgagatcgtcagccatgtccgggcgcggcaagggaggcaaggggctcggcaagggcggcgccaagcgccaccggaaggtactgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggccgccaccagatcagtagctagactgtcgttgtttggtagtaccagcagtgctcgtggtcctcttgtgtaatggcagcatctcgctgctgttaacccttgttgtctggatgtactactaggatggaatggaaattgtagcagtttgcccttgaattcgttacctattctttcggcctgttgatgtttgttcgtgcgcgggtcagatattgccagtgcgttcttcagttgtcttgctctgtaaatttcggcccccaaatccgtttgtgctggcttcggtgtttggatcctattttgtgttgcctccagtgtgtggtggattcaaaccaaatcccactgtgtttggcttctgtgtttggngnatagaaatcaaatcct

SEQ ID NO: 3365 - DNA, 724 bp, Triticum aestivum
  misc_feature (681)..(681): n is a, c, g, or t
cgccgtctccacccaattgcatctgctcggcgctccaagccaccatcatgtccggccgcggcaagggcgggaagggtctgggcaagggcggcgccaagcgccaccggaaggtgctgcgggacaacatccagggcatcacgaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggccgcaccctctacggcttcggcggctgatctgctgctgctgctccgtccagtctctgccagctgctgttccatcggtctgtgtggtagtggacgccatgaatatgaatgcaatgaaatcagagtcggcattagttatcttggacgcatctctcgatatgtttctgtaagcttgttaaattcttcccagcaagaaagattaggagataatctactagctgaggtaaatatcggaaattcatgaatcaatctctaagcaaacattacagtagactgctatgggtgtgtcgtgtgaatgatatttgggcttacagaaagatcttcactgtttttgtcagacattgttgcattncttcaggaagacaggaagaacctgcgtgcctcattgtttgctg

SEQ ID NO: 3366 - DNA, 523 bp, Triticum aestivum
atccacacgagtccttcttctctcaaacaaaaacaaatccagacacgatgtctgggcgcggcaagggcggcaaggggctgggaaagggcggcgccaagcgccaccggaaggtcctccgcgacaacatccagggcatcaccaagccggcgatccggaggctggccaggaggggcggcgtgaagcgcatctccggcctcatctacgaggagacccgcggcgtcctcaagatcttcctcgagaacgtcatacgcgacgccgtcacctacaccgagcacgcccgccgcaagaccgtcaccgccatggacgtcgtctacgcgctcaagcgccagggccgcaccctctacggcttcggaggctagatctgcagtggagcaacttcctcgtttgctctgtgtgatatgtgctgtgctggatggatttaccgatctggtgtgcgtcgttgtattctgtctttgggttgagtaggctgtgtaataccttgttctgttcaatgcaatcagttcgattctgaatcctgacaaaa

SEQ ID NO: 3367 - DNA, 509 bp, Triticum aestivum
tcgacctccatccgctcgcagctcgaaccaaggagagaccgtcagccatgtccgggcgcggcaagggaggcaagggactcggcaagggcggcgccaagcgccaccggaaggtgctgcgcgacaacatccagggcatcaccaagccggccatccgccgcctggctcgccgtggaggcgtgaagcgcatctcggggctcatctacgaggagacccgcggcgtgctcaagatcttcctcgagaacgtcatccgcgacgccgtcacctacaccgagcacgcccgccgcaagaccgtcaccgcaatggacgtcgtctacgccctcaagcgccagggacgcaccctctacggcttcggcggctaggctcttcctcgcccccctgcagatcccaaaagcttggtagaacagcgacttgtgtagttctctatttgccctgtagttcgaactgagtcgtggaacaaagttattcgcacgtgttgctggaaatggaacttgtcccagtgaaaaaaaaaa

SEQ ID NO: 3368 - DNA, 559 bp, Persea americana
  misc_feature (34)..(34): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (77)..(77): n is a, c, g, or t
cgtgtgggcttcaattcaatccaatccacagagngngngngagatgtcgggccgtggaaagggaggcaaggggctgngcaagggcggtgcgaagaggcaccgaaaggtgctgcgagacaacatccagggcatcacgaagccggccatcaggaggcttgcgcgcagaggcggcgtgaagcgcatcagcggcctcatctacgaggagactcgtggcgtgctgaagatctttctggagaatgtcatcagagatgccgtgacttatactgagcacgcgaggaggaagacggtcactgccatggatgttgtctatgcgctcaagaggcaggggaggactctctatggctttggtggttaggaaatctctattgctattgctgtactagttatgtagtcagatccgatctttggggttctagttcatgtgactttctgtgcttttgcttgtaaatttctgattgtgatggcaacataggcttgttgctgtgtattcagtaatatgctaaaatcttgattttctgtaggtgttaaatccatgtagtaattgatgaaagtatctcca

SEQ ID NO: 3369 - DNA, 477 bp, Lactuca sativa
  misc_feature (172)..(172): n is a, c, g, or t
cttcaatcctttcagagtgaaaaagcaaaaaccagagaaaaaatgtcaggaagaggaaagggaggcaagggattgggaaagggcggagcaaagcgtcaccggaaagttctccgagacaacatccaaggtatcacgaagccggcgattcgacgattggcgaggagaggtgganttaagcgtatcagtgggcttatctatgaagaaacacgtggtgtgcttaagatctttctagagaatgtcatccgtgacgccgtgacttacaccgagcacgctcgccggaaaactgtcaccgccatggatgtggtttatgctttgaaacgacagggacgtactctttatggatttggaggttaaggtcgtagtgataggtgatttcattgcaatttcagtttccagatctacattgtttgttaacatggtaatagtgataggttatgtatcattgacttatttctcgtaatgcaatgaacgatttat

SEQ ID NO: 3370 - DNA, 552 bp, Fragaria vesca
  misc_feature (27)..(27): n is a, c, g, or t
  misc_feature (45)..(45): n is a, c, g, or t
  misc_feature (55)..(55): n is a, c, g, or t
  misc_feature (64)..(64): n is a, c, g, or t
  misc_feature (489)..(489): n is a, c, g, or t
atcagagtttatctcttctcaaaattntccggcgaaaatgtcagnacgcggcaanggaggcaanggattgggcaaaggaggagccaagcgtcacaggaaggttctccgggacaacatccagggcatcaccaagcccgccattcgccgtttggctcgcagaggcggtgtcaagcgtatctctggtctcatctatgaagagaccagaggtgtcctcaagatctttctagagaacgtcatccgtgacgccgtcacttatactgagcacgctcgcaggaagaccgtcaccgccatggacgtcgtctatgctttgaagagacagggaaggaccctctatggatttgggggttaattcagattacggcttgtttaggatttggggtttagatctgggtgtcatgaaattgtaatacaagtttgatttctcagtaaatttggctgtttcttctttttcttactatgtggtttggttttttttttttgatggcttcnttagattgaaactagaatactagcattataacaaattccagaaccaagtgattagcagcgtgc

SEQ ID NO: 3371 - DNA, 700 bp, Allium cepa
  misc_feature (7)..(7): n is a, c, g, or t
  misc_feature (45)..(45): n is a, c, g, or t
  misc_feature (69)..(69): n is a, c, g, or t
  misc_feature (113)..(113): n is a, c, g, or t
  misc_feature (138)..(138): n is a, c, g, or t
  misc_feature (146)..(146): n is a, c, g, or t
  misc_feature (187)..(187): n is a, c, g, or t
  misc_feature (217)..(217): n is a, c, g, or t
  misc_feature (239)..(239): n is a, c, g, or t
  misc_feature (264)..(264): n is a, c, g, or t
  misc_feature (333)..(333): n is a, c, g, or t
ttataanccccccccccggcctttcgggaaaaaaatttttaaaanccccccttttcaacctttaaaaangggggggggaaaacccaaaaaaaaaggccttgggggaaaggccnttcccccaccccccggccgggggtngggggccngggggccccggcctttcctttaaggaaaaaccttaagggtnggggggaatttccccccccccccggggggnccttgggccaagggggaaaaanttttccggggcccaacccggaaaanggggccggccggttttccaaccaaaaaaatccccccttaaaaatcccccccccaaaaaatccggaatantcttaaccccggaatttcaatttcaccaaatggttcaagggaaagaagggaaaaggggggtgggaaaaagggtcttcgggcaaaagggggggaagccaaagccgccaccgcaagggttctacgcgacaacatccaggggatcacgaagcccgccatccgccgtcttgccagaagagggggcgtgaagaggatcagtggtttgatttacgaagaaaccaggggtgttcttaaaatctttctagagaatgttatacgcgatgcggtcacttacactgagcacgccaggaggaagaccgtcactgccatggatgtcgtttatgctttgaagaggcagggaagaaccttatatggattcggaggttaaaaa

SEQ ID NO: 3372 - DNA, 517 bp, Triticum aestivum
  misc_feature (368)..(368): n is a, c, g, or t
  misc_feature (387)..(387): n is a, c, g, or t
  misc_feature (507)..(507): n is a, c, g, or t
agcgtggtcgcggccgagatgttagactgcttccatctcatctccggcgatgtctgggcgtggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgtcgcaagaccgtcaccgccatggacgtcgtccccagcgccccagcgactcaagttgggtgagcccaccccgtccccctttccgggntctaattgcccccggttantggcatctatcccctgtctgcaattatgcctggttacctgtgtctgcttgtctgtgatacccattgattccactctattttactctatcgttgctttcgtgcatgcatatcattactgcngcacatcatc

SEQ ID NO: 3373 - DNA, 397 bp, Persea americana
agctcgagtctttttcagatctcatcgatcaatttcaaatctctgcaccatgtctggccgaggaaagggaggcaagggtttgggaaagggaggagcgaagcgccaccggaaagtgctccgagacaatattcaaggcatcacgaagccggcgatccggcggctggcgaggagaggaggcgtgaagaggatcagcggcctcatctacgaggagacgaggggagtcctcaagatctttctggagaatgttattcgcgatgcggtcacctacacggagcacgctcggcggaagacggtgacggccatggatgtggtgtatgctctcaagaggcaggggaggaccctctatggatttgggggttagggttttggcattttcctctctttggaaagtcttgct

SEQ ID NO: 3374 - DNA, 569 bp, Brassica rapa
ggaccatcagaaatttactctattgctttccttaaacacttgcgaggagatgtcaggaagagggaaaggaggaaaaggattgggaaagggaggagccaagaggcacaggaaggtgcttagggataacatccaaggtatcaccaagcctgctattcgtcgtcttgctcgtcgaggtggtgttaagcgtataagcggtttgatctacgaagagaccagaggagtcctcaagatcttcctcgagaatgtcattcgtgacgctgttacctacaccgagcacgccaggaggaagactgttactgctatggatgttgtttatgctttgaagaggcaaggacgcactctctacggtttcggcggttaaattgagggagattggattagggattccaaagtttggggatctgaatttgggaatttttattttttttcgtttctgattagccgaagtaaatcgtacgactgttgtatcattttctaatgcgttgttagccaatattatgttaaattaatcttaatcaaaagttgtgctgtgatattcctccatcttcaaataaattttatgttatgaa

SEQ ID NO: 3375 - DNA, 648 bp, Vitis vinifera
acgtctgggatttcctttctgaaaccctagaaaattcaaaagcagtgaaaatgtcgggtcgtggaaagggaggaaaggggttgggcaaaggaggagctaagaggcacaggaaggtgctccgggataacattcagggtatcaccaagcctgctattcgtcgtttggcgaggagaggaggcgtgaagaggatcagcggtctcatttatgaggagaccagaggcgttctcaagattttcctcgagaacgtgattcgcgatgctgtgacctacactgagcacgccagaaggaagactgtgaccgctatggatgttgtttatgccctcaagaggcagggaaggactctctacggtttcggtggttgatttcttggttctattggttggtgttttagggtttggggcggtagatgtaggcagttgtaaagagtgggttcaaatttagggctaatgatgttgttggttttagtgttagtttactgatttctgtttgattttccttgaaattgtgatgcaaagatcgccattttcgattagaatttcttttgtgttccttccaatttaatttcgttctgtatatttttaattacattcgatctttcggttggttgatgagcttaacaaatagattataagattttgggaattatga

SEQ ID NO: 3376 - DNA, 645 bp, Lactuca sativa
  misc_feature (531)..(531): n is a, c, g, or t
cttcggcgggggcagcaaaatcaaatcaagagaaaacttcagtagaggaaatgtcaggaagaggaaaaggaggcaagggactgggaaagggaggagcaaaacggcatcgtaaggttctccgagataatatccaaggcatcacgaagcccgcgatccggcgtctggccaggagaggaggtgttaagcgtatcagtggtttaatctacgaggagacgcgtggagttttgaagatctttcttgagaacgtcatccgtgacgccgtcacatacaccgaacatgctcgccggaaaactgttaccgccatggatgtcgtttatgctttgaagcgccagggtcgtactctctatgggtttggtggttaaatggaatttttgggtttagggttctgatatgaactgataatttatgtaactaaacctcttagtataatatcagttaatgagcacttcgttttctcgaatgatttatgtttatgcaatacaggacatttagtttgttttctttcattaagtttgacgttttaatagtgangttatttagcgactgtgatacttttagagttgtaggtgttatatgcaaagcttgtttgaagctttacaagtaattaatcaacaaaaaccataaatattttgagattagtgattt

SEQ ID NO: 3377 - DNA, 492 bp, Lactuca sativa
ctccgattccacaacaaagaaaatcaaatccatttccgaagagaaaaattatgtcaggaagaggaaaaggaggtaagggattaggaaagggaggagccaagcgtcatcggaaggttctccgggacaacattcaaggcatcaccaagccggcgatccgccgtctggccaggcgaggtggtgttaagcgtatcagcgggttaatctacgaggaaacacgtggagttttgaagatctttcttgagaacgtcatccgtgacgccgtcacgtacaccgaacatgctcgccggaaaactgttactgccatggacgtcgtttacgctttgaagcgccagggccgcactctctacggatttggtgggtagatgaaccatatgctttttagggttcttgtttgacagccaggttttcattggatttttgtttagttagtttctctaaatctgaagtgatgttacgtgtaattgaatctattaatacaatatcgcttaattt

SEQ ID NO: 3378 - DNA, 537 bp, Lotus japonicus
  misc_feature (526)..(526): n is a, c, g, or t
caaaaccctaattttaactttctcggaaaatttcaattttctcgggaaaatgtctggtcgtggaaagggcggaaagggactcggcaagggcggcgccaagaggcacaggaaggtgctccgcgacaacatccagggcatcacgaagccggcgattcggaggctggcgaggagaggcggtgtcaagaggatcagcggtttgatctatgaggagactaggggagtgctgaagattttcttggagaacgtgattcgtgatgcggtgacttacacggagcatgctaggaggaagacggtgactgctatggatgtggtttatgctctcaagaggcagggaagaaccctctatggatttggaggttgaagactattggttttacttttttggagaagaatatgcatatgcatttctctatttgcttgttcatgggttgtgtgattttgtgaaatgtaaagctgaatgtgattgaagcataacccaattgtagggttaattggaaattagggttttctagtgaattataaatcnagtttctgttt

SEQ ID NO: 3379 - DNA, 577 bp, Secale cereale
accccgctccaaaatccccaaatcccatctcttccgaagctgctcagccatgtcggggcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctctgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggcggctgaagagccgcggcgctggctggccggccggccgtggcgcaccagccctggctcgcggccaagaaggtggaggagaggagaaagctgtagtttatctgggttccatgccttctatgattactagtaatatctgtagtagtagtacatggttgttcaatgggtgcttcagtgttctgaatttctgatgggcaaacactgtgtttgccgagttatatgaat

SEQ ID NO: 3380 - DNA, 606 bp, Euphorbia esula
  misc_feature (6)..(7): n is a, c, g, or t
  misc_feature (9)..(9): n is a, c, g, or t
gcgatnnanaaaaaaaaaaaaaaaagaaagaggaagaagaaaacaaaaatgtcaggaagaggaaagggaggaaaaggattgggcaaaggaggggccaagaggcacaggaaggttttgagagacaatattcaagggattactaagcctgccattagaaggctggctcgcagaggaggtgtgaagcgtattagcggtctgatatatgaagagaccagaggagtcctcaagatctttcttgagaatgtgatccgtgatgctgtgacctacactgagcatgccaggaggaagactgtcactgccatggatgttgtctatgctctcaagagacagggacgtactctctatggatttggtggttgatttaatttcgtttatgtgtttaggtttaattagcgaatcctccatcttaattgtgtaattttcttcatgtaattcagatctatgtggtagaaaaagtagccggaatgatttcaattctctcgttcaatctgtgtttgaacggaagatttgagcattgtatctaggttttttttttaatattgtgataatcaatttgtcattttcgatatggtttattgttcaatactacaatcttcagatttgagc

SEQ ID NO: 3381 - DNA, 462 bp, Helianthus annuus
caaacaaaatccagttatcttttgttgagtcgaaaacctaatttgagaatgtctggacgcggaaagggaggaaaggggctgggaaaggggggagcaaagcgtcaccggaaagttctccgggataacattcagggaataactaaaccggcgattcgaaggctggctagaagaggtggagtgaagaggataagcggtctgatatatgaagagacacgtggagttttgaagatatttttggagaatgtgattcgtgacgctgttacgtatacggagcatgcgaggaggaagacggtgacggcgatggatgttgtttatgcgttgaagaggcagggaagaactttgtatgggtttggtggttgaattgtttgtttgtttgtttgttctggaacaattttgatagtagatgtgtaaaccatgaaaattgttcacaggtttagtttattaattgacatcttctaagct

SEQ ID NO: 3382 - DNA, 421 bp, Triphysaria pusilla
  misc_feature (34)..(34): n is a, c, g, or t
tcaattctcactctgccgattgcatttttttaanttcaatcagctaaaaatgtcgggccgtggcaagggaggcaagggcttggggaagggtggagcaaaacgacatcgtaaggtgctgagggacaacatccaggggatcacaaagcccgctattcgccgtttggcccgcagaggtggcgtcaagcgtatcagtgggctcatctatgaggagactcgtggtgttttgaagatctttttggagaatgtcattcgcgacgctgttacctacactgaacacgctcgccggaaaactgtcactgccatggatgttgtttatgcattgaagaggcaaggccgcactctctacgggttcggtggttaggatctagggtttggtgctatttgtataaattgaatgcttatgaaatcggatcttatggta

SEQ ID NO: 3383 - DNA, 691 bp, Triticum aestivum
  misc_feature (665)..(665): n is a, c, g, or t
  misc_feature (688)..(688): n is a, c, g, or t
ccaccgttcccccgattccacatccgctcgcagctcgagatcgtcagccatgtccggccgcggcaagggaggcaaggggctcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcacggccatggacgtcgtctacgcgctcaagcgccagggccgcaccctctacggcttcggcggctagggccgtccgacggtcgtcggtctttgtcgccgcctgcagattccaaaagcttgatggaaccccgacttgtttagctcgctgtttactctggctctgtagttcgaactgaatcgtggaacaaagttattcgcatgtgtttgttggaaatgaaatttgtctctgtcagcatgtcgtaaatctgtttttgttcgctggtttgtcttctgcatctctgttgggcatgattgttgtttcctttgtgatgcttgagtcggccataatttactaggagccccgggtgaattgaacttgtttgcaggctaanttgtaatgtgatggaaaaaagcnaaa

SEQ ID NO: 3384 - DNA, 593 bp, Triticum aestivum
tcctcgacccccatcctctcgcggctcgaaccaagaagagatcttcagccatgtcggggcgcggcaagggaggcaaggggctcggcaagggcggcgccaagcgccacaggaaggtgctgcgcgacaacatccagggcatcaccaagcccgccatccggcgcctggcgaggaggggcggcgtgaagcgcatctccggcctcatctacgaggagacccgcggcgtgctcaagatcttcctcgagaacgtcatccgcgacgccgtcacctacaccgagcacgcccgccgcaagactgtcaccgccatggacgtcgtctacgccctcaagcgccagggtcgcaccctctacggcttcggcggctaggctcttccttgcccccttgcagatcccaaaagtttgatgataccgcgacttgtgtagttctctacttcctctgtagttcgctatttcctctgtatttcgaactgaatcgtggagcaaacctattcgcagtttgttagaattcaaacttgtctaagtgagataccgtgcctctgattttgtcctgctgcatctctgttaatgtgaaattgttctgtcttctgtgatgcaaaa

SEQ ID NO: 3385 - DNA, 589 bp, Triticum aestivum
cacaaagacaggtcgacctcaccgaggagaagaaaggagaagcgagaaagatgtcggggcgcggcaagggaggcaaggggctcggcaagggcggcgccaagcgccaccggaaggtcctccgcgacaacatccagggcatcaccaagccggcgatccgtcgtctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccaccatcaccgccagattagagtgtctagggttcgtggtcgttgatgtaatcgcagtatctcgctgctgtttgctatcttctgtagaatggaattgaatggaaatcgaactagtttatcgttgaaatctgttagcgtctgtcagttccccaatctctgtctctcaaattttctgtctcaaatcggttgttggttttggtgcgctgaatttgaaccttccctaaaa

SEQ ID NO: 3386 - DNA, 522 bp, Triticum aestivum
  misc_feature (463)..(463): n is a, c, g, or t
cgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaagtcgcccctctcccggtggcgaatacgtggtggcggtggcggtcgtgttgtgttcctggtcaattatctgtgttgtcttatcggtgctgtttctgtggtggntgtactgcatcgtcaatttctagtcattgctgtatatccgctgctgtataatggattct

SEQ ID NO: 3387 - DNA, 541 bp, Cenchrus ciliaris
cttgactcccacctctactcccatccactcctccgaagaatccacctccgtcggcgagcatgtctgggcgcggcaggggcggctagggtctcggaaagggcggcgcgaagcgcctccggaaggtgctccgcgacaacttccatggcatcacaaagccggcgatgcggcggctggcgaggagggggggcgtgaagcgcatctcctggctcatctactaggagacccgcggcgtgctcatgatcttcctcgagaacgtcatccacgacgccctcacctacaccgagcacgcccgccgcaagaccgtctccgccatggatgtcgtctactcgctcaagcgcgagggccgcactcctctacggcttcggcggctaggctgatgcgctcgtccccttcgctgtctccctcctgcgtctccggcgatgtcgggtcgggctcacaagtcttgcggtcaagaaagtttcacactcgcttgtttagctcagctctggctgtattatgtttatctcgtgatacagtaatgaaatgatctgattggaaatcg

SEQ ID NO: 3388 - DNA, 570 bp, Zea mays
gatcaaatcctcatccaccagttctcctttttataattcaattcacttcgtcgaaactctcgacaatgtctggccccggggagggccggaagggtctggccaagggcggcgcctagcgccaccccaaggtgctgcctgacaacatccagggcatcaccaaggccggccatccgcaggttggcgaggaggggcggcgtaagcgcatctcctggctcatctacgaggagacccgcggcgtgctcaagatcttcctcgataacgtcatccgcgacgccttcacctacaccgagcacgcccgccgcaagactgtgaccgccatggacgttgtctttttctcaagcgccagggccgcaccctctacggtttctgcggttaggtcgcctctctctctgtggcgaatatctcgctgccgttggcgggcgtgttgtgttcttgctctacttagtcttccttgtcttgatcggagttgttgcttgtgggggttgtaccccctaaatactattttctagtccatgttcctctaaaatgtcgcttcttctattcaaggcaatttcccccctttcaaccttc

SEQ ID NO: 3389 - DNA, 604 bp, Saccharum officinarum
  misc_feature (48)..(48): n is a, c, g, or t
  misc_feature (517)..(517): n is a, c, g, or t
aatccccaattcccaacctcacctccgagttcgagcggccatgtcggngcgcggcaagggcggcaaggggctgggcaagggcggcgcgaagcgccaccgcaaggtcctccgcgacaacatccaaggcatcacgaaacccggcgatcccgaaggctgccaagaagggccgccgtaaaccgcatttcggggcttatctacaagaaaacccgcgcggtgttcaaaatcttcttcaagaacgttatccgcgacgccgtcacctacacggagcacgcccgccgaaggaccgtcaccgccatggacgtggtttacgcgctaaagcgcaagggccgaaccttctacggattcggcggttgaggggtgcccccgccgttggtggccgtgccaaaagtcttgggtcgcggacaaaatatagagggaggcgagggtattctgccccatatgcttattttcagactattagcggtggtgattattgacacgtgtggggtcgagcaatctatagccatgggtgcagagnaatatattcttggtgtctgaacatcccaggtatgaaaaggggattcactttttatacccccggccaacagctgaattctcttttttt

SEQ ID NO: 3390 - DNA, 323 bp, Triticum aestivum
tatttgcaattacgcacaccacttcaacttcaaaacaaattcaacatgtctggacgtggaaaaggaggtaaaggtttgggaaaaggtggagccaagcgtcacagaaaggttttgcgtgataacatccagggtatcaccaagccagctatccgtcgtctagcacgccgtggtggtgtcaagcgtatctcaggtctgatctacgaagagacccgtggtgttctcaaggttttccttgaaaacgttattcgtgatgccgtcacctacaccgaacacgccaagaggaagacagttaccgccatggaccttgtctacgctctcaagag

SEQ ID NO: 3391 - DNA, 470 bp, Brassica napus
aggagcgaagaggcacaggaaagttctcagagacaacatccaagggatcacgaaacctgcgattaggcgactcgctcgcagaggaggcgtgaagcggatcagcggcttgatctacgaagagacgagaggagttttgaagatctttctcgagaatgtgatcagagacgccgtgacttacactgagcacgcgaggaggaagacggttacggcgatggatgttgtttacgctctgaagaggcaaggtcgcactctctacggattcggtggttaaaatcggttattttcggtttggtttatgggtggtgctgttgctgctgattaagtcggttctttcggtttacttttttgttggttcgtttcttggtttgtgattagcgtttgggtaattgcaatattgtattaaatttatcttttggtataatgaaagttcgattaataaaaaaaaaaaaaaaaaaagaccgcctcggcct

SEQ ID NO: 3392 - DNA, 521 bp, Gerbera hybrid cultivar
aggagcgaaacgacaccgtaaggttctccgggacaacatccagggaatcacgaagccggcgatccgtcgtctggctcgtagaggcggtgtgaagcgtataagtggtttgatctacgaggagactcgcggtgttttgaagatctttctagagaacgtgatcagagacgccgtgacgtacacggagcatgctcgccggaaaactgttaccgccatggatgtggtttatgcgttgaagaggcaggggcgtacgctgtatgggttcggtggttagggtttgtgagttttgtgaaagtcttgctatcaagaaagggaagaaaatggttaggggttcttatttcgggtcgggttgagattcgggtttttagggcttgttcaatttgtactgtttgtgatgtaattagtgtgagttggttgctttacggtaatttgtttttgtgatgtgattgggtattaagtttttgttgacttgggacgtttttttaattggatttgactccgttggtaaaaaaaaaaaaaaaaaa

SEQ ID NO: 3393 - DNA, 940 bp, Hordeum vulgare
caaggcagcggacctctacattcataattccacaaacgcggtctttttgacaactatcgcatgccatggcgaagtccttcacattccccctcaagaggacactcttcttcttaggcatagaaaagaacctcttattgaaagtccacaccgggtgtgctctaattctcctaaaagaccgagtcaatttgtttctcctcatagtcaacttgcatttatctgccactctgggagcgaatccatccgatttgaacgaaccgttcccctctagattcgggataatcccgcctgtgctctaacttctcacgccagccaggtacttcagattccacatccgctcgttcgctcgcttccagctctagatcgtcagccatgtccgggcccggcgaggtaggcaaggggctcggcaagggcggcgccaagcgccaccggaaggtcatgcgcgacaacattcagggcatcatcaagccggcgatccgtcggctgactcgccgtggcggcgtgaagcgcatctcggggctcatctacgaggagacccgcggcgtgctcaagatcttcctcgagaccgtcatccagggcaccgtcacctacactaagcacgcccgctgcaagaccgtcgccgccatggacgtcgtctacgcgctcaagcgccagggccgcaccctctacggattcgccggctaggccaccggaccaccagctagctttgtttggcgcaccacggtagtagtgttcgtggccggtccttgggtgtaatcgccgcatctcgctgctgtcagccctggccatgtttagtttgtcgtctggatgtgctaggatggaatggtaactgcagcggtttgtttacccttgaattcttgtgtgatccgtgtggcctgatgctcgtaattaaatcacgcagccggcggtatccggtagatctatacccactgcccgccgagta

SEQ ID NO: 3394 - DNA, 315 bp, Hordeum vulgare
ctgaacaccaaccaaccaaatcccccaccggcatcagctcgccagccatgtcgggccgcggcaaggggggcaaggggctgggcaagggcggcgccaagcgccaccggaaggtgctgcgcgacaacatccagggcatcaccaagccggctatccggcggctggcgcgcaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacg

SEQ ID NO: 3395 - DNA, 483 bp, Gossypium hirsutum
aaaattcccagttttctgtgaaaaaagagtctcttcgattcttcaaaatgtcgggccgtggaaaaggaggcaagggattgggaaagggaggcgctaagaggcatcgtaaggttctccgagataacattcagggcatcaccaagccggcgattcggagattagctcgtagaggcggcgtgaagaggattagtggtttgatctacgaggaaactcgtggggttctcaagatcttccttgaaaacgttatacgcgatgccgtcacctatacggagcacgctaggcgtaagactgttaccgctatcgatgtcgtttatgctctcaagagacaaggaaggactctttacggtttcggcggttgattttggattttagggtttcttttttgtgtaaattttttttgtaacagtttcttgtaggctttttttcttggattttctctttagtttaatgtatttttgtttcgaatttcgatgaatttctctg

SEQ ID NO: 3396 - DNA, 569 bp, Festuca arundinacea
ggcgccaagcgccaccgcaaggtcctccgcgacaacatccagggcatcaccaagccggccatccggcgcctcgcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctttacggcttcggcggctgagcagaggagttgcggcgctggatggccgtggcacaagtcttggctcgcggtcaagatattggaggggaggaggaagctgtagtagttgatctgtgttcggttcctagttctgtgggtagcagtagtagtagcttcgtcagcagtagtagatggtcgtctgttcagtgttcgcgtcgattgatgtttcaacttgtgatgggcaaatatggtgtttgccgagttctaccatttcagtattaccaaagttatccttcagctatgaattaggctattgatgcccttctcactgttgtgtttta

SEQ ID NO: 3397 - DNA, 525 bp, Solanum tuberosum
attcagaaccctagaaacttcttcttcttcaaatttctccgtgaaaatgtctggtcgtggaaagggaggcaagggattgggaaagggaggagccaagaggcacagaaaggtgctaagagacaacatccagggcatcactaagccagctattcgcaggcttgctcgtaggggtggtgtgaagcgtatctctggtctgatctatgaggagacccgtggagtgttgaagatctttttggagaatgtgattcgtgattccgtcacctacactgagcacgccaggaggaagactgttactgctatggatgttgtctatgctttgaagagacagggaaggactctctatggatttggtggttagatcagttgttaggtgcattagatgtagatctactgttaatttctgctgtttctgtgttttggtatctctgtaactgttcgtaagctctagatattgtaatttctcattacatattcaatgaacaaagctcagtttctaccaaaattacgcagccgcgggatccacta

SEQ ID NO: 3398 - DNA, 626 bp, Picea glauca
aagggaggtgccaagaggcacaggaaggtgctcagagataacattcagggcatcaccaaacctgccatcaggcgtctcgccaggagaggaggtgtcaagcgcatcagtgggctcatctatgaagagaccagaggtgtcctcaagatcttcttggagaatgtcatcagagatgccgtgacgtatacagagcacgccaggagaaggactgtgacggccatggatgtcgtctactccttgaaaaggcagggccgaactctctacggcttcgggggttgagaagtcttgctccgactgttattcatttattactcagtctcatttatggtgtttctagacaccaccttcgcatctatgggaaatttaaaacctggcaagtactgtaaaatgttgaatgcgttgctttagttgaagcttgtagggatttattcagtgtgtcagtagaggagctgtccatatgctaactaaattgccctatttccaactgccttggccatggtttggtgaacagcaaatactttaatctgatcagtctactgtttacattgtacaagtatgatgatctcgattgtgcaattatgataatctggatcacttaaaaagtcagattctgcaattatgataaaaaa

SEQ ID NO: 3399 - DNA, 495 bp, Solanum lycopersicum
ttcaaaaccctagaaacttcatcctcttcaaatttctctgtgaaaatgtctggtcgtggaaagggaggaaagggattgggaaagggaggagccaagaggcacaggaaggttctaagagacaatatccagggtatcactaagccagctattcgcaggcttgctcgtaggggtggtgtgaagcgtatctctggtctaatctatgaggagacccgtggagtgttgaagatctttttggagaatgtgattcgtgattctgtaacctacactgagcacgccaggaggaagactgttactgctatggatgttgtctatgccctcaagagacagggaaggacactctatgggtttggtggttagatcagttgttaggcgcattagatgtagatctaatgttaatttctgctgtttctgtgatttggtatctctgtaactgttcgtaagctctagatattgtaatttctcattacatattcaatgaacaaagctcagtttcta

SEQ ID NO: 3400 - DNA, 529 bp, Artemisia annua
cacaaacaacaatcaattaatccaaacaccaccaaattcaattacaaaaaaatgtcaggaagaggaaagggaggaaagggattgggcaaaggaggagcaaagcgtcacaggaaagtcctccgcgacaacatccaaggtatcaccaagcctgccatccgtcgtcttgctcgtcgtggaggtgtgaagcgtatcagcggtctgatttacgaggagacacgtggcgtcctcaagatctttttggagaatgtgatccgtgatgccgtcacctacactgagcacgctcgccgtaagacagtgactgcaatggatgtggtgtacgcgttgaagaggcaaggaaggactctttacgggtttgggggttagaattggaattagggtttgttgttatggttaggatgtggaagttgttatgtggttaagattgttatgtttaagatctggttaggtgcttgtgtagatggggtttgttacatcttgtaattgaatctctgtttcggattaatatgaattttagtatttcctgcaaaaa

SEQ ID NO: 3401 - DNA, 508 bp, Artemisia annua
accacacacacaaataacaatccaaacacccccaaattcaaaaaatcaaaaatgtcaggaagaggaaagggaggaaagggattgggcaaaggaggagcaaagcgtcatcgcaaggttcttcgcgacaacatccagggtatcaccaagcctgccatccgtcgtctggctcgtcgtggaggtgtgaagcgtatcagcggtctgatttacgaagagacacgtggcgtgttgaagatctttttggagaatgtgatccgtgatgccgtcacctacaccgagcacgctcgccgtaagacagtgaccgctatggatgtggtttatgctttgaagagacaaggccgtactctctatgggtttgggggttaggttgaagttagggtttgttgttatggttaggctgtggttgttgttttatgttttaagatttggttaggtgtttgtgtagatggggtttgttacatcttgtaattgaatctctgtttcggattaatatgaatttaagtactttctg

SEQ ID NO: 3402 - DNA, 593 bp, Phaseolus coccineus
tcctatttatggccggggattgcattttgaatctgaaacttcaaatccctaaattcgagtttgttgcaaagtttgaaaaaatgtctggccgtggaaaaggtggtaagggtttgggaaagggaggcgccaagaggcacagaaaggtgctccgtgataacattcagggcatcacaaagcctgcaattcgtagattggctagaagaggtggcgtcaagagaatcagcggtttgatctatgaggaaactagaggtgtgctcaagatattcttggagaacgtgattcgagatgcagtgacttacaccgagcacgctaggaggaagactgttactgcaatggatgttgtttatgcgctcaagaggcagggaaggactctctacggttttggagggctgaacagttcttcttttgttttcccatggttccattcttatgaatgtttctagttctagggttctatttttgtaatagggacttgtttggttttactacgtctgatacataatgtgaaacttttgaaattatatggattaacattctctttgttggaattaattgttgcaacctttctttaattgagagtggagaacacaaaa

SEQ ID NO: 3403 - DNA, 552 bp, Brassica napus
gggacacaacagtcttcaaaactctctcttacattcaaaagcaaagaaaaaaatgtctggacgaggaaagggaggaaagggactgggaaagggaggagccaagaggcacaggaaggtcctccgcgacaacatccaggggatcaccaagcctgcgattcgtcgtttagcgaggagaggcggtgtgaagcgtatcagcggtttgatctacgaggagactcgcggcgttctcaagatcttcctcgagaacgtgattcgtgacgctgtgacttacactgagcacgctaggaggaagactgtgacggcgatggatgttgtgtatgctttgaagaggcagggaaggactctgtacgggttcggcggctgaggggattgaattaggggtttgtaaatcgcgtttgttgtttttagggtttggttaatttggggagattaagatctctataagctgtctgaagggttttatttgaatgttttaagtggttttaaattgaatgagaaaagcttttatttgaacttgtccgtttcttataaattgactgtctataactgacg

SEQ ID NO: 3404 - DNA, 626 bp, Vigna unguiculata
cggacgcgtgggttagaatcagaaaaaagagaagaaaaaagaagtgcgaaaatgtctggtcgtggaaaaggagggaaaggtttgggaaagggaggagctaagagacacaggaaagttctccgtgataacattcagggaattaccaaacctgctattcgtcgattggctcgcagaggtggtgtgaagagaatcagtggtctcatctacgaggaaactcgtggagtcctcaagatcttccttgagaatgttattcgtgatgctgttacctacactgagcatgctaggaggaagactgttactgccatggatgttgtttatgcactcaagaggcagggcagaactctctacggttttggtggttaatttttttctcctaaattagggttttcatgagaatcaatgtaaattgtgtttcttatggattgttgattatgtgatatgctcttaggtgtaacttatgtttgatttgtttcattaaaacagaactgttgttccagtaagattgatgaatgaaattgcagttgattatgatctctattttgatgttttaaacatgagatgtaactctaacacagtagaaggtgtggtaattagtattgcgggactggatattgattttctacagt

SEQ ID NO: 3405 - DNA, 556 bp, Festuca arundinacea
ggcacgaggcaaaatcccccaaaaaatccccatcttcccaaggagcagcagccatgtccgggcgcggcaagggcggcaaggggctcggcaagggcggcgccaagcgccaccgcaaggtcctccgcgacaacatccagggcatcaccaagccggccatccgcaggctcgccaggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctgagcagagcagtcgcggcgctggatggccgtgccggaagtcttggctcgcggtcaagaaattgaggagacgagaaaaccgtacccagttgatttgggttccctgcctagtttcatgggtggtagttgtagcagcatcgtcagcagtactagtgttgtagtgcaaagtttgttctgtgttttctttcatgttgt

SEQ ID NO: 3406 - DNA, 550 bp, Festuca arundinacea
ggcacgaggcaaccaccaccacacaagtcatcctcaccggagaaggaggagatgtcgggccgcggcaagggcggcaaggggctgggcaagggcggcgcgaagcggcaccggaaggtgctgcgcgacaacatccagggcatcaccaagccggccatccgccgcctggcgcgccgcggcggcgtcaagcgcatctcgggcctcatctacgaggagacccgcggcgtgctcaagatcttcctcgagaacgtcatccgcgacgccgtcacctacaccgagcacgcgcgacgcaagaccgtcaccgccatggacgtcgtctacgcgctcaagcgacagggccgcaccctctacggcttcggaggctaggcggttctccgctgccggtcctgtccaccccggattagagatgttgctagcgggtgatgtttagggttcgtggctgttgttgttgggtgttagtcgttcgtgtcttgttgctgttgtcttgtgttggttggatgtactctactagttcgagctgaacctctggttcggtagaatggaatggaaattt

SEQ ID NO: 3407 - DNA, 542 bp, Vitis vinifera
aatccaaatcaagattttaaccctcatcctagtattttacagctgcgaacgatgtcaggccgtggaaagggaggcaaagggctgggcaagggaggagcaaagcgccatcggaaagttctccgggacaacattcagggtatcacgaagccggcgatacgaagattggctaggagaggaggtgtgaagagaatcagtgggctgatctacgaggaaaccaggggcgttctgaagatattcttggagaacgtgattcgcgatgcggtgacgtacactgagcacgccaggaggaagaccgtgaccgccatggacgtggtttacgccctcaagaggcagggaaggactctttacggcttcggtggctgataaatttcattctttttgggtctctcttcggcgtttttggttgaaattcagcttctgagttttgccatttcttgtctcaatcagtagctattactggctgtaatagattgaatgtatgctatttctggcaacaatggagattgttatatgagaattgctaaaactatcgtttcatatta

SEQ ID NO: 3408 - DNA, 540 bp, Lactuca sativa
cggggacaccagaaatcaaaaccaattccagagtatccattccgtacaaagagatgtcaggaagaggaaagggaggcaagggacttggaaagggaggagccaagcgccaccggaaagttctccgtgacaacatccagggaatcacgaagccggcgatccgtcgtttggccaggcgaggtggtgttaagcgtatcagcggtctcatatacgaggagacacgaggtgtcctcaagatctttctcgagaacgttattcgtgatgcagtaacctacaccgagcatgctcgccggaaaactgtgactgctatggacgtggtttatgcattgaagcgacaaggtcgtactctgtatggttttggagggtaggaaagatttagggcttctggaattaggtgtaactggaggttttgtttcacagatctgtttgttggtttgttaaaattgtttatatatctgtgtaattgagattcccaatcaatgtcagtttgatcttgttagcagctctttttttattttatttttatttttttttctgattttg

SEQ ID NO: 3409 - DNA, 517 bp, Lactuca sativa
gacatacattcaactaaattcgtagagataacaaaagcagaaaaagaaaaaatgtctggaagaggaaaaggaggcaagggattgggaaagggtggagcgaagcgtcaccggaaggttctccgtgacaacatccaggggatcacaaagccggcgatccgccgtctggcgaggcgtggcggcgtgaagcgtattagcggtcttatctatgaagagacccgaggcgtgttgaagatcttcctagagaacgttattcgtgacgccgttacttacaccgagcacgctcgtcgaaaaactgttactgctatggatgttgtctatgcgttgaagcgtcagggacgaactctgtatggtttcggtggttaaggttaattacgatttgtagattagtttgtgtcctgtttcatttacgtttccgatttggttagtttatttgtagagatgtttgttatatcggtgcaactgaagctagatttcgatttaagatgaatacaaactcaatttcatgttagattttaag

SEQ ID NO: 3410 - DNA, 468 bp, Lactuca sativa
  misc_feature (467)..(467): n is a, c, g, or t
gggatcattcaagttcaaacccaattcaattttatctttctccttgtgaaaatgtctggccgtggaaagggtggaaaaggactgggaaagggcggagcaaaacgtcaccggaaagtactccgtgacaacattcagggaataacaaagccggcgattcggaggttggctagaagaggtggagtcaagagaatcagcggattgatttatgaagagactcgaggtgttctcaagatctttttggagaatgtgattcgtgatgcggtgacttacacggagcatgctcgccggaaaacggtgactgccatggatgttgtatatgctctcaagagacaaggccgaactctttatggatttggaggctaagtttgtttatcctgttgaatgatatatcaatagaattaatcgattccaatgtgtacttggtttacagggtattgaatgttaatgaaatgctaattttcttcacna

SEQ ID NO: 3411 - DNA, 529 bp, Lactuca sativa
tcatctcaattcaaaacttttcaaatccgttcctacagagagagttgcagacatgtctggaagaggcaagggaggaaaggggctaggaaagggaggagcaaagcgtcatcgaaaggttctccgggacaacatccagggaattaccaaaccggcgatccgtcgtttggccagacgtggcggcgttaagcgtatcagcggtctgatctacgaagaaactcgtggtgttctcaagatctttctagaaaatgtcatccgtgatgctgttacctacaccgagcatgctcgccggaagactgtcaccgccatggatgtcgtctatgctttgaaacgtcaaggacgtaccctttacggtttcggtggttagggtttttatttggtttaggtatttcttgccttttatgcaccgatttagatctctagtgtttagatttcagttcaccttgttgatgcttagttatgtatgtcattcaatgcaatcgaaaccttatcgattcaatattaatcaagatcttagcttattttcgtattc

SEQ ID NO: 3412 - DNA, 487 bp, Rosa hybrid cultivar
gacacaaagcatttcaaaaaatccaagatccgaaatccgaagtctaattaaaatgtcgggtcggggcaagggcggtaagggtttgggcaaaggcggagccaagcgccacaggaaggtcctccgcgacaacatccagggcatcactaagccggccatccgccgtctggctcgccgtggcggcgtcaagcgtatcagtggccttatctacgaggagacacgtggcgtcctcaagatctttctggagaacgtcatccgcgacgccgtgacgtacaccgagcacgccaggaggaagacggtgacggccatggatgtggtgtacgcgctcaagaggcagggcaggactctctacgggttcggcggttagggttagggtttgggaaatttgtaaagggaatggggctgatttcgcgggtggttggattagggttattggaattcgatgttgtttaggctgattttgaatgaagaatctacttgcttcttttac

SEQ ID NO: 3413 - DNA, 507 bp, Helianthus annuus
acccaccacccaattcatcaccaatcaatcaaacccacaatctcaaatcaaccatgtctggccgtggaaagggaggcaaggggctcggaaagggcggagcaaagcgacacagaaaggttcttcgtgacaacattcagggaatcaccaagcccgccattcgcagattggctcgcagaggtggagtcaagcgtatcagcggcttgatctatgaagagacacgtggcgtgttgaagatctttttggaaaatgtcatcagagacgctgttacctacactgaacacgctcgccgtaaaactgtcactgctatggatgtcgtttatgcccttaaacgacagggccgtaccttgtacggattcggtggttagatcatttagggttagggtttttagaagattatctgtttggttgtaatctatgttctgttatctgttttcaattcaccatcttggtgtatggggtttaatgatgaagaagttttttattttaaattgttatattgtctgtttg

SEQ ID NO: 3414 - DNA, 560 bp, Helianthus annuus
  misc_feature (407)..(407): n is a, c, g, or t
  misc_feature (410)..(410): n is a, c, g, or t
  misc_feature (489)..(489): n is a, c, g, or t
  misc_feature (492)..(492): n is a, c, g, or t
  misc_feature (506)..(506): n is a, c, g, or t
  misc_feature (511)..(511): n is a, c, g, or t
ccaaaaaccaaaaccccaattctcaaatctcatcatccaccgattgaaaaaaatgtcaggacgcggaaagggaggaaaagggttaggaaagggcggagcaaagcgccacaggaaggttctccgagacaacattcagggaataaccaagccagcgattcgaagactggctcgtagaggcggagtgaagcggatcagtgggttgatatacgaagagacacgtggagtgttgaagatatttctagagaatgttattagagatgcggttacctacactgagcatgccaggaggaagacggttactgctatggatgtggtttatgcgttgaagaggcagggaaggacgctttatgggtttggtggttagggtttgggatttggggaaaagtcttgctatcaagaaagaaaanggnttagggtttgtttgggtttattgtgttgatgtaaaaaatgttatggttggaaatttgcaatgtgttttgtgtttcaatnganggtattatagttgncttcncaaaaaacaagtttaagaatacaattttcctgttcggccggctcgggcc

SEQ ID NO: 3415 - DNA, 519 bp, Helianthus annuus
  misc_feature (412)..(412): n is a, c, g, or t
  misc_feature (414)..(414): n is a, c, g, or t
  misc_feature (431)..(431): n is a, c, g, or t
  misc_feature (444)..(444): n is a, c, g, or t
  misc_feature (518)..(518): n is a, c, g, or t
ggacacactcaaaaccaaaccaaatcttccatacacacttattttccaaaacatgtctggtcggggaaagggcggaaagggtctcggaaagggtggagctaaacgacaccgaaaagtcctccgcgacaacattcagggaataacaaagccggctattcgaaggttggcgagaagaggtggagtcaagagaattagcgggttgatttatgaggaaacgcgtggtgttttgaagatatttttggagaatgtgattcgtgatgcggttacttacaccgagcatgctcgtaggaaaacggttactgctatggatgttgtgtatgctcttaagaggcaggggcgaactttgtatggctttggtggctaatctttttttttttttttttagtttgttgaatggattgtaaggatttangngtttgaatgaaatgttngattatggtaaantgggttttattgttgttttgggatgactattactatttttttgttagattaatgctaattataatttcttttang

SEQ ID NO: 3416 - DNA, 571 bp, Triticum aestivum
attcggcacagggcaacagccaccaccagcaacacacagcagccaagcgaagatgtcgggtcgcggcaagggagggaaggggctgggcaagggcggtgccaagcgccaccgaaaggtgctacgtgacaacatccagggcatcaccaagccggcgatacgccgtctggctcggaggggcggcgtgaagcgcatctcggggctcatctacgaggagacccgcggcgtgctcaagatcttcctcgagaacgtcatccgcgacgccgtcacctacaccgagcacgctcgccgcaagaccgtcaccgccatggacgtcgtctacgccctcaagcgacagggacgcaccctctacggattcggcggctaggccccgcgaatcgagcccacgccaacagattagttgctgtagctagctatggttgtgtagtgttcatggtctttgatgtggtggccgcatctcgctgctttgatgtgatttttgtcagatgttactaatttcagattggtctctcgctctgtaatttgtcgcctcctcaaatcagtcgtgttggcttcagtgattctaaaaaaaaaa

SEQ ID NO: 3417 - DNA, 599 bp, Triticum aestivum
accaccgctccctcaatcccactcgcgcagcagctccaagaggatcgtcagccatgtctgggcgcggcaagggaggcaaggggctcggcaagggcggcgccaagcgccaccggaaggttcttcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgtgacgccgtcacctacacggagcacgcccgccgcaagaccgtcaccgccatggacgtcgtctacgcgctcaagcgccagggccgcaccctctacggcttcggcggctaggccgcgccagatggtcgtcagtcctcgtcgccgcctgcagattccgctgtgttagtccgcccgttcctagtagtgttgcgctcaagaaatctcagatggaaaccgccttgtttcccatttcctctgtctgtttagctggatcatgaaattatgtactgtaatgaagatgtttgcatccagagttcgaactgaaacccgcatcccttgtcgtgaattatgtgcaaatgctgtgtt

SEQ ID NO: 3418 - DNA, 536 bp, Triticum aestivum
atcccaagcttcaacatccacaccactcccttcttctcccagatccatcgacgatgtccgggcgcggcaagggcggcaaggggctgggaaagggcggcgccaagcgccaccggaaggtcctccgcgacaacatccagggtatcaccaagccggcgatccggaggctggccaggaggggcggcgtgaagcgcatctccggcctcatctacgaggagacccgtggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctagatccgtctagtggagcaacttcctcgtttgctctgtgtgacatgtatcgtgctagatgggatttactgctttggcgtgcgtcgttgtgttctgtcttgggttcagtaggctgtgtaatacctgttcaatgcaatcagttcgattctgaatcctgacgaaatgcttcactgt

SEQ ID NO: 3419 - DNA, 453 bp, Triticum aestivum
gcgagccaatccgcccgctcgcagctcaaaggaaggaaggaagccgttgaccatgtccggccgcggcaagggcgggaaggggctgggcaagggcggcgccaagcgccaccggaaggtgctgcgggacaacatccagggcatcaccaagccggccatccggcggctggctcgccgtggcggcgtgaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgacagggccgcaccctctacggattcggcggctgattgacctgccgctgccgctgctctgctcccgctgttcctgtcttcctgtgggtttctaaattctagtgcgtgcgttgggttgcatctgt

SEQ ID NO: 3420 - DNA, 508 bp, Triticum aestivum
ctcctcgacctccatccgctcgcagctcgaaccaaggagagatctgtcagccatgtctgggcgcggcaagggaggcaaggggcttggcaagggcggcgccaagcgccaccggaaggtgctgcgcgacaacatccagggcatcaccaagccggccatccgccgtctggctcgccgtggaggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggcttcggcggctaggctcttcctcgccccccctgcaggtcccaaaagctttatagaacagcgacttgttcagttctctatttgctctgtagttcgaactgaatcgtggaacaaagttgttcgcatgtgttgctggaaatggaacctgtctctgtgaaa

SEQ ID NO: 3421 - DNA, 549 bp, Triticum aestivum
  misc_feature (543)..(543): n is a, c, g, or t
gaattcggcacgaggccacacgagtcccttcttcccccaaatcgagcgacgatgtctgggcgcggcaagggcggcaaggggctgggaaagggcggcgccaagcgccaccggaaggtcctccgcgacaacatccagggcatcaccaagccggcgatccgcaggctggcgaggaggggcggcgtgaagcgcatctccggcctcatctacgaggagacccgcggcgtcctcaagatcttcctcgagaacgtcatccgcgacgccgttacctacaccgagcacgcccgccgcaagaccgtcactgccatggacgtcgtctacgcgctcaagcgacagggccgcaccctctacggtttcggaggctagattcatgtagtccgccagcagtggggcaacttcctcgtttgctctctgtgatgtgtgctgtggtagatgagatttactggtttgcgtgtgttgttgtgttctgtcttggggttcagtaggctctgtaatagctttgttctgttcaatgcaatcagttcgattctgaatctaaaaaaaacntccaaa

SEQ ID NO: 3422 - DNA, 520 bp, Triticum aestivum
caccaccgtccctccgattccacatccgctcgcagctcgagatcgtcagccatgtccgggcgcggcaagggaggcaaggggctcggcaagggcggcgccaagcgccaccggaaggtgctgcgcgacaacatccagggcatcaccaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggattcggcggctaggttctttgccgccgcctgcagattccaaaatcttgatggaaccccgacttgtttagctcgctgtttactctggctctgtagttcgaactgaatcgtggaacaaagttatttcatatctgttgttggaaatgaaacctgtctttgtgcaaaaaaaaaa

SEQ ID NO: 3423 - DNA, 439 bp, Secale cereale
tccaccgtctccgtccaatcccatctgctcggagctccaagccgccatcatgtccggccgcggcaagggcgggaagggtctgggcaagggcggcgccaagcgccaccggaaggtgctgcgggacaacatccagggcatcacgaagccggcgatccggcggctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccaccatggacgtcgtctacgcgctcaagcgccagggccgcaccctctacggcttcggcggctgatctgctgctgctccttccagtctcttccagctgccgttccatctgccgtagtgcgcgtgttgttccgtcggtctgtgt

SEQ ID NO: 3424 - DNA, 316 bp, Triphysaria pusilla
tcaccgaaaaaattagggttaagtgaaatgtcgggaagaggtaagggcggcaagggattgggaaagggtggcgcaaagcgtcatcgcaaagtgttgagggacaacatccagggcatcacaaagccggctatccgccgattggctcgccgtggtggagtcaagcgtatcagcgggctgatctatgaggagacacgtggcgtcctcaaaatattcctcgagaatgtcatccgtgatgctgtcacctacactgagcatgctcgccggaagactgtgacggcgatggatgttgtctacgcgctcaagaggcagggccgta

SEQ ID NO: 3425 - DNA, 550 bp, Triticum aestivum
  misc_feature (431)..(431): n is a, c, g, or t
  misc_feature (465)..(465): n is a, c, g, or t
  misc_feature (488)..(488): n is a, c, g, or t
  misc_feature (539)..(539): n is a, c, g, or t
  misc_feature (550)..(550): n is a, c, g, or t
caacagcaagcgaaaatctcccgatcccctctggtctccgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagccatggacgtcgtctacgcgctcaagcgccagggccgcaccctctatggcttcggcggctaagctaagccggccgcgcctcgctgtcgtcgctgcggttctattgtttttgcaattcgcaaattaatggctcngtggcgaaaatgctggttactgtggcactagatnaaacatgttgtgcgtgtctgaanaaatgcaattgtactgctgtttgtcaaaaaaaagggggccggtaccaatcncctatatgagn

SEQ ID NO: 3426 - DNA, 574 bp, Elaeis guineensis
  misc_feature (29)..(29): n is a, c, g, or t
  misc_feature (37)..(37): n is a, c, g, or t
  misc_feature (53)..(53): n is a, c, g, or t
  misc_feature (58)..(58): n is a, c, g, or t
  misc_feature (86)..(86): n is a, c, g, or t
  misc_feature (116)..(116): n is a, c, g, or t
  misc_feature (194)..(194): n is a, c, g, or t
  misc_feature (204)..(204): n is a, c, g, or t
  misc_feature (206)..(206): n is a, c, g, or t
tctacgacttcccctccaaatcgagagcnagaaaganagaatcggagatgtcnggacnaggcaagggaggcaagggactgggaaanggcggggccaagcggcatcgcaaggtcctncgggataacatccagggtatcacgaagcctgccatccgccgcctggcccgccgaggcggcgtcaagcgcatcagcggnctcatctacnangagactcgcggcgtcctcaagatcttcctcgagaacgtcatccgcgatgccgtcacctataccgagcacgcccgccggaagacggtcaccgccatggacgttgtctacgcccttaagcgccagggccgcaccctctacggctttggcggctaaaggaaggaagagaaaaaattcgcatcagcgattcgctaaatttctagaattagggttaggattttctcagctgctgttgtttcgtctttgttgatgtaagatatattttaaagattagcaaatattttcctcgttgctcctcatgaatgttgtttgtgatttcatcggaatgtaagttttagggtatttgatgaagtcctacgatttgaactttg

SEQ ID NO: 3427 - DNA, 498 bp, Hordeum vulgare
gggggagtggcgctaaccggagagaagcgagacgatgtcgcgccctggaagggccggcaaggggctcggcaaggtcggcgccaagcgccaccggtaggtgctccggaacaacattcagggcatcaccaagccggacatccgtggtctcgcgcgcaggggcggcgccaagcgcatctcggggctcatctacgacgagacccgcggcgtgctcaaaatcttactagagaacgtcatgcgcgacgccgtaacctacaccgagcacgccccgccgaaagaccgtcaccgccatggacgtcgtctacgcactcaagcgccaggggcgcaccctctacggacttggacgctaggccaccaaccaaatccagagagttttagtggttgcggtcgttggtgtaactcgagcatctcgtttgccggtgctgtttaatgtagaagctaacggaatcgaatggaaataggtgtggattatgcctgagaaaaaaaaaaaaaaaaattgct

SEQ ID NO: 3428 - DNA, 423 bp, Triticum aestivum
  misc_feature (319)..(319): n is a, c, g, or t
  misc_feature (346)..(346): n is a, c, g, or t
  misc_feature (351)..(351): n is a, c, g, or t
ccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaaggagacccgcggcgtgctcaagatctttctccgagaacgtcatccgcgacgcctcacctacacggagcacgcccggcgcaagaccgtcacagcatggacgtctctacgcgctcnaagcgccaaaggccgaccctttaacgntttcngcggtaagggcgctagctaggcatctcgaccggccccatcttcgctctggggtctcaatggtcctttaccct

SEQ ID NO: 3429 - DNA, 282 bp, Triphysaria pusilla
tgaagaggtaagggcggcaagggtttgggaaagggcggtgccaagcgccatcgcaaagtcctccgcgacaacatccaaggcatcaccaagccagccattcgccggttagctcgccgtggcggagttaaacgaatcagcggtttgatctacgaagagactcgcggcgtcctcaagatcttcctagaaaacgtcatccgtgatgccgttacctacactgagcacgctcgccgtaagtgtttttccactcaggacgtcgtatatgctcttaagaggcagggacgt

SEQ ID NO: 3430 - DNA, 457 bp, Artemisia annua
acgctcgacagagcaaagcgtcatcgcaaggttcttcgcgacaacatccagggtatcaccaagcctgccatccgtcgtttggctcgtcgtggtggtgtgaagcgtatcagcggtctgatttacgaagagacacgtggcgtcctcaagatctttttggagaatgtgatccgtgatgccgtcacctacactgagcacgctcgccgtaagacagtgactgcaatggatgtggtttatgctttgaagaggcaaggaaggactctttacgggtttgggggttagagttgaaattagggtttgttgttatggttaggatgtggaagttgttatgtggttaagcttgttatgttttagatctggttaggtgcttgtgtagatggggtttgttacatcttgtaattgaatctctgttgcgaattaatttgaatttaagtactttctgttaaaaaaaaaaaaaaaa

SEQ ID NO: 3431 - DNA, 358 bp, Pisum sativum
aggagctaagaggcacagaaaagtgcttcgcgacaacatccaaggcataaccaaacccgcgattcgtcgtttggctagaagaggcggtgtcaagagaataagcggcctcatctatgaagaaacccgcggtgttctcgagatcttccttgagaatgttattcgtgatgctgttacctacaccgagcacgctagaaggaaaaccgttacggccatggatgttgtttatgctctgaagaggcagggaaggactctttacggcttcggtggttgattcttgttttcaattcatggttttgttagcgttagattggtttagttgtaaatgtttgttaattttgatgtgtttttcatatgttct

SEQ ID NO: 3432 - DNA, 461 bp, Pisum sativum
gtgcaaagaggcataggaaggttcttcgtgataacatccaaggtatcacaaagccagctattcgtagattggcaagaagaggaggtgtgaagaggatcagtggtttgatctatgaagaaaccagaggagttctcaagatctttttggaaaacgtcattcgtgatgctgttacatacactgagcacgcaaggaggaagactgttaccgccatggatgttgtttatgctcttaagagacagggaagaaccttatatggatttggaggttgattaagaatcattcatttctttattgttattagctttagatttgtaataggagtgtgattgtaattcttgaatcttgtgatgatgtttaggttaattgcgagatgaaattctcaatgaaatcacaacatactcaatttacacggtttgaaattgaaatctaatgaaaaccagtgctttttgttgaaaaaaaaa

SEQ ID NO: 3433 - DNA, 482 bp, Pinus taeda
aggtgctaagaggcacaggaaagttctcagagacaatatccagggcatcaccaagcctgccattaggcgtttagccaggagaggaggcgtcaagcgcatcagtggccttatctatgaagagaccagaggcgtcttgaagattttcttggagaatgtcatcagagatgcggtgacatacacagaacacgcgaggagaaagactgtgacagctatggatgtcgtctactccctgaaaagacagggccgaactctttacggctttggaggctgagaagtctcactctgactattattcagtcgtttttactcatttatggtgtctttagacaccaccttatctacaggaaattttaagcctaataggtactgtaagtgtccaatgcattgctttggatgaagcttgtggagatttagtcagcgtgttgataaaaaagttgtcgatgtactaaatatttccaatttgtgttgactgtagtttgctg

SEQ ID NO: 3434 - DNA, 841 bp, Hordeum vulgare
cagatcccctccaaggttaccctcggcacagacataccatccaccgagcgtggtcagccatgtcgggccgcagcaagggaggcatgggcctgggaaagggcggcgcgatacggcacaggaaggtgctgcgagacaacatccacgggatcaccaaacccgcgatccggcggctggctctgcggggcggcgtgaatcgcatctccgggctcatctaccaggagaccctcggcgtgctcaaaatctaccttgagaacgtgatacgagacgccgtcacctacacggagcactcccgccgcaagaccgtcatcggcatggacgtcctctacgcgctcaaccgccaaggccgaaccctctactgcttcggaggctaagccctctcgtggtgcaggtgcttcaggtgtagttgtggtcaagcaggtcatcgatctctggcgtgctggtcatgtgtgtgcagctgcactctggtgcttgaaacgagccacaaattctgtgatgtggggtcttcatgttggcctgtgggttgggagtgtaggggagggggagggcagtgtgcgtgtggtgtttgctagtgggggcgtccccgatgcttcgtataggtggtgtgtgatgtcgtcttgtggcgttgtcttgtcgttagctgggcaccgcgagttgctcttgtcgccccgtgtttcgtcgctgttctttcctgttctctctgtgttgctcctgcggtcttcccttgagtcatagttgatcctgcgttgattcccgccttgttcctgcgtatttttcagttttgtgcccgcttagtttttcattacttatgttggcgatttttgcccgatatgttgcatgattg

SEQ ID NO: 3435 - DNA, 286 bp, Populus trichocarpa
gaaaagaatgtcagggagaggaaagggaggtaagggattgggaaagggtggagccaagaggcatcgtaaggttcttcgtgataacatccagggtatcaccaagcctgcgatccgtcgtctggctaggcgtggtggagtcaagcgtctcagtggtcttatatacgaggagaccagaggtgtcctcaagatcttcttggagaatgtgattcgtgatgccgtcacctacactgagcacgctcgccgcaaaacagtgactgctatggatgctgtgtatgctttcgactaa

SEQ ID NO: 3436 - DNA, 710 bp, Picea glauca
  misc_feature (252)..(252): n is a, c, g, or t
  misc_feature (417)..(417): n is a, c, g, or t
  misc_feature (524)..(524): n is a, c, g, or t
  misc_feature (645)..(645): n is a, c, g, or t
  misc_feature (650)..(651): n is a, c, g, or t
  misc_feature (653)..(653): n is a, c, g, or t
  misc_feature (656)..(656): n is a, c, g, or t
ggagccaagaggcacaggaaagttctcagagataacattcagggcatcaccaaacctgccatcaggcggctcgccaggagaggcggagtcaagcgtatcagcgggctcatctatgaagagaccagaggagtcttgaagatcttcttggaaaatgtgattagagatgctgtaacatacacagagcacgcaaggagaaagaccgtgacagctatggatgtcgtctactcattgaagaggcagggccgaaccctntacggattcggaggctgataagcctgattgttactcgtttctcctatttctcatcactcattgactcatttatggtgtctattgacaccaccttctgcctctttgggagattgtaaccctattctcactggcgaatgcccatgatttgcttccattgaaagtctncatatgcggattgtgagttaggcgtattttccgaattgttattattatgtattttccgaattggcatgattctactatttcctgccaaatgatgcggtttttaaggnttttgtccagtttggtccaacagggcaaaacgtctgcgtttttcgaatttgttgaacggtcagcagggtattgccgataataggtatgtgttcttgctatttttatcacaagtatgtatgngtttnncncangggttcattttaaaggtatttttaagtggctgggtgttgctagccgattgtata

SEQ ID NO: 3437 - DNA, 471 bp, Avena sativa
ggcaagggaggcaaggggctgggcaagggcggcgcgaagcgccaccgcaaggtgctccgcgacaacatccagggcatcaccaagccggcgatccggcgcctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgacagggacgcaccctctacggattcgggtgtcttcagggatggatgaagttggcgaatgttgttgtttagggtccgtggttcttgggtgttgtggtagctgtgtctcgctgttggttgtttgctgctgtgtcgtgttcgtgtgcggatgtacttctaggatttgctggacctctggttcggtagaatggaatgggaatttcacta

SEQ ID NO: 3438 - DNA, 442 bp, Avena sativa
ctcctctggcaagggaggcaaggggctcggcaagggcggcgccaagaggcacaggaaggtgctccgggacaacatccaggggatcaccaagccggcgatccggaggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggcccatctctctgctggcgtgtgattagggttgtcacttgttagggtttcggatccgtgcgtgagttgtcatggagcgatggcatgtagtgatggaatttgttgcatatcgatgaatggatgaatgaatgagtttggtgtttc

SEQ ID NO: 3439 - DNA, 566 bp, Avena sativa
ggcaagggcgggaagggcctgggcaagggcggcgccaagcgccaccggaaggtgctgcgggacaacatccagggcatcacgaagcccgcgatccggcgtctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggcttcggtaggattggcctctcgctcgctcgctcgctgccaccagattagaaagctatacctagcaggtgtttagggttcgtggtcttaagtgtaatcgcagggtctctctgtcgtttcgttctgttcttgaatgtttggatgtattccgagctgttggctgctggtttggaatggaaggtagctgatgtacatgtactccaacagttatgttgtagtggtatttgcctgcagtttcttctgttgattttgatttgtagccgatgataaaaatctaaaag

SEQ ID NO: 3440 - DNA, 454 bp, Brassica oleracea
gaacttattattttctcccatcgaaggtttttaatattgaattttcccgagaaaaaatgtcaggccgcggaaagggaggaaaaggattgggaaagggaggagccaagaggcatcggaaagttctccgagacaacatccagggaattacgaaaccagcgatccgtcgtctggcgagaagaggaggtgtgaagcgtatcagcggtttgatctacgaagaaactcgcggcgttctcaagatctttctagagaacgtgattcgtgacgcggttacgtacacagagcacgctcgccgcaaaacagtcacggccatggacgttgtctacgctctcaagaggcagggtcggactctgtacggattcggcggttaattcgattgtttcagtttcagatcttgtaaaatcttttttttttcagaatcaatgggaaaatatgcatctttttccgaaaaagaaaa

SEQ ID NO: 3441 - DNA, 568 bp, Brassica rapa
gacacatcgaaaacacacaagcgaatctcaatttaaaactttccgagaaaagaaaaatgtctgggcgaggaaaaggaggaaagggattgggaaagggaggagccaagaggcacaggaaggttctccgtgacaacatccagggcatcacgaagcctgcgattcgtcgtttagctagaagaggtggcgtgaagcgtatcagcggtttgatctacgaggagactcgcggtgttctcaagatctttctcgagaatgtgattcgtgatgccgttacttacactgagcacgctaggaggaagacggtgacggcgatggatgttgtctatgcgttgaagaggcagggacgaactttatatggattcggcggttgatgggatgattttgtaaatcgcgtttgtctttagggtttgtttaatctattaaagctgttttagagtttcgtttagaatgtttcagcgttttgaattgaatgaaaacactttttctctattagcttttgcaaaattgtcggtatagttacgctgaatcgtcgttttaactaagaacaaattaagcaactccttacctcgtt

SEQ ID NO: 3442 - DNA, 494 bp, Brassica rapa
gacacatcgaaaacacacaagcgaatctcaatttaaaactttccgagaaaagaaaaatgtctgggcgaggaaaaggaggaaagggattgggaaagggaggagccaagaggcacaggaaggtcctccgtgacaacatccagggcatcacgaagccggcgattcgtcgtttagctagaagaggtggtgtcaagcgtatcagcggcttgatctacgaggagactcgcggtgttctcaagatctttctcgagaatgtgattcgtgatgccgttacatacactgagcacgctaggaggaagacggtgacggcgatggatgttgtctacgcgttgaagaggcagggacgaactttgtatggattcggcggttgagggggatgtgatttgagtttgtaaatcgcgtttgtctttagggtttgcttaatctattaaagctgttttagagtttcgtttagaaagtttcaacgattttaattgaatgaaaacactttttatcta

SEQ ID NO: 3443 - DNA, 725 bp, Gossypium hirsutum
  misc_feature (22)..(22): n is a, c, g, or t
accagttttcaatatatcttcnaagaagttccatcgatttcagtttagcattcataatgtcaggaagaggaaagggaggcaaggggttgggcaagggaggagcaaagcgtcaccgtaaggtcctccgtgataatatccagggaattacaaagccggctattcggcgtttggctcgtaggggaggcgtcaagcgcatcagcggcttgatctacgaagaaacccgtggtgttctcaagatcttcttggagaacgtgattcgtgacgctgtcacctataccgagcacgcgaggagaaagactgtgactgctatggatgtggtttatgcgctcaagaggcagggcaggactttgtatggattcggtggttaaatgtgatttagggtttaggttttagaatggtggtgtcttaggggggatttgaagtcttgctgtcaagaatgtttgagctttgggttagggattgtaattagggggtgtttacccgtttgtttgttttgtgggttgtgtaattcgtgcttcgaattgcagatttcaatgaaattttaacttcattttgttaatttgtatgtcttatttattttgaatttaattcagttctggttcttttaaaggggcccccaaattcaattcaagggggaatttcgcaaaaatccctcaaactgggggccccccgagcatgcatttaaagggcccaattccccctaaagggggtcctattaaaattcc

SEQ ID NO: 3444 - DNA, 994 bp, Gossypium hirsutum
acaagttttcaatatatcttcacagaagttctatcgatttcagtttagcattcataatgtcaggaagaggaaagggaggcaagggtttgggtaagggaggagcgaagcgtcaccgtaaggtcctccgtgataatatccagggaattacgaagccggctattcggcgtttggctcgtaggggaggcgtcaagcgtatcagcggcttgatctacgaagaaacccgtggtgttcttaagatcttcctggagaacgtgattcgtgacgctgtcacctacacagagcacgcgaggagaaagactgtgactgctatggatgtggtttatgcactcaagaggcagggcaggactttgtatggattcggtggttaaatgtgatttagggtttaggttttagaatggtggtgtcttaggggggatttgaagtcttgctgtcaagaatgtttgacctttgggttagggattgtaattagggggtgtttacccgtttgtttgttttgtgggttgtgtaattcgtgcttcgaattgcagatttcaatgaaattttaacttcattttgttaatttgtatgtcttacttattttgaatttaatttatttctggtttacggtgttttgatgaggagattggcaaaaggaaaatgaagtctgcaaaatttaggagctaaagaaagctgaaagcgtatatgaaagtcatcttgatgctctaatttgctcattcgatagtttaaattttactgtcaagaatgttcgaacttaggggttttattttggattatacgaagttataagttggtatctgttgattgcttctgtgttttgtaactcatgcttcgagttgcagatttgaatgatatttgaacttcgttttgtttatttaaaaaaaaaaaaggcggccgctctagaagtccaactactacctggtgcgatctacctctaagggcccaaataattctggggcgttttacaccgcggggaaacggggtcccattttcccgg

SEQ ID NO: 3445 - DNA, 498 bp, Taraxacum officinale
aatctcattcaaccacaaaccagatccaaaatcttctctcgagcttctctcaacaatgtcaggccgtggaaagggaggcaaggggctcggaaagggaggagccaagcgacacaggaaggttctccgtgacaacatccagggaataaccaagcccgccattcgcagattggctcgtcgtggaggtgtaaagcgtatcagcggcttgatctacgaggaaactcgcggtgttcttaagatctttctagagaatgtcatcagagatgctgttacctacaccgagcacgctcgccgcaaaactgttaccgccatggacgtcgtctatgctttgaaacgacaaggccgtaccctctacggattcggtggttagatttagggtttctggaattactaattagtgtatgaactgtagatcgtatttggtattctaattatctgtattctgtatcattctccatctcggggttatgaaattatgttatgaaaacttgtttttgtttt

SEQ ID NO: 3446 - DNA, 491 bp, Taraxacum officinale
  misc_feature (22)..(22): n is a, c, g, or t
cggcggggaatccacagaaatnaatccaagtcgagaggatcaacagagaaagagaaatgtcaggaagaggcaagggaggcaagggattgggtaaaggaggagccaagcgtcaccgtaaagttctccgggacaacatccagggaatcacaaagccggccatccgccgtttggcgaggcgaggcggtgttaagcgtatcagcggtctcatctacgaggagacaagaggcgtcctcaagatctttctagaaaacgttattcgtgatgctgtaacctacactgagcatgctcgccggaaaactgttacagctatggacgtggtttatgcattgaagcgacagggccgtactctctacgggtttggagggtaagagacagagggcttctaaaattagggctccacagatctgtttgttggtttgttaaatagttatatatctgtgtaattgaaacttctaatgaatgccggtttgaacttgttaccagttcttctt

SEQ ID NO: 3447 - DNA, 503 bp, Zingiber officinale
  misc_feature (5)..(5): n is a, c, g, or t
  misc_feature (7)..(7): n is a, c, g, or t
gcacnanggttcgcctcctcgtatttcttgtacttctaacacctccttcgttgaaatgtctgggcgtggcaagggaggcaaggggctcggcaagggcggagcgaagcgccaccgcaaggtccttcgtgacaacatccagggcatcacgaagccggcgatccgccgcctcgcccgacgcggcggcgtcaagcgcatcagcggcctcatctacgaggagacccgcggcgtcctcaagatcttcctcgagaacgtcattcgcgacgccgtcacctacaccgagcacgcccgccgcaaaaccgtcaccgccatggacgtcgtctacgccctcaagcgccagggccgaaccctctacggtttcggcggctgataccttcctattctctaggattagggtttgcactaggtccgtaaaaaaaagccatctttttacgaagatgctgctgctgaatcatgtaatcaaacatatgaatgcccttttaatccgacccgtttaaattccccac

SEQ ID NO: 3448 - DNA, 606 bp, Lactuca sativa
cggcggggatcattcaacccaattcattatattctttatcattctccttgagaaaatgtccggtcgtggaaagggtggaaaaggacttggaaagggcggagcaaaacgtcaccggaaagtactccgtgacaacattcagggaattacaaagccggcgattcggaggttggctagaagaggtggagtcaagagaatcagcggattgatttatgaagagactcgaggtgttctcaagatctttttggagaatgtgattcgtgatgcggtgacttacacggagcatgctcgccggaaaacggtgactgccatggatgttgtatacgctctcaagagacaaggccgaactttgtatggatttggaggctaaatttgtttctccattccagtaccagtgtttattttgtttacgaactattgaatcttaacaaaatgccgttttgtctttttggaatattgatttgctgcggggttgaatgattcataattttttggcttccatttttgggtttgacctatatttgtttaaaactctataaggatttgtcgtatttaattagtatcatcagatttgatcatgagctattgatttactgagtttttgaatgc

SEQ ID NO: 3449 - DNA, 545 bp, Lactuca sativa
cgcggggaagcgaaaatcgaactcatttctagagagagaaagcgagagaaaaaaaatgtcagggagaggaaaaggaggcaagggattgggaaagggaggagccaaacgacatcgtaaggttctccgggacaacatccaaggtatcaccaagccggcgatccgccgtctggccagacgaggaggtgttaagcgtatcagtgggttaatctacgaggagacccgtggagttttgaagatctttcttgagaacgtcatccgtgacgccgtcacatataccgagcatgctcgccggaaaactgttactgccatggatgtcgtttatgctttgaagcgccaaggtcgtactctctacggatttggtggttgatagaaatttgctatcttttcgtttctgggtgtaggctttttattagttagattatgtaatctgaattgatatgatgtgtaattgatgcctcttaatacaaattcagttactttttatcaatttcttgtcgaattcttcatctcgaatgattctcttaatacaaattcatcggatatca

SEQ ID NO: 3450 - DNA, 500 bp, Lactuca sativa
gcggggaacaccagaaatcaaaccaattccagagtatctattccgtacgaagagatgtcaggaagaggaaagggaggcaagggactcggaaagggcggagccaagcgccaccgtaaagttctccgagacaacatccagggaatcacgaagccggcgatccgtcgtttggccaggcgaggtggtgttaagcgtatcagcggtctcatatacgaggagacgcgaggtgtcctcaagatctttctcgagaacgttattcgtgatgcagtaacctacaccgagcatgctcgccggaaaactgtgactgctatggacgtggtttatgccttgaagcgacaaggtcgtactctttatggttttggaggttaggtaagatttagggcttctggaattaggtgtaatttgaggttttgtttcacagatctgtttgttggtttgttaaaattgttcatatatctgtgtaattgagatttccaatcaatgttagtttgatcttgttagca

SEQ ID NO: 3451 - DNA, 554 bp, Lactuca sativa
cttcggcggggaacaaaatcaattcatttttaacgagagaaaagttgagagaaaacatgtcaggaagaggaaaaggaggcaagggattgggaaagggtggagccaaacgtcatcgtaaggttctccgggacaacattcaaggtatcaccaagccggcgatccgccgtctggccagacgaggaggtgtcaagcgtatcagtgggttaatctacgaggagacccgtggagttttgaagatctttcttgagaacgtcatccgtgacgccgtcacatacaccgaacatgctcgccggaaaactgttaccgccatggatgtcgtttatgctttgaagcgccaaggccgtactctttacggatttggtggttaagagaattttgcggtttctactttctagggttcttgtttggcatcgaggttttcattgctttgttatctgtaatcggaagtggtattacctgtaattgaagctattaatacaatatcacttatccaattcatcttttctgtatgattatatgcttatgcaatacatgatataatatttgtctttggg

SEQ ID NO: 3452 - DNA, 700 bp, Elaeis guineensis
ccgcacagcagaacttcccaaattgtccatcgctcaagcaatctgtgcaaggtacgatgtccggccgcgggaagggaggcaaaggattgggaaagggtggcgcaaagcggcatcgcaaggtcctccgggataacatccaggggatcacgaagccagcgatccggcgtttggcgaggcggggtggggtgaagcggatcagtggcttgatctacgaggagaccaggggtgttctcaagatcttcttggagaatgtgatccgggacgccgtcacctacaccgagcacgcccgccggaagactgtcaccgccatggacgtcgtctacgccctcaagaggcagggccggacactctatggattcggtggttaggacttctattctatgaaaagtcttgctgtcaagaaaatggccaacaagcagattaaaaaaaaaagttgagaactttggtagggtttctgtcgtaggtgtcgtctgtcggtgttgtctttttattctatgttgttcttttcatggttactggaaggaactccgtttgtaaatcttagtgtatcttttcatccatgaatgcagtgcttcattattctctcaatcatctcaggtcttattgctttcttgtacttcctgataaacattttaatgtgatgtttcgattatattctaattaaggtagaggatggcaagggataaggcttgaacaaaat

SEQ ID NO: 3453 - DNA, 559 bp, Raphanus sativus
aactctaacttcgattcttcttcagcaccaaactttctcaatcgaaaaaaaaacatgtcgggtcgtggaaagggaggaaagggtttggggaaaggaggagccaagcgtcacaggaaggttctgagagacaacatccaaggaatcaccaagcctgcgattcggaggttggctcgtagaggtggagtcaagcgtatcagtggtctcatctacgaggagacgcgtggcgtcctcaagatctttttggagaacgtcatccgcgacgcagtcacttacaccgagcacgctaggaggaagacggtgaccgccatggacgtcgtctatgctctgaagaggcaggggaggactctctacggtttcggcggttaagggtgttttcagatccgcgtttgcgtttctgtgtttcttttctgggaatttctaatcgaattatgtttttcattagatgtttgggtactggcgtttatgtgttgcggtagcgtttcgttttatgtgtaattaggcctttgattaacaatgcaatgtcaatccatggttaagaagtttctggagaaatatgatt

SEQ ID NO: 3454 - DNA, 511 bp, Raphanus sativus
ggacatccttcacacgtgtgagaaacaagctttctttttccgagaaaagaaaaaaatgtcagggagaggaaagggaggaaagggattggggaagggaggagctaagaggcacaggaaggtcctccgcgacaacatccagggcatcacgaagccggcgattcgtcgtttggcgaggagaggcggtgtgaagcgtatcagcggtttgatctacgaggagactcgcggtgttctcaagatcttcctcgagaatgtgattcgcgacgccgttacttacacggagcacgctcgcaggaagactgtgacggcgatggatgttgtgtacgcgttgaagaggcaggggaggactctgtacgggttcggcggctgagtgggggttggaatcgagattttgtaaatcgcgtctgtttgtttaagacctttaagctgttgttagggtttcgtttcgatgtttcgttgattttgaatttagtgaaaacgcattaatccatatctctggtgttttttacaaaga

SEQ ID NO: 3455 - DNA, 562 bp, Triticum aestivum
ccccaatcccctccaatcccaccttcggaacagcagccagcaagcgtcgccagccatgtcgggccgcggcaagggaggcaagggcctgggaaagggcggggcgaagcggcacaggaaggtgctgcgcgacaacatccaggggatcacgaagccggcgatccggcggctggcgcggcggggcggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagcgcggttcgtgcctcgcgtgggatttagatgtggttaggcgggtcgtcgttctgtggtgtgcttgtcctgtgtgtgcgtgtgcagctgcgtgctggtgcttgtaatgagttccagattctaatatgggtgttcatctcgcattggattgaatcatgtgttctgctctgaccactggcgatgtctgtccctgcac

SEQ ID NO: 3456 - DNA, 611 bp, Triticum aestivum
gaccacaccgccgcaaccaccaccaccaccagcagcacacactcagaagcgaagatgtccggccgcggcaagggagggaagggcctcggcaagggcggcgccaagcgccaccggaaggtgctgcgcgacaacatccagggcatcaccaagccggcgatccgccgtcttgcccgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgtcaggggcgcaccctctacggattcggcggctgacctgcgcccgctgctccaatctccaatctccatcgactctgactctgctagctgctgttctggtgctatggtttcgtttctgagtgcgtgcgttgttggtccatcggtctgtgtagttagtggaaggcgatggatctgaatgcagtcagttcgtcagagtgcgtctgttgatctatcggtctctgtagtcagttcctcagtggaaggcgatgaatatgaatgcaatggggtcgttggttctttct

SEQ ID NO: 3457 - DNA, 613 bp, Triticum aestivum
ccgcagcaacacacacacagagaagccaatctcgccggagagggaagcgtcgacgatgtcgggccgtggcaagggagggaaggggctcggcaagggcggcgccaagcgccaccggaaggtgctccgggacaacatccagggcatcaccaagccggcgatccgccgtctggctcgcaggggcggcgtgaagcgcatctcggggctcatctacgaggagacccggggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggcggctaggccacgccggtccagcagaacccacctcgcgccgccagattcactagctagccatggttgttcagtgttcatgttcctcggtgtaatggaatggccgcatctcgccgctgtctgttgttcagtgtactgtgtttggatgtactaggatggaatggaaatcgcggcgttttacccctgaatgtgtctgcaaagaaaaaaacaaaaaactcgagggggggcccggtgcccaattcgtcctatagcgag

SEQ ID NO: 3458 - DNA, 630 bp, Triticum aestivum
agccaccgccgttcctccggttccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaagcgcatctcagggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctagggcctgcagattcgaaaagcttgatggaaccccgacttgtctagttcgctgtttcctgagtagctccaattgaatcgtggaacaaagttaatcgcatgtgtttgttggaaatcaaacttctctctgcaaatgccgcgtttctgaatttgtttcgccgtttggtctctgttgggtcgatattgaggtggcgatgagttgatttgccataatttactaggagccccggattagccgtacttgtttgcagtataatttgaaatgtta

SEQ ID NO: 3459 - DNA, 479 bp, Triticum aestivum
  misc_feature (169)..(169): n is a, c, g, or t
  misc_feature (353)..(353): n is a, c, g, or t
  misc_feature (392)..(392): n is a, c, g, or t
  misc_feature (400)..(400): n is a, c, g, or t
  misc_feature (472)..(472): n is a, c, g, or t
gtccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaancgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaagggcgcaccctctaagggttcgggggctaagcccggncgacggtcgcatgtttctctcgccgccctgcaagattcnaaaaagcntgatgggaaccccacctgtcctaatttgcttttcctgttgtaactcccaagtttttgtttggaaaataaacnttcctct

SEQ ID NO: 3460 - DNA, 480 bp, Triticum aestivum
  misc_feature (395)..(395): n is a, c, g, or t
  misc_feature (406)..(406): n is a, c, g, or t
  misc_feature (413)..(413): n is a, c, g, or t
  misc_feature (422)..(422): n is a, c, g, or t
  misc_feature (442)..(442): n is a, c, g, or t
  misc_feature (471)..(471): n is a, c, g, or t
cgccgcaacacacacacacacagagaagccaagatgtccggccgcggcaagggagggaagggcctcggcaagggcggcgccaagcgccaccggaaggtgctccgcgacaacatccagggcatcaccaagccggccatccggcgtctggctcgcaggggcggcgtgaagcgcatctcggggctcatctacgaggagacccggggcgtgctcaagatcttcctggagaacgtcatccgcgacgccgtcacctacaccgagcacgcccgccgcaagaccgtcaccaccatggacgtcgtctacgcgctcaaagcgacagggccgcacctctacggatccggcggctgaccttcgcccgctgctccaatctcatgttctccgtgctatggttccgtttnctgaattcaanatggctncgttgtttngccatccgtcctgtgtattngtggatggcgatggttctgaatgcatcantcctcaaat

SEQ ID NO: 3461 - DNA, 548 bp, Nicotiana benthamiana
gcacgaggtttcaattcaaaccaaaaaccctaggtcaaagttctgtgtgaaaatgtctggccgtggaaagggtggcaagggattgggcaagggaggagctaagaggcaccggaaggtgctaagggataacatccagggaattacgaagccagcaattcgtcggttggctcgtaggggaggagtgaagcgtatatctggtctgatctacgaagagacacgtggagtgatgaagatctttctagagaatgtgatccgtgatgctgttacctacaccgagcacgccaggagaaagactgttactgctatggatgttgtttacgcactcaagaggcagggcaggactctctatggatttggtggttaggttgtttagtttgtgatttaggttggtgtacttgtggtaattgtagattttctggaaatttctgttgtttcggtgttggtttctcagcagctttgttctagttgtcgttcttaaggtcttgatattgtaatttctcattgcaaattcaaggaacaaagttcattttctagaaattacaatgtta

SEQ ID NO: 3462 - DNA, 557 bp, Picea glauca
gcacgaggcttcattgttcgagcagcagcggaatttactgttgcgagtaaatatgtctggccgtggaaagggagggaagggtttggggaaaggaggtgccaagaggcacaggaaggtgctcagagataacattcagggtatcaccaagcccgccatcaggcgtctcgccaggagaggaggcgtcaagcgtatcagtgggcttatctatgaggagacaagaggcgttctcaagatcttcttggagaatgtgattagagatgccgttacatacacagagcacgccaggagaaagaccgtgacagccatggatgttgtctactccctaaagaggcagggccgaaccctctacggctttggaggctgataaattttactctgagtattactcattcctcctgtcgctaatcatttatttactaatggtgtctgttgacaccacccttctctatttgggaatggtagccttatcagttccttctatatattgaacatattgtgagtatccatttttagtgtgataatgtgattgtcaggatttgttttgagctttcgttgct

SEQ ID NO: 3463 - DNA, 616 bp, Solanum lycopersicum
tccacattcaaaaccctagaaacttcatcttctacaaatttctctgtgaaaatgtctggccgtggaaagggaggcaagggattgggaaagggaggagccaagaggcacaggaaggttctaagagacaatatccagggtatcactaagccagctattcgcaggcttgctcgtaggggtggtgtgaagcgtatctccggtctgatctatgaggagacccgtggagtattgaagatctttttggagaatgtgattcgtgactctgtcacctacactgagcacgccaggaggaagactgtcactgcgatggatgttgtctatgccctcaagagacagggaaggactctctatggatttggtggctagattgtggagtttggtggttgtaatggtagtaactctaggttttaatttacatagcttttgtgactgctgtgaattttaattctctgtagccttgttttggatcttgttcgtaagctctatattttgttaatattcaaggaatcaagttcacctttccagaaattacatcgtgtatttgcagctaattacgtcttttcttgattgtggattttgaattgcatatgttgtgtaatgaagtttatttgctgagttg

SEQ ID NO: 3464 - DNA, 581 bp, Actinidia deliciosa
agctcttcagttgaaaaccctagaactctctctctctctctctctctctctatctctctctctctcgatctctgtgaaaatgtcgggtcgtggaaagggaggcaaggggctgggaaaaggaggagcgaagaggcacaggaaggttctgagagacaacatccagggaatcaccaagccggcgattcggagacttgcgaggaggggtggtgtaaagagaatttctgggctgatctacgaggagactcgtggagttctcaagattttcctggaaaacgtgattcgtgatgcggtgacttacacggagcacgccaggaggaagacggtgactgccatggatgtggtctatgcactcaagaggcagggaaggactctctatggcttttggtggttagattcatctcgtagtgtcttccgttttagctctagtgcgtcgttgtagattttctctctccttcgatagatctgtctttctttttatatattgctttgtaattctattttagatcccaattaacagagcttacagtttattgcaaagcattggatttttttgggttgtataatcctaattaataaattta

SEQ ID NO: 3465 - DNA, 437 bp, Helianthus annuus
gcggggatcccaaatcaatactttgtcgatccaatctcctgcaacaatgtctggacgcggaaagggaggaaaggggctgggaaagggaggagcaaagcgtcaccggaaagttctccgggataacattcagggtatcaccaaacctgcaatcaggaggctcgctacaagaggtggagtcaagagaatcagcggtctcatataccaagagactcgtggcgttttgaagatatttttggagaatgtgattcgtgacgctgttacctacacggagcacgctcgccggaaaacagtgacggcgatggatgtcgtctatgcgttgaagaggccaggaagaactttgtacggattcggaggttaatggtctagtctgtgatgatatgatatacgaatatgtaattgttgaagtcaatggatcaatgctgcgttttattattggg

SEQ ID NO: 3466 - DNA, 1088 bp, Zea mays
tcagaacaagctagtctgaaaaatcaatcgcagaaacccaaagtagcactaggacgaacggaccaagcgacgacgaaacgaaacaacagtacagtacagtacagcaacctctccggctaaagcaagatgtatgtatgatccgcacagcaaaaagcaggggacagttagcaggggatcttggaggtaaaccaggtcatgacatggagcggcgccttgacgagctccacggccacctccagcagcaccgtcacgcaaaggcagcaggggcataaacgagatgggcagcccgatgatccagatgacggcgccgacgaaggagacgaggacggcgagcagcgcgaagggcaggcccaggagccacccgagcggccggcactccccgtcgccgccgcagcacatcgtccgcccttgaccagccggcccgcctccccttccctctccggctccgccgtcgctttctaggttggccgcgcgcgagggaaaaaggaagggaaaccgagcgcgcgcaccaagacgacctggtgccgaattcggcacgagggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcactgccatgtactttttcttttttctcaagcgccagggccgcaccctctacggcttcggcggctaggctgatgggctcctcgcgatgttctccccttctgcagatgcgaagttttctggccgtggccaccaatcttgcggtcaaaaaaagtttcagaactcttgtttattcttctcttgcctggggaagttttttctaatcgtgagactagtaggtttatctaaatcccagggttacagggttttcccgaaacattgaaacaataattaaaatttgtgggcttccgatagttggaaaaaccaacccgtaatgcaattttttac

SEQ ID NO: 3467 - DNA, 461 bp, Avena sativa
cggcacgagggcgaagaggcactggaaggtgctgcgcgacaacatccagggcatcacgaagccggcgatccggaggctggcgcggaggggcggcgtgaagcgcatctcagggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggcggaatcaaggcatcaggattagttaggtctttcgagggatcgctcgtcggatctctgcagctgttgtaatctctatctgcttgttgttcttgcgtggtggttgtggtgtatgaacaaactactgtcatgttggtttccaagaatttagtcactgcaaatctcttgcagagctattgttgttc

SEQ ID NO: 3468 - DNA, 447 bp, Picea glauca
ggcacgagggcgaagaggcaccggaaggtgttgagggataacattcagggcatcacaaagcctgcaatcagacggctggccaggagaggtggagtcaagcgcataagcggtctcatctatgaagagacgaggggagttctcaagatcttccttgagaatgtcatcagggatgccgtgacatacaccgagcacgcccggaggaagaccgtgactgccatggatgtcgtctactccctcaagaggcagggcaggactctctacggcttcggcggttgattgaatcaattcctcaaatggatttctcaatctattctgtcattcatttctttctttcatggtgtcttttgacaccgcccccctcatctttggaaattctttctctgtctgtgaaaaatatggagcaaacacggcataaaatgagggaaataatatcttttgatatgttct

SEQ ID NO: 3469 - DNA, 380 bp, Gerbera hybrid cultivar
tagaaggtttgcgatcccattgaaaccttttgcaacaatgtcgggttgtggaaagggcggaaaggggttgggcaagggcggagcaaagcgtccccggaaagttttccgtggcaacatccagggaatcccgaagccggcaatcaggagattggcgaggaaaggaggagttaaaaggatcagtggttttatttatgaaaaaactaggggtgtttttaaaatttttttggagaatgtaatttgtgatgcagttacgtaccctgagcccgctcggaggaagactgtgccccccatggacgttgtgtatgcccttaaaaggcagggaagggctttttatggattcggaggttaataaatctgtatttcctttgctgtttgtactg

SEQ ID NO: 3470 - DNA, 403 bp, Avena sativa
aaaatccccaaatccattcttctacctcgagagcgagacagcagagcagcgggcaagggcggcaaggggctcggcaagggcggcgccaagcgccacaggaaggtgctgcgcgacaacatccagggcatcaccaagccggcgatccgtcgtctcgcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtgtacgcgctcaagcgccagggacgcaccctgtacggcttcggataggcttctctgtaggtcgtggctctgcgaatgtctgttcttgtggttctaatgtaat

SEQ ID NO: 3471 - DNA, 330 bp, Tragopogon dubius
aagcagaaatcaaagaacagaaaaacattcaaatttcaattcgggtgaagctgagcggggagaatgtcaggaagaggtaagggcggaaaggggttggaaaagggaggagctaagcgtcaccggaaggttctccgtgataatatccagggaatcacaaagcccgcaatccgccgtcttgcgcggcgtggaggtgtgaagcgtatcagcggtcttgtctatgaagagactcgtggtgttctcaagatatttctcgagaatgttattcgtgacgctgttacttacactgagcatgctcgccggaaaaccgtcaccgccatggacgttgtctat

SEQ ID NO: 3472 - DNA, 333 bp, Brassica juncea
gatatcaacattctcatttgttatcttctccgatcgatttacagatctttggaaactaactgaggagaagagatgtcgggaagaggaaagggaggaaagggattgggaaaaggaggagccaagaggcacaggaaggtgcttagggacaacatccaaggcatcaccaagcctgcgatccgtcgtctcgctcgtagaggtggtgtcaagcgtatcagcggtctcatctacgaggagaccagaggagtcctcaagatcttcctcgagaatgtcatccgtgatgccgtcacttacaccgagcacgccaggagaaagaccgttacggctatggatgta

SEQ ID NO: 3473 - DNA, 458 bp, Brassica napus
agagggaaaggagggaaaggattgggaaagggaggagccaagaggcacaggaaggggcttagggataacatccaaggtatcaccaagcccgccattcgttgttttgctcgtggagggggcgtcaagggttttagcggtttgatcttcgaggagaccagaggagtcctcaagtttttcctcgagaatgtcttccgcgacgctgtcacctaccccgagcacgcgagggggaagactgttactgctatggatgtggtttttgctttgaagaggcaagggggtactctttacggtttcgggggttaaatcgacggaaatgagattagggtttcgaaagtttggggatctgaatttgggattttttttttttttggtttttgatttttcgaagtaaatccccgactgttgtttcgttttttgctgtgttgttagccaatattatgttgaattaattttaatca

SEQ ID NO: 3474 - DNA, 687 bp, Gossypium hirsutum
  misc_feature (589)..(589): n is a, c, g, or t
ttaccccacgcgtccgaaccactgcacattactatacactaccagagtatacaccaaccacgcaactaaacgaccaactctccctctatcacaatgactggacgcggcacgggcgggaagggtctcggcaagggcggcgccaaacgtgaccgaaagatcttgcgagacaacatccagggtatcaccaagcctgccatacgacgtctcgctcgccgaggaggtgtcaagcgtatctctgccatgatctacgaggagacccgcggtgccctgaataccttcctcgagggtgtcattcgagacaccgccacctacactgagcacgccaagcgcaagacagtcacatctattgatgttgtctacgccctgaagagacaaggccgcaccctctacagattcggtggctaaactcgctctgatgtacatgcatgcacgaaactctgcggtcaactgcttgctgcgcaggaccatgtaaggtgttgcatgacgacaaatgggtccggtcttgcttttgggtgttctgtatcatacggaaacgggggatgacatttcgggataatcgaacatgcccttgaggcgcatgtgatcgtcngcaaagcccgatcctcatgtggttgtattcggtgcgccttcgttcaaggaaaaaaacaaagccatcggcgacagccgaatacttttttaataaaaccc

SEQ ID NO: 3475 - DNA, 536 bp, Cycas rumphii
gaagaggcacaggaaggttctgagggataacatccagggtatcaccaagcctgctatccggcgccttgcccgacgtggtggtgttaagcgtatcagtggtttgatctatgaagaaacccgtggtgtgttgaagatattcctggaaaatgtcatcagggatgctgttacgtacaccgagcatgctcgccgtaagacggtgactgccatggatgtcgtctatgctctcaagaggcagggcaggactctatatggcttcggcggttgattattttctgttctattttggtgtttttaaacaccacctatgcatctcggaaccgttttatttgttttttccaacaattttgtaaaaccccaaaagagattacgggctcaggaggtttgttgcattgagcgaacttctgcttgtttgttctttattagcggaggctatttgcaggttggatgatttctggaatgtaatgttggtgcactggtggattggtgacccagtcaatgtggattttcgttgttatttgtacgaatagatttatgta

SEQ ID NO: 3476 - DNA, 460 bp, Picea glauca
gccaagaggcacaggaaggttctcagagataacattcagggcattactaagccagccattaggcgtctcgccaggagaggaggcgttaagcgtatcagcgggctcatctacgaagagaccagaggtgtcctcaagatctttttggagaatgtcatcagagatgccgtgacgtacacagagcatgccaggagaaagacagtgacagccatggatgtcgtctactccctgaagaggcagggccgaaccctctacggcttcggaggttgagaagtcttagtctgactgctactcatttctcctattgttcatcccgcatttattcatggtgtctgttgacaccacccttctcagtttggggaatgttaaccttgataattccctgttaccatatgtaattagggagattcactgaagctgtgaatatccatcacgacttaaataaagagaaatttgaaccgta

SEQ ID NO: 3477 - DNA, 425 bp, Triticum aestivum
gcggcgccaagcgccaccggaaggtcctccgcgacaacatccagggcatcaccaagccagcgatccggaggctggcgaggaggggcggcgtgaagcgcatatccggcctcatctacgaggagacccgcggcgtcctcaagatcttcctcgagaatgtcatccgcgacgccatcacctacaccgagcacgcccgccgcaagaccgtcaccgccatggatgtcgtctacgcgctcaagcgccagggccgcaccctctacggcttcagaggctagattcgtgtagcggagcaacttcctcgtgtgctctgtgtgatatgtgctatggtggatggatttactgatttgttgttcgtcgttgtgttctgtctttgggttcagtaggctgtgtaataccctgttctgttcaatgcaatcagtttgattctg

SEQ ID NO: 3478 - DNA, 418 bp, Ipomoea nil
  misc_feature (17)..(17): n is a, c, g, or t
  misc_feature (19)..(19): n is a, c, g, or t
  misc_feature (22)..(22): n is a, c, g, or t
  misc_feature (55)..(55): n is a, c, g, or t
  misc_feature (66)..(66): n is a, c, g, or t
  misc_feature (92)..(92): n is a, c, g, or t
  misc_feature (189)..(189): n is a, c, g, or t
  misc_feature (194)..(194): n is a, c, g, or t
  misc_feature (197)..(197): n is a, c, g, or t
  misc_feature (216)..(216): n is a, c, g, or t
  misc_feature (221)..(221): n is a, c, g, or t
  misc_feature (231)..(231): n is a, c, g, or t
  misc_feature (233)..(233): n is a, c, g, or t
  misc_feature (238)..(238): n is a, c, g, or t
  misc_feature (241)..(241): n is a, c, g, or t
  misc_feature (306)..(307): n is a, c, g, or t
  misc_feature (312)..(312): n is a, c, g, or t
  misc_feature (323)..(323): n is a, c, g, or t
  misc_feature (326)..(326): n is a, c, g, or t
  misc_feature (339)..(339): n is a, c, g, or t
  misc_feature (351)..(351): n is a, c, g, or t
  misc_feature (394)..(394): n is a, c, g, or t
  misc_feature (412)..(412): n is a, c, g, or t
actttcaaatcaaaatntnctngtccaatttacctctcactccaccaattcaaanccctagatttnttctttctctctgcaaaaatgtccgnccgtggaaagggaggcaagggattgggcaagggaggagccaagcgtcacaggaaggtgcttcgcagacaacatccaggggatcacgaagccggccantcgcngtntggctcgtagaggaggcgngaagngtatctccgncntcatntcngaggagaccaggggagtcctcaagatcttcctcgagaatgtgatcagagacgccgtgacatacanngagcncgctcggaggnagnccgtgacggcganggacgtcgtatncgccctcaagaggcagggcaggactctgtacggtttcggaggntaggatgttgggatgcgntatcgg

SEQ ID NO: 3479 - DNA, 604 bp, Saccharum officinarum
  misc_feature (594)..(597): n is a, c, g, or t
  misc_feature (599)..(599): n is a, c, g, or t
  misc_feature (603)..(604): n is a, c, g, or t
ccttcagtcccgccgcctgcagtctactactccgaggaaatccaccacccacccgagcggaagaagccatgtctgggcgcggcaagggcggcaaggggctcggcaagggcggcgcgaagcgtcaccggaaggtgctgcgcgacaacatccagggcatcaccaaaccggcgatccggcggctggcgcggaagggcggcgtcaaaccgcatctcggggcttaatatacaaggaaacccgtggcgtgttcaaaatcttcctcaaaaacgtaatccgcaacgccgtaacttacaccaagaacgcccgccgaagaaccgtaaccgcattgaacttgttttaccccttaaaccgcaagggccgaaccttttacggtttcggcggttaggctggtgggctcccctcgatgttcccccttctgcagctgcgatgttgtctggccgtgccaacaagtcttgcggtcaagaaagtttcaggaactctttgtagttcatctctggctgtagtaggtttatctgaattgtaagactgtagcaggtttatctgaatcatgcagtatcgaaatcatgtgaacatcagatgttggaaatcaaagcttgnnnnanaaann

SEQ ID NO: 3480 - DNA, 839 bp, Hordeum vulgare
ctcctccgctcccatccaagatccattcaactccatctgctcggggctccaccatcatgtccggccgcggcaagggcgggaagggtctgggcaagggcggcgccaagcgccaccggaaggtgctgcgggacaacatccagggcatcacgaagccggcgatcctgctgctggcgcggcggggcggcgagaaacgcatctcggggctcatctacgaggagacccgcggcgtgctcaagatcttgctcgagaacgagatccgctacgccgacacctacaccaagcacgcccaccggaagaccgggaccaacatggatgtggagtacgcgctcaaacagacacggacaaaccctgtacagctgaggcggctgatctgctggtgctgctacacacaaactacaacgactgctaaaccactatacggaatgcacaacaggattcaacattcaataatattcgacattctcaataccttcacgttctttatagatgcctatacacttatcaaataattaacttttgaaatttatttactaaccgtatgatctcagatatctatgcaatgggagtccaaagtattacacttaatttttattagtgtacttattctcttaatatatatttcgtacggtatgttatttacatttggatttaattataaaacagagccgaaatctgacccagccagatttatttcgtcacctattttcgcattttatcgcattatagtctcccagcggattttcacaataacaaataattgacggttagataaatatttttacttgcaggagatgtccccattatttatatattaaaattaagtgagtgggggagttaat

SEQ ID NO: 3481 - DNA, 552 bp, Zea mays
  misc_feature (34)..(34): n is a, c, g, or t
ggaggagccctttaaggggaccggccgccgccgnccgcgaagaacacggccccggcgaagacggggcgcggcaagggcggcacccgggagggcgagggcggcgccaagcgccaccgcaaggtgctgcgcgacaacatccagggcatcacgaagccggcgatccgtaggctggccaggaggggcggcgtcaagcgcatttctgggctcatctacgaggaaacccgcggcgtgctcaatatcttcctcgagaacgtcatccgcgacgccgtcacctacaccgagcacgcccgccgcaagaactgtcaccgcctttttttttttctacgcgctcaagcgccagggttggaggctcgacggcttctgctgctttgcctccccccctcccgatgctttgatactaccgccgtggtctgttgtgtgtcctagttggccggtctaactgtaggtttgtcctgatgcctcgggtccgaggtggtccatggtaccagccccattgggtggcagtagcagcccaagcctttcttcattggtaaaccctcgggtgcccccacc

SEQ ID NO: 3482 - DNA, 524 bp, Zea mays
accaaggtctatgtaccttcccaaaaatccctcattttcttccaggcgaggaaagcgtgaaagacagggcaccgatagcgacgatgtcggagagcggcaagggcggaaaaggtctggttaaggctggagcaaagcgacaccgtaaggtgctccgtgacaacatcaagagcatcaccaagcccgctcatccggaggctgcatcgtaggggcggagtgaagcgcatttaggagcttatctacgaggagacccgcggcgtcctcaagatcttcctccagaacgttatcggtgacgccgtcacctacaccgagcacgcacgctcgcaagactgttaccgccatgtacgtcgtctacgacgctcgagtggcagggccgaaccctctacgggttcagaggctaggatgggagcctcttctccttgctgacgaggatgcctgtttgaagatatgcatacttcttttagccccttgactgtgacgtgctggactattgctaggattatacttgaaaatgtgtttcaaatgca

SEQ ID NO: 3483 - DNA, 605 bp, Zea mays
aacaacaacaacaacccgcacaacggcactattctactcctgcgtccgcgtagctctcggtttcggcgatgtcggggcgcgacgagggcggcaaggggctgtgccaagggcggcgccaagcgccaccgcgaggtgctgcgcgacaacatccagggcatcacgaagccggcgatccgtaggctggccaagaggggcggcgtcaagcgcatttctgggctcatctacgaagagacccgcggcgtgctcaagatcttcctcgagaacgacatccacgacgccgtcacctacaccgagcactctcgccgcaaaatcgatctccgccagggatgtcgtctacacacacaggcgacagggccgcacgctcaacggattcggcggctaggccgtctccccttcggacgctttgatatgaagggcgtgggatgttgagtgagaaatgggccggtctattgcagtttgtaatgtaataagggttcaaggagatccagggttgagccccatttgggtcgtaatatttggcccaggttagttcaatgaaaagccatcgggttctatactctccagaagggattaggagaaaagaaaaagaaatgaaaattcagaat

SEQ ID NO: 3484 - DNA, 408 bp, Helianthus annuus
ggtttcctagagagagaaaatgccggaagaaaaaaaaggaggcaagggattgggaaaaggaggaacaaaatgacagtgtaaggttcttcgaggcaacattcagggaattacgaagccggcaatccgttggtttgcacgacgtggtggtgtgaagcgtactagcggtctgatttatgaagagacacgtggcgtgttgaagatattcttggagaatgtgataagagacgcggttatgtacacggagcatgcggggaggaagaccgttactgccatcgatgttgtttatgcgttgaagaggcaggggcatacgctttatggtttcggtggttagggtttggaatagttgggatttggttaggttgtgtagaggtttgatagtggtggttgtgaaccagtcgtttctaatta

SEQ ID NO: 3485 - DNA, 483 bp, Helianthus annuus
  misc_feature (27)..(27): n is a, c, g, or t
tagagagagaaatgtctggagaggaanaggaggctactgattgggaaaatgaagagcgaaacgacaccgtaaggttcttccggacaacattcagggaattacgaagccggcaatccgccggcttgcacaacgtggtgccgtgaagctttaatacggtctgatttatgaagagacacgtgtcgtgttgaagatattcttggagaatgtgataagagacgcagttacgtacacggagcatgcaaggaggaagactgttactgccatggatgtttatgctttgaagaggcaggggcatacgctatatgttttggtggttagggtttggaatagttggggttttttttttggtaaaaggggcctggcaaacactaaatagttggttaggttgtgtagacgtttgttagtggtagttgtgtaattgaagtttgtttgggaatcaagtgattttgaatggattttgctttagtttggttttaaaaaaaa

SEQ ID NO: 3486 - DNA, 519 bp, Triticum aestivum
  misc_feature (323)..(323): n is a, c, g, or t
  misc_feature (358)..(358): n is a, c, g, or t
  misc_feature (499)..(499): n is a, c, g, or t
  misc_feature (507)..(507): n is a, c, g, or t
tcgcgtacatgtcgcacgcgccaggtgttttgagcacccgatttctacaaacaaattggacccttccgttgtatagggaaggtcttcaccctcattttaacccccctcaaccacaggctcaccccaccaacagcaagcgaaaatctcccgatcccctctggtctccgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggntcatctacgaggagagccgcggcgtcctcaagatnttcctggagaactgatccgcgacccgtcacttacaccgagcaccgcgccgcaagacgtcacagcatggacgtctctaccgctcaagcgccaaggccgcacctctatgcttccggggctaagctaagccggcgcgctcgctntctccctncggtctattgtt

SEQ ID NO: 3487 - DNA, 596 bp, Gossypium hirsutum
cacccacgcgtccgaaaaatctcaattccctctagaaaaaatctttgatttttcaaaaatgtcgggccgtggaaaaggaggcaagggattaggaaaaggaggagctaagaggcatcggaaagttctccgagataacattcaaggcatcactaagccggcgattcgtagattagctcgtagaggcggtgtgaagaggatcagtggcctgatctacgaagaaactcgtggagttctcaagatctttctggaaaacgttatacgcgatgctgttacctatacggaacacgctaggcgtaaaactgttaccgctatggacgttgtttatgctctcaagagacaaggaaggactctttatggtttcggtggttgatttagggttttagggtctttcttcttttgttgtaaatctttcgttgcaactgcttgttgtaggctttttttttttttgtttggatcgatgtattttcgtttcgatgaaaatttcgctccgaaagctaattgggtttctaaatatttgacatttgaaaatttgaaattttagggttcgtccgaaaatatgggtatactcgtttatctgcatttcgatttctttgaac

SEQ ID NO: 3488 - DNA, 644 bp, Cryptomeria japonica
  misc_feature (2)..(2): n is a, c, g, or t
  misc_feature (386)..(386): n is a, c, g, or t
  misc_feature (391)..(391): n is a, c, g, or t
  misc_feature (413)..(413): n is a, c, g, or t
  misc_feature (432)..(432): n is a, c, g, or t
  misc_feature (469)..(469): n is a, c, g, or t
  misc_feature (480)..(480): n is a, c, g, or t
  misc_feature (502)..(502): n is a, c, g, or t
gnaccgcgtttcattcaatttgtctgcattcacaggattttgaagagagaaggaaaaatgtcaggaagaggaaagggcggcaagggtttggggaagggaggcgccaaaaggcacaggaaagtactacgcgataacatccagggcatcactaagcctgccattagacgtctggccaggagagggggcgttaagcgtatcagcggcctcatttatgaggaaaccaggggtgtactgaaaatctttctggagaatgtaatcagggatgctgttacgtatactgagcatgcacgccgcaagacagtgacggccatggatgtagtctatgctctcaagaggcagggcaggactttgtacggattcggcggttaaatattgccgaggtcgangtttnaatagtgtttctgtaacgccgnctcaacaattgaaatgctngtggtgtgcacagggctgttagaatggttaaatgcanttgctcttttnttgttctatgaagaatgaatanattgtaattttttttctgtttaattataatatggcaacattgttaattctgattcctttggagttcagtgatgttaaaggttgattgatgtcacttgttagtggaaaccttgttacaaagatgtcaaatgcatttgtgctgc

SEQ ID NO: 3489 - DNA, 561 bp, Festuca arundinacea
ggcacgaggcaattccccagtctcgctcgcagctcgaagcaaaagcagatcgtcagccatgtcggggcgcggcaagggaggcaaggggctcggcaagggcggcgccaagcgccacaggaaggtgctgcgcgacaacatccagggcatcaccaagccggccatccgccgccttgctcgccgtggcggcgtgaagcgcatctcggggctcatctacgaggagacccgcggcgtcctcaagatcttcctcgagaatgtcatccgcgacgccgtcacctacaccgagcacgcccgccgcaagaccgtcaccgccatggacgtcgtctacgccctcaagcgccagggccgcaccctctacggcttcggcggctagatgccaccgtccttgtcttcgtctgcgccaaacccgtcgcctccttggcggcaacaacctgttggctttctcagtgtgttctgttctgttcagtagctgtagttcgccatctgtgcttcgcatagtctctctagctagcttgtagctctggatgagcctagatctgaaatcgaatatattatgttcaccta

SEQ ID NO: 3490 - DNA, 583 bp, Festuca arundinacea
ggcacgaggcgaatccccagtctccctcacaccccgaagcaacagcagattcgtcgaccatgtccggccgcggcaagggaggcaaggggctcggcaagggcggcgccaagcgccaccggaaggtcctccgcgacaacatccagggcatcaccaagccggccatccggcgcctcgctcgccgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctagaggcccccgtcctcctcttcgtccgcgccaaatccgtcgcctcctcgccggcaacagcctgttgtctttctcagtgtgttctgttccgttcagtagctgtagttggaacaatgttactagttcgccatctgtttatcgcaaaacccgtctagctagcttgtaatagctctgtatgagcccacatctgaaatcgaatagtactatctcctcct

SEQ ID NO: 3491 - DNA, 619 bp, Festuca arundinacea
  misc_feature (363)..(363): n is a, c, g, or t
  misc_feature (376)..(376): n is a, c, g, or t
  misc_feature (387)..(387): n is a, c, g, or t
  misc_feature (389)..(389): n is a, c, g, or t
  misc_feature (426)..(426): n is a, c, g, or t
  misc_feature (435)..(435): n is a, c, g, or t
  misc_feature (437)..(437): n is a, c, g, or t
  misc_feature (441)..(442): n is a, c, g, or t
  misc_feature (465)..(465): n is a, c, g, or t
  misc_feature (532)..(532): n is a, c, g, or t
ggcacgaggccccactccaaaaaaatccccaaatcttccgaaggagcagcagcagccatgtctgggcgcggcaagggcggcaaggggctcggcaagggcggcgccaagcgccaccgcaaggtcctccgcgacaacatccagggcatcaccaagccggccatccggcgcctcgcccgccgtggcggcgttaaacgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggnggctgagcagagnagtcgcggcgntngatggccgtggcacaagtcttggctcgcggtcaaganattggaggngnggannaagctgtagttgatctgtgttcngttcctagttccgtgggtagcagtagtagcttcgtcagcagtagtaggttgttgtctgttttagtgnttgttttattgttctcaacttgtgatgggcaaatatggtgtttgccgagttgtatgatttcagtattaacaaagtcatccttcagct

SEQ ID NO: 3492 - DNA, 496 bp, Lactuca sativa
atttatcctccatctcttcctcagaaacttgaaattcaagaacttgtttcatttgacaatgtctggccgtggaaagggtggaaaagggttgggaaagggaggagcaaagcgtcatcggaaagttctcagggataacatccagggaatcacgaagccagctatcaggagactggcgaggagaggaggagtgaagaggatcagcggtctgatctatgaagagacacgaggtgttttgaagatctttttggagaatgttattcgtgatgctgttacctacaccgaacacgctcgtaggaagactgtgacagccatggatgttgtgtatgctttgaagaggcagggaagaactttgtatggattcggaggttaatagatctaagagctgggtagtgaatattttgcttaaattgttgtaatgaatcatctcgatttttgggacaatttggttacatgttatcaatgtcttgctgtttgggatgcttagttgaatggaaat

SEQ ID NO: 3493 - DNA, 480 bp, Lactuca sativa
gcttcggcggggatcattcaagttcaacccaattcaattttatctctctccctgtgaaaatgtctggccgtggaaagggtggaaaaggactgggaaagggcggagcaaaacgtcaccggaaagtactccgtgacaacattcagggaataacaaagccggcgattcggaggttggctagaagaggcggagtcaagagaatcagcggattgatttatgaagagactcgaggtgttctcaagatctttttggagaatgtgattcgtgatgcggtgacttacacggaacatgctcgccggaaaacggttactgccatggatgtcgtatatgctctcaagagacaaggccgaactctttatggatttggaggctaagtttgtttatcctgttgaatgatatatcaatagaattaatcgattccaatgtgtacttggtttacggggtattgaatgttaatgaaatgctaattttcttcacaatgaa

SEQ ID NO: 3494 - DNA, 487 bp, Lactuca sativa
gcggggatccatcacaatcggaattaatttcatttttagagaaaaaaaaaataaaaaaatgtcaggaagaggaaagggaggcaagggattgggaaagggaggagctaaacgacatcgtaaggttctccgggacaacatccaaggtatcaccaagccggcgatccgccgtctggccagacgaggaggtgtcaagcgtatcagtggcttaatctacgaggagacccgtggagttttgaagatctttcttgagaacgtcatccgtgacgccgtcacatacaccgaacatgctcgccggaaaactgtcaccgccatggatgtcgtatatgctttgaagcgccaaggccgtactctctacggatttggtggttaatagaagtttagggtttctagggttcttgtttgacaccagagtttaattcgaagtgatattacttgtaattgaagttcttaatataatatcagatagcaagtcaatttatggtttgaa

SEQ ID NO: 3495 - DNA, 492 bp, Lactuca sativa
gggaacatcatcacttcaatcgtttcagagagaaaaagcaaaagtccagagaaaaaaatgtcaggaagaggaaagggaggcaagggattgggaaagggcggagcaaagcgtcaccgaaaagttctccgagacaacatccaaggtatcacgaagccggcgattcgccgattggcgaggagaggtggagttaagcgtatcagtggccttatatatgaagaaacacgtggtgtgcttaagatctttctagagaacgtcattcgtgacgccgtgacttacaccgagcacgctcgccggaaaactgtcaccgccatggatgtggtttatgctttgaaacgacagggacgtactctttatggatttggaggttaaggtcgtagtgataggtgttttcattgctatttcagtttccagatctacattgtttgttaacatggcgtttgtgataggctatgtatcattgacttatttctcgtaatgcaatgatcgatttat

SEQ ID NO: 3496 - DNA, 479 bp, Lotus japonicus
catattcggtttcctcttaacgaaatcacagagagagagcatcacccaacaacaaccatgtcaggaagaggaaagggaggcaagggtttgggaaagggaggagcgaagcgtcaccggaaggttctgagggataacatccagggaatcaccaagcctgccattcgccgtctcgcaaggcgtggtggtgtgaagcgtatcagcggtctcatctatgaagaaactcgcggtgttctcaagatcttcctcgagaacgttattcgtgatgctgttacctacactgagcacgctcgccgcaagactgtgacggcgatggacgttgtttacgctctcaagaggcagggcaggaccctctatggttttggaggatagaggattggggatttatgtgttttagggtttcgtttagtttcaatttcgctgttgatattgtgtaattgctcttgagcttcaatttaacaatcaatgattattgtttggct

SEQ ID NO: 3497 - DNA, 754 bp, Elaeis guineensis
actagttctctccggaagagttgcactggagcggaaaagggaaggagcttcaagaagatgtcgggacgtggaaagggaggcaagggattggggaagggcggtgcgaagcgccaccgcaaggtgctccgggacaacatccagggcatcaccaagcctgccatccggcgtctcgcacggcgtggcggcgtgaagcgcatcagcggcctcatctacgaggagacgagaggcgtcctcaagatcttcctcgagaacgtcatccgcgacgctgtcacctacaccgagcacgcccgccggaagacggtcaccgccatggacgtcgtctacgccctcaagcgccagggccgcaccctctacggcttcggcggctagggatagcagtcgctctctggcatgtaaaattctagtaatttaggttagggtttttctgttttatgattgggggctcggttgggcttgagatggcatgttcttatggtgtaattgaatgattgcactagaattagggcttcagttgatgtaatcttctagaattcttaatgatagcaagcaactattgctctcaaatatcttgccgtctccccatactcccacttctcgttgcaggcccaattgttatttggatggagtgtctgccaaattctgggtttcttcaatatttctgatgtgagggcggtgtcgacgacggccatattcggtgttcagcatcccctcgctttgcgaaacacgataagaattagtatgttgttatttttag

SEQ ID NO: 3498 - DNA, 508 bp, Secale cereale
caccgctcctccaaccccagttcgctcctcagcagctcgaagaggaccgtcggcgaccatgtccgggcgcggcaagggcggcaaggggctcggcaagggcggcgccaagcgccacaggaaggtgctgcgcgacaacatccagggcatcaccaagccggccatccggaggctcgctcggaggggcggcgtgaagcgcatctccggcctcatctacgaggagacccgcggcgtgctcaagatcttcctcgagaacgtcatacgcgacgccgtcacctacaccgagcacgcccgccgcaagaccgtcaccgccatggacgtcgtctacgcgctcaagcgccagggccgcaccctctacggcttcggcggctaggctcttcctcgcccccatgcagatcccaaaaggctgatgaaattgcgacttgtttagtaccctacttcctctgtagttcgaagtgaatcgtgaaacgaagctattcgcatctggagttggaaatcaaacctgtgtctg

SEQ ID NO: 3499 - DNA, 451 bp, Triphysaria pusilla
cggccgcccgggcaggtcgatattccaatcaacagctaacaagtttcagaagaaaaaaaatgtcaggacgaggcaaaggcggcaagggtttgggaaagggcggtgccaagcgccatcgcaaagtcctccgcgacaacatccaaggcatcaccaagccagccattcgccggttagctcgccgtggcggagttaaacgaatcagcggtttgatctacgaagagactcgcggcgtcctcaagatcttcctagagaacgtcatccgtgacgccgttacctacactgagcacgctcgccgtaagaccgtcactgccatggacgtcgtatatgctcttaagaggcagggccgtactctttacggcttcggcggctgaggtcgtctctagggttagagcttttgttaaatcgaaatgtatgatgtttaattctttcaatgcagtgattaattccaact

SEQ ID NO: 3500 - DNA, 504 bp, Triticum aestivum
gcagctaccacaaagacaagtcaacctcaccgaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccagattagctagcctgtgtctagggttcgtggtcgttgatgtaatcgcagcatctcgctgctgtttgctatcttctgtagaatggaattgaatggaaattcaactagtttatccttgaaaaaaaaaa

SEQ ID NO: 3501 - DNA, 576 bp, Triticum aestivum
aaacttcaacatccacacgagtccttcttctctcaaacaaaaacaaatccagcgacgatgtctgggcgcggcaagggcggcaaggggctgggaaagggcggcgccaagcgccaccggaaggtcctccgcgacaacatccagggcatcaccaagccggcgatccggaggctggccaggaggggcggcgtgaagcgcatctccggcctcatctacgaggagacccgcggcgtcctcaagatcttcctcgagaacgtcatacgcgacgccgtcacctacacggagcacgcccgccgcaagaccgtcaccgccatggacgtcgtctatgccctcaagcgccagggccgcaccctctacggcttcggaggctagattcgtctagtggtgccagtagtggggcaacttcctcgtttgctctgtgtcatgtgttgtgtggtagatgggatttactgctttggcgtgcgtcgttgtgctctgtcttgggttcagtaggctgtgtaatacccaaagtatgttgtgttcaatgaaatcagttcaattctaaatcatgacgaaatgcttcactgttgaaaaaaaaaa

SEQ ID NO: 3502 - DNA, 567 bp, Triticum aestivum
aggaattcggcacgaggtcttcccaatcacacacctgtcggagctaaccggagcggcgatgtcggggcgcggcaagggcggcaaagggctgggcaagggcggcgccaagcggcaccggaaggtgctccgcgacaacatccagggcatcaccaagccggcgatccggaggctggccaggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggttcctgggttccgttggtggcagcagcagtgtggttgcggctgtgtctgtcttgtgccctctgtgatgtgtgctgtgggagatgggatttactgctgctttggcgtgcgtcgttgtgttccgtgtcttgtgttcagtaggctgtaatatcttgttgcggtcaatgaaactagttctgttctgaaaaaaaaaaaaaa

SEQ ID NO: 3503 - DNA, 652 bp, Triticum aestivum
  misc_feature (651)..(652): n is a, c, g, or t
gcaacaaccaccaccaccagcaacaaagccaagctcgccggagagggaatcgtcgaggatgtccggccgcggcaagggagggaaggggctgggcaagggcggcgccaagcgccaccggaaggtgctccgcgacaacatccagggcatcaccaagccggcgatccggcggctggcgcggcggggcggcgtgaagcgcatctcggggctcatctacgaggagacccgcggcgtgctcaagatcttcctggagaacgtcatccgcgacgccgtcacctacacggagcacgcccgccgcaagaccgtcaccgccatggacgtcgtctacgccctcaagcgccagggacgcactctctacgggttcggcggctaggccgcgcgaatcgatccccccaccaccagatttgtgcgcggctgtgtagtgttcatgggcttcggtgtaatggccgcatctcgctgctgtatgtcttggccttgactgttgtttggatgtagttctgagatggaattgaaattgaagcagcttacccttgaattcttctccaatctctcactctgttgatgctgatttgtgtgagcagttagaaattactaatttcccactctgtaatttacccctgaattactagtttacccttgaattcttctgcaaann

SEQ ID NO: 3504 - DNA, 606 bp, Triticum aestivum
  misc_feature (595)..(595): n is a, c, g, or t
acctcgcccaccacccgccgcaacaaccaccagcagcaacacacacacagcagcgaagatgtccggccgcggcaagggagggaaggggctgggcaagggcggcgccaagcgccaccggaaggtgctccgcgacaacatccagggcatcaccaagccggccatccggcggctggcgcgacggggcggcgtgaagcgcatctcggggctcatctacgaggagacccggggcgtgctcaagatcttcctggagaacgtcatccgcgacgccgtcacctacaccgagcacgcccgccgcaagaccgtcaccgccatggacgtcgtctacgcgctcaagcgccagggccgcactctctacggattcggcggctgacctgcgccctctgctccaatctccatcgactctgactctgctagctgctgctgctgttctggtgctgtggtttcgtttctgaattcagagtgcgtgcgttgttgttccgtcggtctgtgtagttagtggatggcgatggatctgaatgcagttagttcgtcagagtgcgtgtgttgtctgtggaaggagataaatatgaatgcaatgggattgttggtttcttcnaaaaaaaaaaa

SEQ ID NO: 3505 - DNA, 534 bp, Triticum aestivum
gcgctcctcgacctcctccatccgcccgcagctcgagccaagaagagatcgtcagccatgtctggccgcggcaagggaggcaaggggctcggcaagggcggcgctaagcgccacaggaaggtgctgcgcgacaacatccagggcatcaccaagcccgccatccgccgcctggctcggaggggcggcgtgaagcgcatctcggggctcatctacgaggagacccgtggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctcttcctcgccccccctgcagatcccaaaagttggatgacaccgcgacttgtgtagttctctgtttgctctgtagttcgaactgtatcgtggaacaaagtggttcgcatgtgttgctggaaatcaaacctgtcccagtgaaataccgtgtctctgattttgtc

SEQ ID NO: 3506 - DNA, 619 bp, Triticum aestivum
accaaccaaattccccaccaccaaatcctccaccggcgaccgacctcaacagccagcaatgtcggggcgcggcaagggaggcaaggggctgggcaagggcggcgccaagcgccaccggaaggtgctgcgcgacaacatccagggcatcaccaagccggcgatccggcgtctcgcgcgcaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacaggggcgcaccctctacggattcggcggctgatcccatggtctccggtcgtgtcctcttcgtctggtgttagcgagccatggtttgttgttggtgtctcgggtgcgtgtgttcgtactgtgtagttgttggaaggcgatgaatatgaatcaatggaatcgttgttcgggcaagctttctgaagattttgattgtctaccattgtgatttaacagagtatcttctgaatatatcggattggaggaagcaaatggttgcgtgttttttatttgcttctacccc

SEQ ID NO: 3507 - DNA, 598 bp, Triticum aestivum
tcggcacgaggcaccgttcctcccatcccacactcgctcgcagctcgagatcgtcggccatgtccgggcgcggcaagggaggcaagggcctaggcaagggcggcgccaagcgccaccggaaggtcctccgcgataacatccagggcatcaccaagccggcgatccggcggctggcgcggcggggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtcgtctacgcgctcaagcgccagggccgcaccctctacggcttcggcggctaagggccggccggccgacgggagtcactctttgtcgccgcctgcagattccagaagcctgatgaagccccgacttgtttagttcgctatttcctctgtagtttgaactcaatcgtggaacaaagttattcgcatatattgttggaaatgaagcttgtctgttgtctctgtgctgataccctgtttctgattttgtctcgctggttggtctctgttgggtacgatcttga

SEQ ID NO: 3508 - DNA, 627 bp, Triticum aestivum
caccacccctccccccaatcccactcgcgcagcagctccaagaggatcgtcggcgaccatgtccggccgcggcaagggaggcaaggggctcggcaagggcggcgcgaagcgccacaggaaggtgctgcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgcgacgccgtcacctacaccgagcacgcacgccggaagaccgtcaccgccatggacgtcgtgtacgcgctcaagcgccagggccgcaccctctacggcttcggcggctaggccgctggcccccgccagacggtcgtcagtcttcgtcgccacctgcagattccgatgtgttagtccgcccgttcctagtagtgttgcgctcaagaaatctcagatggaaaccgccttgtttccccatttcctctgtatgtttagctgaatcatggaattatgtaatgaagatgtttgcatccagagttcgaactgaaacctgcatcccttgtcttgaattctgtgcaaatgctgcgttcctctccttttttgtgaaa

SEQ ID NO: 3509 - DNA, 571 bp, Triticum aestivum
cggcacgaggcaacaaccaccaccagcaacagccaagccaagctcgccggagagagaggatgtcgggccgcggcaagggagggaaggggctgggcaagggcggcgccaagcgtcaccggaaggtgctccgcgacaacatccagggcatcaccaagccggccatccgccgtcttgcccgcaggggcggcgtgaagcgcatctcggggctcatctacgaggagacccggggcgtgctcaagatcttcctggagaacgtcatccgcgacgccgtcacctacacggagcacgcccgccgcaagaccgtcaccgccatggacgtcgtctacgccctcaagcgccagggacgcaccctctacggattcggcggctaggccgcgcgaatcgatccccccaccaccagatttgtgctcgtagctagctatggctgtgtagtgttcatgggcttcggtgtattggccgcatctcgctgctgtatgtcctcctggcctcgattgttgtttggatgtagtcctgggatgtttacccttgaattcttctgcaatctctcactctgttcatgttgatttgtgtg

SEQ ID NO: 3510 - DNA, 431 bp, Triticum aestivum
  misc_feature (416)..(416): n is a, c, g, or t
  misc_feature (418)..(418): n is a, c, g, or t
cgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctagttaagtgtgggtaaatgcctgtccaagtgtctcggatctgtggtacnanttggctgccttcc

SEQ ID NO: 3511 - DNA, 620 bp, Triticum aestivum
agccaccaccgttcctccgattccaccacatccgctcgcagctcgagatcgtcagccatgtccgggcgcggcaagggaggcaaggggctcggcaagggcggtgccaagcgccacaggaaggttctgcgcgacaacatccagggcatcaccaagccggcgatccggcggctggcgcggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctatggcttcggcggctaggccaccaccggatagtcgttgtttggtacagtactagcagtgttcgtggtcctcgggtctgaaaaatcgccgcatctcgctgctgtttgccctggccctgtttgttgtctggatgtactaggatggaatggaaattgcagcagtttacccttgaattcgtccctgatatgtggatctgttgatgtttgttcatgcgcgtggtctgatattaccagtgcgttcttcagttgtcttgctctgtaaaaaaaaaa

SEQ ID NO: 3512 - DNA, 528 bp, Brassica oleracea
  misc_feature (309)..(309): n is a, c, g, or t
  misc_feature (474)..(474): n is a, c, g, or t
gatctgaatctaaaactcaaaccatctaaatctcgagaaagtttccagaaaataatgtcgggaagaggaaagggaggaaagggattgggcaaaggaggggcgaagaggcacaggaaggttctgagagacaacatccaaggaatcaccaagcctgcgattaggcgtctcgctcgtagaggaggcgtgaagagaatcagcgggctgatctacgaggagaccagaggagttctgaagatctttctcgagaatgtgatcagagacgccgtgacgtacacggagcacgcgaggaggaagacggtaacggcgatngacgttgtttatgctttgaagaggcaagggcgcactctctatggattcggtggttaaaaccggtttagatttcggttttgtttctgggtgctacttattaagtcttgctgtcaagaaatctagtaggttttaggctttatcactcctttgctggtttttttcttngtttgtgtaatttctcttttggggatttataaaaaatcaattattcagttctcg

SEQ ID NO: 3513 - DNA, 516 bp, Nicotiana benthamiana
ggggatctcaaatcaaattctattttcttttcagttcaattactttaccaacaaaatgtcaggccgtggaaagggaggcaagggtttgggaaagggtggagcaaaacgacaccgaaaggttctccgtgataatattcagggaatcactaagccagctattcgtcgattggctcgtaggggtggagtgaagagaatcagcgggctgatttatgaagaaacaagaggagttctgaagatttttttggagaatgtgattcgtgatgctgtgacttacactgagcacgccagaagaaagactgttactgcaatggatgttgtttattcattgaagagacaaggcaggaccctctacggatttggtggttgatttatgtattttaggttttttaaggggaaatggagctcagttggtgtttaaaagttgtattgttaatgaaggttattaggtcattgtaacgagttatttgtgttaatgtaatggatctcattagtgtttcagatataattcttgcttct

SEQ ID NO: 3514 - DNA, 794 bp, Picea glauca
  misc_feature (468)..(468): n is a, c, g, or t
atcgcaattcttcacttatctttttatcatttggttcattgcagagaaaggaagaatgtctggccgtggaaagggagggaagggcttggggaaaggaggtgccaagaggcacaggaaggttctcagagataacattcagggcattactaaacccgccatcaggcgtctggccaggaggggaggagtcaagcgcatcagtggcctcatctatgaggagaccagaggcgtcctcaagatcttcttggagaatgtgatcagagatgccgtgacatatacagagcacgccagaagaaagaccgtgacagccatggatgtcgtctattccctaaagaggcagggccgaacactctatggtttcggaggctgaggagtctctctgtagctcattatttctcttggccatcaatcatttattcgttcatggtgtttttcgacaccaccctctgtctctttgggagattgtgaccntcgttctacccgctgattgtatactgcggtgcttttctttgaggtctgcatatgtgggttgttggtaggccggttattgtctgttcaggcgtttttgcttttttcaatgagcgtgctttactgttttgcattgttgactttagcatgattggctttgggaatactttggccctgtgttattggacttaacataagtgttccatgttgtctcctgtcataagccttttatagcagcttgtgtattggtagcaactttttgaacatttatacaaaagtccagtctggaagcattcaaagaatttcaaaatcatttttgaggtaaaaaa

SEQ ID NO: 3515 - DNA, 612 bp, Picea glauca
atcgtcatcattcattttcattgtctgagggcaggacaagaatcgttaacaaggatgtctggacgtggaaagggcgggaagggtttggggaagggaggagctaaaagacacaggaaagttctcagagataacattcagggcatcaccaagcctgccatccggcgtctcgcaagaagaggaggcgttaagcgtatcagtggcctcatctatgaagagacgagaggcgtcttgaagattttcctggagaatgtcatcagagatgcggtgacatacacagagcacgccaggagaaagaccgtgacagctatggatgtcgtatactcattgaagaggcagggccgaaccctctacggattcggaggctgagaagtctccgtctgactgttaatcatatttcttaatgctcatcatggtgtgtttccaccaatctccttttcacgtcactatatgtaatagcagatcaggttgtgagcactgtgttttgggctgttaatagaattgccaacattgttagtaatggcgttattttcagctgctgtaactgaaaatgcttctaactcagggtgtggaaattttggtcaataaatgaaagttctctttggtcctaaaaaa

SEQ ID NO: 3516 - DNA, 568 bp, Picea glauca
gagggacaggcattcatcattttatttttgtgattgaaagcagggcagaagtaagtatgtctgggcgtggaaagggaggcaagggtctggggaagggaggggccaagaggcacagaaaagtgctgagagataacattcagggcatcaccaagcctgctatcaggcgtctcgctaggagaggaggcgtcaagcgcatcagcgggctcatctatgaagagaccagaggcgtcttgaagatcttcttggagaacgtcattagagatgcagtgacatacacagaacacgccaggagaaagaccgtcacggccatggatgtcgtctactccctcaagaggcaaggccgaaccctctacggcttcggaggctgatcgttatttttctcggcaattaatcactcacccattcatggtgtctgttgacaccaccctttgcctctttgggatattgtagcctccttctcacttgcgaatatctaatgtgccgcttccctgggaagtctgcatatgcaaattgtgaatttctcgaattgtttctgttatctactttaatttagcaattctgcaaaaaa

SEQ ID NO: 3517 - DNA, 610 bp, Zea mays
cactcgtctcatctcttccatacgaccataccctacctccaaattcccaattctcaacctctcctccgagttcgagtgaccatgtcggggcgcggaaagggcgggaaggggctgggcaagggcggcgcgaagcgtcaccgcaaggtcctccgcgacaacatccagggcgttacgaagccggcgatccggaggctggcgagaaggggtggcgtgaagcgcatctcggggctcatctacgaggagacccgcggcgtgctcaagatcttcctcgagaacgtcattcgcgacgctgtcacctacacggagcacgtccgccgcaagacccccaccgcaatgcacgtcgtctacacgctcaagcggcaggtccgcaccctctacggattttggcggctgaagggtcaggggggtcccccagctgcctgacggtacgttgcacaaacccctgggtccgaggcccccaaaatggaaagaaggcgagagttctatcttgcccatagagccttaatttccataagacttataccctcctaaaactcctagtgccctttggtccaccgatagaaccctcaccaactttggaaccggcaatttccctatggatcatgaaaac

SEQ ID NO: 3518 - DNA, 445 bp, Mimulus guttatus
atatattcattccattaattagttaattagaaattcatctcaccgcccaccaactgtttgataaaaatccacactgagaaaaaaaaaaatgtctggaagaggcaaaggaggaaaggggctgggcaagggcggagcaaagaggcacagaaaggtgctccgcgacaacatccaagggatcaccaagcccgccatccgccgcctggccagaaggggcggcgtcaagcgaatctccgggctgatctacgaggagacacgtggcgtcctcaagatctttttggagaacgtgatccgtgatgctgtgacgtacaccgagcacgctaggaggaagactgttactgccatggatgttgtttatgctctgaagagacaggggagaaccttaataataattggtattattaatataataatacaggcaaaatgtctatatgatttgcaattttag

SEQ ID NO: 3519 - DNA, 502 bp, Carthamus tinctorius
tatacattatataggaagagagagagagagagaaagtctgaaaatgtctggaagaggaaagggaggcaagggattgggaaagggaggggccaagcgtcatcggagagttctccgtgacaacatccaggggatcacgaagccggcgatccggcgtctggggaggcgtggtggcgtcaagcgtatcatcggtctgatctacgaggagaccagaggcgtgttgaagatcttcctccaaaacgtcatccgtgacgccataacctacaccgagcacgctcgccggaagaccgtcaccgccatggacgtcgtctatgccttgaagcgtcaaggccgtacgctgtacggatttggtggttaaggtaatctagggttaggttgtggtgtttacgtttaggattttgttagtttgtgtagagatttgtggtatatcactgtaacggaaagctcgattgggatttgaaatgaaatttggttccatttccgtgcaaagaaaaaaaaaagaaag

SEQ ID NO: 3520 - DNA, 600 bp, Brassica juncea
acaattcaactctaacttcgattcttatttcagcatcaaaactttctcaatcgaaaaaaaaatgtcgggccgtggaaagggaggaaagggtttaggcaaaggaggagccaagcgtcacaggaaggtattgagagacaacatccagggaatcaccaagccggcgattcggagattggctcgtagaggtggagtcaagcgtatcagtggtctcatctatgaggagacacgtggagttctcaagatctttttggagaacgttatccgcgacgccgtcacttacaccgagcacgccaggaggaagacggtgaccgccatggatgtcgtctatgctctgaagaggcaagggaggactctctacgggttcggcggttaagggtcttcttagattcgcgtttgcgtttcgtgtttcttttccggaaatttccaatcaaatcatgttctatttagcgtttgcgtttgcgtttgcgtttgggtacgccgtttatgtgttgcggtagcgtttcgttttatatgtaattacgcctttcattttatgtctaatcgatgcaatgtcaaagcacaagtttctggagaaagataattcgaattttattttccaga

SEQ ID NO: 3521 - DNA, 521 bp, Brassica juncea
tacgcggggacacacaacagtcttcaaaactctctcttacattcaaaagcaaagaaaaaaatgtctggacgaggcaaaggaggaaagggactgggaaagggaggagccaagaggcacaggaaggtcctccgcgacaacatccaggggatcaccaagcctgcgattcgtcgtttagcgaggagaggcggtgtgaagcgtatcagcggtttgatctacgaggagactcgcggcgttctcaagatcttcctcgagaacgtgattcgtgacgctgtgacttacactgagcacgctaggaggaagactgtgacggcgatggatgttgtgtatgctttgaagaggcagggaaggactctgtacgggttcggcggctgaggggattgaattagggatttgtaaatcgcgtttgttgtttttagggtttggttaatttggggagattaagatctctataagctgtctgaagggttttatctgaatgtttttagttgtttttaattgaatgaaaaaaagcttttatctag

SEQ ID NO: 3522 - DNA, 587 bp, Brassica rapa
gacaattcaactctaacttcgattcttattcagcatcaaacttgctcaatcggaaaaaaaatgtcgggtcgtggaaagggaggaaagggtttgggcaaaggaggagccaagcgtcacaggaaggttctgagagacaacatccaagggatcaccaagccggcgattcggagattggctcgtagaggtggagtcaagcgtatcagtggtctcatctacgaggagacacgtggcgtcctcaagatctttttggagaacgttattcgtgacgctgttacctacaccgagcacgctaggaggaagacggtgaccgccatggacgtcgtctatgctctgaagaggcaagggaggactctctacgggttcggcggctaagggttttcttagattcgcgtttgcgtttctgggtttcttttatggaaatttctagacaaatcatgttcgagtttgcgtttgaattatgtttgggtaaggcgtttatgtgttgcggtagcgtttcgttttatatgtaattacgccttttatcttatgtttttagcgatgcaatgttgaagtgatccaatgtcaagaaatatattcgagttttattt

SEQ ID NO: 3523 - DNA, 497 bp, Brassica rapa
gacaaactgaatctattactctagttatcttctttgattccagagaaagtttccaaagaaaaatgtcaggaagaggaaagggaggaaagggattgggaaaaggaggagcgaagagacacaggaaagttctgagagacaacatccaaggaattaccaagcctgcgatcaggcgtcttgctcgcagaggaggcgttaagcgaatcagcggtttgatctacgaagaaacgagaggagttctgaagatctttctcgagaatgtgatcagagacgccgtcacttacaccgagcacgcgaggaggaagacggtgacggcaatggatgtggtttatgctttgaagagacaaggacgtactctctacggattcggtggttgaatcgttttcgatttgttgtgttgttgctactattattaagtcttgcggtctagaaatttagctttaattgcagtgttgtaacgaagttcttctctttatcggttaatggaaatatgattaatc

SEQ ID NO: 3524 - DNA, 521 bp, Gossypium hirsutum
aaatttccaatttcaccatccaaatcattcaagtttcttaattttcattcgatatcgaagatgtcaggaagaggaaagggaggcaagggacttggcaagggaggagcgaagcgccaccgtaaggtcctccgtgacaacatccagggcatcacaaagccggcaattcgacgcttggcccgtaggggaggagtcaaacgtatcagtggcttaatctacgaggaaacccgtggagttctcaagatcttcttggagaacgtcattcgcgatgctgtcacctacaccgaacatgccaggaggaagacggtgaccgccatggatgtggtttatgctctgaagaggcagggtaggactttgtatggatttggcggttagtcgatttagggtttaggtttgtaattaggggaatcctttagggcttaatcgaaactacaagttgggtcttgttgttcgatgttatgatttgtagcccgtgctatcaatttcatattttattggaatatgaagaatttttttagtgtctg

SEQ ID NO: 3525 - DNA, 1419 bp, Gossypium hirsutum
  misc_feature (520)..(523): n is a, c, g, or t
aagttttccaatttcgttatccaaatcattcaagtttcttaattttcattcgatatcgaagatgtcgggaaggggaaagggaggtaaaggacttggcaagggaggagcgaagcgccaccgtaaggtcctccgtgacaacatccagggcatcacgaagccggcaattcgacgtttggctcgtaggggaggagtgaaacgtatcagtggcttaatctacgaggaaacccgtggagtcctcaagatcttcttggagaacgtcattcgcgatgctgtcacctacaccgaacacgctaggagaaagacggtgaccgccatggatgtggtttatgcactgaagaggcagggcaggactttgtatggatttggcggttagatgatttagggtttaggtttgtaattagaggagctttggtaatgtttagtcgaaataacaggttgggtctagttgttcgatgttgtgatttgtaacccgtgctatcaattgcatatttgattgaaatttgaatatcattttgccaannnnaaaaaaaaaaactggagctttgacacagctgctatttcttttttgtgggtttcagcatcagcttgtatttggaataatggtgaggctgagcgttttgaatgatgcactcaagagcatgtacaagtgcagagaagagggggcaaactacaggtcatgatcctaccgtcctcgaaggtgatcattaaattccttttggtcatgcccaaacatggttatattgggggagtttgagtatgttgatgatcatagacctggcaaaattgtggttgaattgactgggaagctgaccaagagtggcggtgattgtcctacttttgatgtcggagtaaacgagattgaaggttggactgcttctttgcttccttaaaaatttttgttaaattgtgttcacacatcccttgggattatgggccaataatgcccccacaaaaataaatgggtgggtggtaaaattacttgggatttttgacttcaaaatttcccttttttgtttttttaattcgagtaaaaattataaaaagggcgccttttttgggttccattcatatagggtatataaaagtttttgttttcccaatttgaaattgtttggttgggaaaaaaaatttttttttcttttgaaaatttccaaaaaaaaaaaaaaaaaaaaaaaatttgagaggccttttctcacactggctcccggggccccactaatttttcccccccgggggggggggataccagtcaaaaacctacccccaattttcccccttttcagggagtaatgaattttaaaatactgggtggccccccgtttttaaaaaaagtatctgccaagggaaaaaaaccccctgttccccttcccaccccctcctgtctctccttcggtgggaggaaacaattttctctctttt

SEQ ID NO: 3526 - DNA, 548 bp, Gossypium hirsutum
tttcacgcgtccgaaaaattcccaattttctgtgacaaaagagctcttcgatttttcaaaaatgtcgggccgtggaaaaggaggcaagggattaggaaagggaggagctaagaggcataggaaggttctccgagataacattcagggcatcaccaagccggcgattcggagattagctcgtagaggcggcgtgaagaggattagtggcttgatctacgaggaaactcgtggtgttctcaagatcttccttgaaaacgttatacgtgatgccgtaacctatacggagcacgctaggcgtaagactgttaccgctatggatgtcgtttatgctctcaagagacaaggaaggactctttacggtttcggtggttgattttggattttagggtttctattttgtaacagtttcttgtaggcttttttttcttggattttctctttagtttaatgtattttcgtttcgaattacgatgaatttctctgaaaatctcgtttcaaaagctaatttggttttggtttttgaatctcagttctaaaatatttagggg

SEQ ID NO: 3527 - DNA, 732 bp, Vigna unguiculata
gccaagttgtttgcttgcatattcagttctgtgtcagagaagaaagaaaaatcgtcagccatgtctggaagaggaaagggtggcaaggggctcggaaagggaggtgccaaacgacaccgtaaggttctgagggataacattcagggaatcaccaagcccgctattcgccgtcttgctagacgtggtggtgttaaacgtatcagtggtctcatctacgaagaaacccgtggtgttctcaagatctttctcgagaacgtgattcgcgacgctgtcacctacaccgagcatgctcgccgcaagaccgtcaccgccatggacgttgtctacgccctcaagaggcaaggcaggaccctctacggtttcggtggttagagaattggggatttcttcgatgctttggaaattagggtttcttataatttaaatttctctgtcgatattgtttagggtttcgaggattgttcttgtttggcttcgactcgtagctgagaaattgtcaatgtgaatcagaatgaattgaaatttttcaggaaatttcattttgcgtatctttgttttcttgtttctttgcctgcgctaaattaaaaattaaaagcattcatttaactctcgacagtttcttgatatttgttgaacgatgcagctagtttttgaagtgtttctggctgtgatgttattgaattaaatattggctttacgctgttgttgaggtatgaatgacataattaggct

SEQ ID NO: 3528 - DNA, 587 bp, Festuca arundinacea
ggcacgaggccgattccagccgctcgccgctcgaagctcgaagcaaagccagatcgtcagccatgtcggggcgcggcaagggaggcaaggggctgggcaagggcggcgccaagcgccaccgcaaggtcctgcgcgacaacatccagggcatcaccaagccggcgatccggcgccttgctcgccgtggcggtgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgccctcaagcgccagggacgcaccctctacggcttcggcggctaggaggaccctgacgttccgtggcttctgtctgcccgtgctcactagcccgtgggtcaagaaagcttagatggaatgaattctgccttgtttagttcgctgtttccttagtagatcgagctgtaatttggaagtcgtgggacaaagttgtttcgtagctgaagttcggattcagtattgtttctgtgccaatactgtgcttctgttgtgtctgac

SEQ ID NO: 3529 - DNA, 584 bp, Zingiber officinale
  misc_feature (499)..(499): n is a, c, g, or t
aagtttcgcagatctcgcagccttcagaaatcagtagatcgatcgctcgattcggcggcgatgtctggaagagggaagggcggcaagggattgggcaagggcggcgcgaagcgccaccgcaaagtgcttcgcgacaacatccagggcatcaccaagccggcgatccggcgcctggcaaggaggggcggcgtgaagcgcatcagcggcctgatctacgaggagacgcgcggcgtcctcaagatcttcctcgagaatgtgatccgtgacgccgtgacctacacggagcacgcccggaggaagaccgtcaccgccatggacgtcgtctatgcgctgaagaggcagggaaggactctctatgggttcggtggttaatcagacatgcctatttactggaaatcttacaaagtagttagattgttgttagaatcgatgtgtaatgtgtgtggagtttgatcgtgctgcctgatattactaatctgagttcttagatttccagaantagatttaaatatcatttaagcgactttataatgtattttcaattatcaagcaagtaatatcaaagttgcttaaccctaaaaaaa

SEQ ID NO: 3530 - DNA, 584 bp, Ipomoea nil
cggcaatcaaaaatcttcgaagttcagatttccttagcttagaagagaagtactttctgaagatgtctgggcgtggaaagggcggtaagggtttgggaaagggaggagcgaaacgacaccgtaaggtcctccgggacaacatccaaggcatcacgaagccggccattcgccgtctggctcgccgtggtggagtgaagcgtatctccggtctcatctacgaggagactcgcggcgtcctcaagatcttccttgagaatgtcatccgcgatgctgttacctacaccgagcacgctcgccggaagacggtcaccgcaatggacgtcgtctatgctctcaagagacagggccgcaccctgtacggattcggcggttagcttttcttatcggcggtgtatattttggtgttctattctgaatcaatctcagatttattgtgacaatgttactctgatttcaattcaatgaatttcagttcttatgaattctcaattttcttaattttatatcttctatttgactcttcgttgcaattcgtaatatttgtaaaatggtttatgaaaagtttgttcaaaggaaaaaaaaaa

SEQ ID NO: 3531 - DNA, 563 bp, Lactuca sativa
gatctcactcctcactcaatcacaactcaaattcagcatctaaccttgagcttgtttcaacaatgtcgggacgtggaaagggaggcaagggactcggaaagggaggagcaaagcgacacaggaaggttctccgtgataacatccagggaatcaccaaacccgccatccgaagattggctcgtcgaggaggtgtcaagcgtatcagtggcttgatctatgaagagactcgtggtgttctcaagatctttcttgagaatgtcatcagagatgctgtaacctacaccgagcacgctcgccgcaaaactgttactgcaatggatgtcgtctatgctttgaaacgacagggccgtaccctatatgggtttggtggttaggtctagggttttggttgtgtggtagtgtgtattcactgtagatcgtatctaatttccccttcgttgtatcctgtttcaatatcgttgacataccccatctcggggtttgaatttatgttatgaaatccctctattttctataatcgtctgagtttcatcatctgaatctataagctttgaattattacc

SEQ ID NO: 3532 - DNA, 583 bp, Raphanus sativus
  misc_feature (205)..(205): n is a, c, g, or t
  misc_feature (374)..(374): n is a, c, g, or t
ggacacatcaaaaacacacaaagcgaatctcaattttaaaaactttccggagaaaaggaaaatgtctgggcgaggaaagggaggaaagggtttgggaaagggaggagccaagaggcacaggaaggttctccgcgacaacatccagggcatcacgaagcctgcgattcgccgtttagcgagaagaggtggcgtcaagcgtatcagnggcttgatctacgaggagactcgcggtgttctcaagatctttctcgagaatgtgatccgtgacgctgttacttacactgagcacgctcgtaggaagacggtgacggcgatggatgttgtctacgcgttgaagaggcagggacggactttgtatggattcggcggttgangggatgagattggcgtttgtaaatcgcgtttggtctttagggtttgttttgatttctattaagctgcttttagggtttcgttttagaatgtttcaccggtttgaatttaatgaaacgcttctttttatctttttgcttctgcaaaattgtcggtattgttaaagctgaatcttcgtgttaactaagaacaaattaaacaacttcgcatc

SEQ ID NO: 3533 - DNA, 553 bp, Raphanus sativus
atatcgtcaatcgcattttgctatcctctccgttccattattcagagcttaggaatcaagatatgtcgggaagaggaaagggaggaaagggattgggaaagggaggagcgaagaggcacaggaaggtgcttagggataacatccaaggcatcaccaagcctgccattcgtcgtcttgctcgcagaggtggtgtcaagcgtataagcggcctcatttacgaagagacccgaggagtcctcaagatctttctcgagaatgtcatccgtgacgccgtcacctacacggagcacgctaggaggaagactgttactgctatggatgttgtctatgctttgaagaggcaaggacgcactctgtacggattcggcggttaatcgaacggttgagattttagcaggagacggaattagtgtgttgtttctgttatcatccacttgtttagtagtaaaaagtaaaacaaggagctgtgtcttgttaagccaatttgatgttccatgtagctagctaaaattcagcaatctctgattggattcttaaattaaaattctgtttg

SEQ ID NO: 3534 - DNA, 683 bp, Helianthus annuus
  misc_feature (20)..(20): n is a, c, g, or t
  misc_feature (33)..(33): n is a, c, g, or t
  misc_feature (35)..(35): n is a, c, g, or t
  misc_feature (49)..(49): n is a, c, g, or t
  misc_feature (174)..(174): n is a, c, g, or t
  misc_feature (486)..(486): n is a, c, g, or t
gcggggacactcttctcttncaatcctttgaantnaacaatccttcaancaaatttcaaaatgtctggacgtggaaagggaggaaaggggttgggaaagggaggagcaaagcgtcaccggaaagttctccgggataacattcagggtatcaccaaacctgcaatcaggaggctngctagaagaggtggagtcaagagaatcagtggtctcatttatgaagagacacgtggcgttttgaagatatttttggagaatgtgattcgtgatgctgttacctacacggagcacgctcgccggaagacggtgacagcgatggatgttgtgtatgcattgaagaggcagggaaggactttgtatggttttgggggttaattgatttctgtcaacaatttgtaatgaatcatgttatcgttgaacaatttggcgtcgaatgttgtaaatcatgaaaagttgcaatgattttggtggaatgaaagttagttgttnacattgttctccggaaaaaaaatatatacacacacagaggtttgtttcagatttcaaaatatcacaagttgtatacacttgggatatatgattaaatttgcgtactcctaaatgctaaatgtaccactttttctacgtacccctcttttgactttcacattattacaattcaaagtcttttctttttgttttgctac

SEQ ID NO: 3535 - DNA, 640 bp, Helianthus annuus
  misc_feature (507)..(507): n is a, c, g, or t
ggccggggacacccaaaaaccaaaaccccaatcccaaatctcatctccaccgttgagaaaaatgtcaggacgcggaaagggaggaaaagggttaggaaagggcggagcaaagcgtcacaggaaggttctcagagacaacattcaggggatcacgaagccagcgattcgaagactggctcgtagaggcggagtgaagcggatcagtgggttgatatacgaagagacacgtggagtgttgaagatatttctagagaatgttattagagatgctgttacctacaccgagcatgccaggaggaagactgttactgctatggacgtggtttatgcgttgaagaggcagggtaggactttgtacggatttggcgggtaaattggggaatggaagtagttgttttaggctatgtattttgttttgtgttgtgttgaatttcagtgaatcctatctcagggtttgtgggtattatgatgttgttttggacacttttaatacaagtttcggttgcngaaaaaaaaaaaaaataaaacttaatcatgtttggccgctcttggcccagtctacttttattactcgatcaagctttatgcttgcgcgcccgcaattgaagcttcattgggccaatttctccttataggggag

SEQ ID NO: 3536 - DNA, 564 bp, Triticum aestivum
caccactcctccaatccgacaatttctcgcagctcgaaccaaggcgagttcgtcggcgaccatgtccgggcgcggcaagggaggcaaggggctcggcaagggcggcgccaagcgccacaggaaggtgctccgcgacaacatccagggcatcaccaagccggcgatccggcgcctcgctcggaggggcggcgtgaagcgcatctcggggctcatctacgaggagacccgcggcgtcctcaagatcttcctcgagaacgtcatccgcgacgccgtcacctacaccgagcacgcacgccgcaagaccgtcaccgccatggacgtcgtctacgcgctcaagcgccagggccgcaccctctacggcttcggcggataggcccctcgtggtcgtcaatcttcgttgcccccctgcagattcctaaagctcgatgagaacctgacttgtttagttcgctatttcccctgtagttccaagtgaatcatgaaacaaagctattcgcatctggagtttggaaattgtacttgtctttgtgcaaataaactgtttgtgattttgtctcgctggtt

SEQ ID NO: 3537 - DNA, 633 bp, Triticum aestivum
ctgcaggaattcggcacgagccacagctcctcctccatttccatctcagtcaaactccaagatgtccggccgcggcaagggagggaagggcctcggcaagggcggcgccaagcgccaccggaaggttctccgcgacaacatccagggcatcaccaagccggcgatccggcggctggcgcggcggggcggcgtgaagcgcatctcggggctcatctacgaggagacccgcggcgtgctcaagatcttcctggagaacgtcatccgggacgccgtcacctacaccgagcacgcccgccgcaagaccgtcaccgccatggacgtcgtctacgcgctcaagcgacaaggacgcaccctctacggattcggcggctgacctgcgcccgctgctgctccatcgagtcgactctgctgcatgctgctgttcctctgctatgcgtttcgtttctgagtgcgtgcgttgctgttccatctgtctgtgtagttagtggaaggcgatggatctgaatgcaatcgaaattgttggctatgattgtaccgcgtctcgctatgattgtataccttctggcttgttcctgtacattctaaaatttatcagcaagaacgtcgatgttgactctttcagtaaaaaaaaaa

SEQ ID NO: 3538 - DNA, 628 bp, Triticum aestivum
ccagccaccaagccccgctccaaaatccccaaatcccctctcttcccaagctactcagccatgtcggggcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgaagagccgcggcgctggctggccggccgtggcgcacaaaacctggctcgcggtcaagaaggtggaggagtggagaaaactgtacttgatttgggttccatgccttctatgattagtagtgatatatctgtagtggcagtagctggttgttcgatggttgcttcagtgttctgaatttctgatggacaaacactgtgtttgccgagttatatgaatccagagttaacaaaattgtcctagaactatgaattattgcta

SEQ ID NO: 3539 - DNA, 722 bp, Triticum aestivum
  misc_feature (704)..(704): n is a, c, g, or t
gaaaccagcagccgccgccgccacagctcctcctccatttccatctcagtcagctccaagatgtccggccgcggcaagggagggaaggggctgggcaagggcggcgccaagcgccaccggaaggtgctccgggacaacatccagggcatcaccaagccggccatccgccgtctggcgcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggacgcaccctctacggattcggcggctaggccgcgctggtccaggccaggaggatccgtcttgcaccaccggattagtgctagtagctacgcgttgtctggtggtggtgttcatggcctcggtgtaatggctgcatctcgctgttgttcgcgctggacttgtttgttgtttgggtgtacagcattttacccctgaattcgtatggaatctgtggctctgtcgatgtttgttcgtgcgtgcggtcagatattaccagtgctttcttcaatccccattgcctcgatcatcgaaaaaaatccccattgcctcgttttgtaaatttctgcccccaaatcctgtttgtgtggcttcagtgtttgcngattctcaaaccaaatct

SEQ ID NO: 3540 - DNA, 524 bp, Triticum aestivum
ccacgcgtcccactgttcctccgattccacatctgctcgcagctcgaagaggatcgtcagccatgtccggccgcggcaagggaggcaaggggctcggcaagggcggcgccaagcgccaccggaaggtcctgcgcgacaacatccagggcatcaccaagccggcgatccggcggctggcgcggaggggcggcgtgaagcgcatctcggggctcatctacgaggagacccgcggcgtgctcaagatcttcctcgagaacgtcatccgcgacgccgtcacctacaccgaacacgcccgccgcaagaccgtcaccgccatggacgtcgtctacgcgctcaagcgccagggccgcaccctctacggattcggcggctaggttctctgtcgccgcctgcagattccaaaagcttgatggaaccccgacttgtctagttcgctatttcgtgtgtagttcgaactgaatcgtggaacaaagttgttcgcatgtgtttgttggaaatgaaacttgtctctgtcaaaaaaaaaa

SEQ ID NO: 3541 - DNA, 603 bp, Triticum aestivum
cacgaccgctccctcgacccgcatccgctcgcagctcgaaccaaacagagatcgtcagccatgtccgggcgcggcaagggaggcaaggggctcggcaagggcggcgccaagcgccacaggaaggtgctgcgcgacaacatccagggcatcaccaagccggcgatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggcgtcaatctccgtccgcaacccgtcgcctcctcgccttcagccaacaactccgccccgccgtggctgcagcctgcagacgcgagaaaactgtcatatctttcgttcagtagctgtagccggaacaaatgttgcctgttcacccatctgtctatcgcagaatgtctctagttaccttgtagctccatgagcccagtcatgagatcgaatatatatcgtcttcccgtgcaaa

SEQ ID NO: 3542 - DNA, 564 bp, Triticum aestivum
caccaccgctcctccaatcccacattcgctcgcagctcgaaccaaggagagaccgtcagccatgtccgggcgcggcaagggaggcaaggggctcggcaagggcggcgccaagcgccaccggaaggtgctgcgcgacaacatccagggcatcaccaagccggcgatccggaggctcgctcggaggggcggcgtcaagcgcatctccggcctcatctacgaggagacccgcggcgtgctgaagatcttcctcgagaacgtcatccgcgacgccgtcacctacaccgagcatgcccgccgcaagaccgtcaccgccatggacgtcgtctacgccctcaagcgccagggccgcaccctctacggcttcggcggctaggctcgtcctcacctccgtgcaaattccgatgtgcctatccccctgtgcgccgtagtctcgctgtccagaaaacttagctgaaatgagttccccatgtttatctccgctgtttccttcgtaggattagctgtatcgtcaaacaaagctgttcgcatctgaagtttgaatccaatcttgtgtctacgcaaaaa

SEQ ID NO: 3543 - DNA, 550 bp, Triticum aestivum
  misc_feature (8)..(10): n is a, c, g, or t
  misc_feature (13)..(13): n is a, c, g, or t
  misc_feature (15)..(17): n is a, c, g, or t
  misc_feature (20)..(22): n is a, c, g, or t
  misc_feature (540)..(540): n is a, c, g, or t
gctctacnnntcncnnngannngtcaacctcaccgaggagaagaagggagaagcgagaagatgtcgggccgcggcaagggaggaaaggggctcggcaagggcggcgccaagcgccaccggaaggtcctccgcgacaacatccagggcatcaccaagccggcgatccgtcgtctggctcgcaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggacgcaccctctacggattcggcggctaggcctccgccagattagagtgtctagggttcgtggtcgttgatgtaatcgcagtatctcgctgttgtttgctatcttctgtagaatcgaatggaatggaaattggagtagtttgtctttgaatctttgcagtctgttgattcatgataaaatcgtttgattgcgttaanaaaaaaaaaa

SEQ ID NO: 3544 - DNA, 501 bp, Triticum aestivum
acaaaatccccaaatccatcttcgtccccgggaaagagagagagagagagagcagcggagatgtctgggcgcggcaagggcggcaaggggctcggcaagggcggagcgaagcggcacaggaaggtgctgcgcgacaacatccagggcatcacgaagccggcgatccggcggctggcgcgtcggggcggcgtgaagcgcatctcggggctcatctacgaggagacccgcggcgtgctcaagatcttcctcgagaacgtcatccgcgacgccgtcacctacacggagcatgcgcgccgcaagaccgtcaccgccatggacgtggtctacgcgctcaagcgccagggccgcaccctctacggcttcggcggctaggctttccgttcctcgtagcggcttgtttgctggtggtgtggtggtggtagtttggtgtcgaatgttgtgttcctgatgtaaccgtgccctgttgcagtgaagtaaatcctggtgtcttatttgcaaaaa

SEQ ID NO: 3545 - DNA, 556 bp, Cucumis melo
acacacttcaattatctcagcttttatttcttcggattttccatcaaacaaggcgacaatgtccggcagaggcaaaggaggaaagggtctcggaaagggtggagccaagaggcatcggaaagttttaagagacaacatccaaggaatcaccaagccggccatccgccgtcttgctcgccgtggcggcgtcaagcgtatcagcggcctgatctacgaagaaactcgcggcgttctcaagatcttcctcgaaaatgtcattcgcgacgccgtcacttacactgagcacgctcgccggaagactgtcaccgccatggacgttgcgtacgcgctcaagaggcaaggacgtactctatacggcttcggaggttagggttgttgaaacctagggtttggatttgggggttttgtggttaggggattttggatgttgaaatttggttgtgattctggagaggaattgtatattgttggtgattttgttagattcaaactctgatttctatcagtaggttgttaattgtttctctcgtaattggaaatgttgatgcgcgtaatt

SEQ ID NO: 3546 - DNA, 527 bp, Raphanus sativus
  misc_feature (10)..(10): n is a, c, g, or t
  misc_feature (12)..(12): n is a, c, g, or t
  misc_feature (22)..(22): n is a, c, g, or t
  misc_feature (51)..(53): n is a, c, g, or t
  misc_feature (150)..(150): n is a, c, g, or t
  misc_feature (165)..(165): n is a, c, g, or t
  misc_feature (222)..(222): n is a, c, g, or t
  misc_feature (252)..(252): n is a, c, g, or t
  misc_feature (255)..(255): n is a, c, g, or t
  misc_feature (306)..(306): n is a, c, g, or t
  misc_feature (346)..(346): n is a, c, g, or t
  misc_feature (397)..(397): n is a, c, g, or t
  misc_feature (431)..(432): n is a, c, g, or t
  misc_feature (439)..(439): n is a, c, g, or t
ggactcacanancatctaattntccttacattcgattctagagtaagtttnnnaaaaatgtcaggaagaggaaaaggaggaaagggactgggaaaaggaggagcgaagagacacaggaaagttctgagagacaacatccaagggatcacnaagcctgcgatcagnagactcgctcgcagaggaggcgtgaagcgaatcagcggcttgatctacgaagaaacnagaggtgttctgaagatctttctcgagaangtnatcagagacgccgtcacttacactgagcacgcgaggaggaagacggtcacngcgatggatgttgtttacgctttgaagaggcaaggacgcnctctctatggattcggtggttaatttatctggtttggtgtgtgcttgttgntactgatttaagtcttgctgtcaagaaatcttanngtgtttngtcggttcgtttctttgttagtgtttttgtaattgcagtactgtaatgaaagttcgattactctattttaagttttttttttggtgcc

SEQ ID NO: 3547 - DNA, 563 bp, Raphanus sativus
gacaattcaactctaacttcgattcattttcagcaccaaactttctcaatcgaaaaaaaatgtcgggtcgcggaaagggaggaaagggtttgggcaaaggaggagccaagcgtcacaggaaggttctgagagacaacatccagggaatcaccaagccggcgattcggaggttggctcgtagaggtggagtcaagcgtatcagcggtcccatctacgaggagacacgtggcgtcctcaagatctttttggagaacgtcatccgcgacgccgtcacctacaccgagcacgccaggaggaagactgtgaccgccatggacgtcgtctatgctctgaagaggcaagggaggactctctacgggttcggcggttaaggggcgttttagattcgcgtttgcgtttctgtgtttcttttctgggaatttctaatcgagtcatgtttctctttagcgtttgcgtttgaattatgtttgggtacgggcgtttatgtgttgcggtagcgtttcgttttatatgtaattagggcttttattagcgatgcaatgtcgaatcaatccatggttaag

SEQ ID NO: 3548 - DNA, 476 bp, Pisum sativum
agaggcacagaaaagtgcttcgcgacaacatccagggaattaccaagcctgcaattcgccgtttggctagaagaggtggcgtcaagagaatcagtggtctcatctatgaagaaactcgtggtgttctcaagatctttctcgagaatgttattcgtgatgcagtgacctacactgagcacgctaggaggaaaaccgttaccgccatggatgtggtttatgctctgaagaggcagggaaggactctttacggtttcggtggttgattgtagtcttcaaattaggggttttgttagcccttgctggtttagttgtaaatgttggttaatttcgacgtatttcagctgctctgttttggttcatttgataaaattaggtttagatctgtttgaattaaacttgaacaacttgttctatgtttttattatgtggatttgtaagagtttttaattatgaatgacaaatctttgaaagagttt

SEQ ID NO: 3549 - DNA, 407 bp, Pisum sativum
gaggcataggaaggttctccgtgataacatccaaggaatcacaaagccagctattcgtcgattggcgagaagaggaggtgtgaagagaatcagtggtttgatctatgaggaaaccagaggagttctcaagatcttcttggagaacgtcatccgtgatgctgttacatacactgagcatgctaggaggaagactgttacagccatggatgttgtttatgctctcaagagacaaggaagaaccctctacggattcggaggttgaagactcattctttggatgttgttctgatttcactgtatcattggaacatgtgatagatcttcataatgcttagtagggttgtttgatagttctgttactttgtaagattaacaaggttgaaatctaatgaaaatattttctggtg

SEQ ID NO: 3550 - DNA, 432 bp, Pisum sativum
aggcataggaaggttctccgcgataacatccaaggaatcacaaagccagctattcgtcggttggctagaagaggtggtgtgaagagaatcagtggtttgatctatgaagaaaccagaggagttcttaagatcttcttggaaaacgttatccgcgatgctgttacatatactgagcatgcgaggaggaagactgttactgccatggatgttgtttatgctctcaagagacagggaagaactttatacggattcggaggttgatgaagaagcattcatttctttattttattagctttagcagtgtattttgagtgtggaaatgtaaatcttgattcttgtgatgtttagtttaattgagatatgtaatactccatgagaccaaagcatactcaattacatggattgcaatttaaatcaaatgaaaaccagtag

SEQ ID NO: 3551 - DNA, 431 bp, Pisum sativum
taaagaggcatagaaaggttcttcgcgataacatccagggtatcacaaagccagctattcgtcgattggcaagaagaggaggtgtgaaggatcagtggtttgatctatgaagaaaccagaggagttctcaagatctttttggagaacgtgattcgtgatgctgttacatataccgagcatgctaggaggaagactgttactgccatggatgttgtctatgctcttaagagacaaggaagaaccctctatggattcggaggttgaagatgattcactcttttgtttattttcaaaatgttgctgtgtagtttcaaaatgcgattgtaatttcccagcgcttctgatgatgtttaggttgatttgtgacatgcaattctcagtgaaatggaatttatattgaatattacatagactgaagtttgaattttatg

SEQ ID NO: 3552 - DNA, 749 bp, Saccharum officinarum
cgtctccgttagagaagaggccgacgatgtcgggtcgctgcaacggcggcaagggcctgtgcaacggcggcgcgaagcgtcaccggaaggtgctccgcgacaacatccaggggatcaccaagccggcgatccggaagctgtcgcggatgggcggcgtgaagcgcatctccgggctcatctacaaagagacccgcggagtgctcaagatctccctctagaacatcatccgcgaagccgtcacctacaccgagcatgcacgccgcaagaatgtcaccgccatggacgtcgtctacgctctccagcgccaggggcgccatctctacggctttcagcgataagtcgctgtcgctgtggttccagtcttgctgcaattcgccaattgtgcctgggtggggaaaatgctatttactgtcaaactgatcaaccatggtgaatatgtctggttcatattgaatcttattgctgaaagaaatggctatcaatatgacttgttcccggacttcaacaacatctaaacattaccagctcaccctctcgttcaaatcaaagatcagaccaacgttcctcacttgcaagacaagtgtcatagctagccttacatccccccccgccttccccattttctacggagtatctgtcgggcccccccaaacatttagatatgtagtgaagaaaaacccttacaacatctctgtgtggccaatggattccccccccgcgcgaaacaacagatatcataaggacgctcg

SEQ ID NO: 3553 - DNA, 471 bp, Artemisia annua
taggaaagggactaggcaaaggaggagcaaagcgtcatcgtaaagtactccgcgacaacattcaaggtatcaccaaacctgctattaggagattagccagacgtggtggtgtgaagcgtatcagcggtcttatctacgaggagacacgtggcgtgttgaagatatttttggagaatgtcatccgtgatgctgttacttacactgaacacgctcgccgtaaaactgtcactgctatggatgttgtttatgccttgaagagataaggccgtaccctctatggttttggtggctagatagatttaacttagggtttcatatgtgtacctgtctttgttctattatctaatttaaggttgcttgagatttaatatccatgttattttttactttgtgttggagtaaaattcatttaaaatcagcgaggggcgtgtttgttttggcttatatacctggcttatggcttatttggta

SEQ ID NO: 3554 - DNA, 460 bp, Artemisia annua
  misc_feature (7)..(7): n is a, c, g, or t
  misc_feature (23)..(23): n is a, c, g, or t
  misc_feature (41)..(41): n is a, c, g, or t
  misc_feature (46)..(46): n is a, c, g, or t
  misc_feature (56)..(56): n is a, c, g, or t
  misc_feature (59)..(59): n is a, c, g, or t
  misc_feature (74)..(74): n is a, c, g, or t
  misc_feature (83)..(83): n is a, c, g, or t
  misc_feature (86)..(86): n is a, c, g, or t
  misc_feature (95)..(95): n is a, c, g, or t
  misc_feature (98)..(98): n is a, c, g, or t
  misc_feature (107)..(107): n is a, c, g, or t
  misc_feature (109)..(109): n is a, c, g, or t
  misc_feature (120)..(120): n is a, c, g, or t
  misc_feature (132)..(132): n is a, c, g, or t
  misc_feature (144)..(144): n is a, c, g, or t
  misc_feature (153)..(153): n is a, c, g, or t
  misc_feature (156)..(156): n is a, c, g, or t
  misc_feature (168)..(168): n is a, c, g, or t
  misc_feature (190)..(190): n is a, c, g, or t
  misc_feature (192)..(192): n is a, c, g, or t
  misc_feature (196)..(196): n is a, c, g, or t
  misc_feature (218)..(218): n is a, c, g, or t
  misc_feature (240)..(240): n is a, c, g, or t
  misc_feature (244)..(244): n is a, c, g, or t
  misc_feature (271)..(271): n is a, c, g, or t
  misc_feature (273)..(273): n is a, c, g, or t
  misc_feature (278)..(278): n is a, c, g, or t
  misc_feature (282)..(282): n is a, c, g, or t
  misc_feature (345)..(345): n is a, c, g, or t
  misc_feature (347)..(347): n is a, c, g, or t
  misc_feature (419)..(419): n is a, c, g, or t
  misc_feature (425)..(425): n is a, c, g, or t
  misc_feature (453)..(453): n is a, c, g, or t
acaaacncaaacccccaagtcanttccaaaaaaaaaaaaangaaangaaaaaattntcnggaagaggaaaaggnggaaagggnctnggcaaaggnggngcaaaacgncntcgtaaagtantccgcgacaacntccagggaatcncgaaacccncgntaagacggttancgagaagaggaggagtgaagcntntcancgggttgatttacgaagagacncgtggcgtgttgaagatatttntagngaatgtgattagagatgctgtgacttncnctgancatnccagaaggaagactgttactgctatggatgttgtttatgctttaaaaagacaaggcaggactntntacggcttcgggggttaggtcaattagtattatgttgtttgtacggttttatggatgtattgtgtaattggncctttntcaatgaaatcaaatgaaatggatgttnttgtttg

SEQ ID NO: 3555 - DNA, 343 bp, Hordeum vulgare
cccaaatccatccgatttccatatccaaaaaagcaagccgtcaatgatgtccggccgcgggaagggcaggaaagggctgggcaagggcggcgccaagcgccaccggaaggtgctgcgggacaacatccatggcatcaccaagcacggccatccaccacctggcgcggcgtggcggcgtgaaacacatcttgggactgatctacgaggagacccggggcgtgctgaagatcttcctcgagaacgtcatccgcgacgccgaaccctacactgatcacgcccgccgcaagaccgtcaccgccatggacgtcttctacacgctcaagcgacagggccgcaccctcta

SEQ ID NO: 3556 - DNA, 311 bp, Brassica napus
gaaatcatctaaattttcctacccagaacaaaaaaaaatgtcaggaagaggaaaaggaggagagggattgggaaaaggaggagcgaagagacacaggaaagttctcagagacaacatccaagggatcccgaagcctgcgattaggcgactggctcgcagaggaggcgtgaagcggatcagcggcttgatctacgaagagacgagaggagttttgaagatctttctcgagaaagtgatcagagacgccgtgacttacactgagcacgcgaggaggaagacggggagggcgatggatgttgtttatgctctga

SEQ ID NO: 3557 - DNA, 521 bp, Zea mays
  misc_feature (317)..(317): n is a, c, g, or t
tcgcacaaatcctcttcctcgagttctcctcaaccaaattcaaagtcacagcggcgaaactctcgacgatgtctggccgcggcaagggcgggaagggtctgggcaagggccgcaccaaccgccaccgcaaggtgctgcgtgacaacatccagggcatcaccaagccggccatccgcaggttggcaaggaggggcggcatcaaacgcatctcctcgctcatcaacgaagagacccgcggcttgctctatatcttcctcgagaacgtcatccgggacgccgttacctacacccaccacgcccgaggggggagggtgacntccatgtaccttgcctactctctcaagcgccagggccgcaccctctacggtttcggcgggtaggtcgcccctctccccggggcaaatttactggggggcggggccccccctgttgccttcctggggcaaataggcccgagtagcctttaaccgagccgctttctgaggggggcggccctgcacctttcctaatttctaaggccc

SEQ ID NO: 3558 - DNA, 558 bp, Picea glauca
attattcttttttcattttggtggagagccggcggaatccgaagaattgtcagagatgtctgggcgtggaaagggaggcaagggtttgggaaagggcggagccaagaggcacaggaaagcgctccgagataatattcagggcatcaccaaacccgccatcaggcgtcttgccaggagaggaggtgttaagcgcataagcggcctcatctatgaggagacgagaggcgtcttgaagatcttcttggagaacgtcattagagatgcggtgacatacacagagcacgccaggagaaagactgtgacagccatggatgttgtctactctctaaagaggcagggccggacactctacggctttggaggctgagccggaggacttttgctcacatctaatcgtttattatatatggtgtcttttgacaccaccttcccctcttctgggtaccattaaccctggctgcaagcgataagtgttgaaagatctagttgtaggtttgtatgtattttctgttttaatcatggaatgtaggtctcatgaattttctgaacaacaaaaaa

SEQ ID NO: 3559 - DNA, 578 bp, Picea glauca
aatcttcatttatcattttcattttggttgccattaacggcagagagaaacgaaggatgtctgggcgtggaaagggaggtaagggtttgggaaagggaggagccaagaggcatcggaaagttctcagagataacatccagggaatcaccaagcccgccatcaggcgtctggccaggagaggaggagtcaagcgcattagtggcctcatctatgaagagaccagaggcgtcttgaagatcttcttggagaatgtgattagagatgccgtgacatacacagagcacgcgaggagaaagaccgtgacagccatggatgtcgtctactccctaaagaggcgaggccgaaccctttacggctttggaggctgagaagtctcactttgacggctatttatcatttgaccaggtgtctctagacaccacctctgtatctgtggaatattttttcacctgttttttattaccaaatgtcgaatgcgttgctttcttgcattttgcagggttttggcaatcttgttacgccgaaaggcgtatacctattgaagatgggcacaattaatgatcttttaatcgaaaaaa

SEQ ID NO: 3560 - DNA, 441 bp, Helianthus annuus
  misc_feature (131)..(131): n is a, c, g, or t
  misc_feature (411)..(411): n is a, c, g, or t
tgcgggtgctgggcacgcggcttgtgttggtctccgggattcggccattacggcgcggggacaccgtgaaaatcctacgggacaacatccagggcatcaccaaaccggcgatccgacggttggcgagacgngggggagtgaagcgtataagcggactgatatatgaggagacgcgtggtgttctcaagatctttctagaaaatgtaattcgtgacgcggttacctacacagagcatgctcgccggaaaactgttacagctatggatgtggtttatgcgttgaagcgtcagggacgcactctgtacggtttcggtggttagggtgagggaagttggatccggagtgtttggttattgttttgttatgttatgtatgatagttgttaatggaatgaaaagttagatttgattncatgataaaaaaaaagaaccgacaaggaaa

SEQ ID NO: 3561 - DNA, 985 bp, Citrus sinensis
ggggtcacccgtgcgggtccgggaccgggattccccggggtcgacccacccgtccgttcccattagtttgaaacccctctttagattttaatttcgtaacagaatgtctggacgcggctagggaggcaagggattggggaagggaggagccaagaggcatcgcaaggtgttgcctgatagcattcaaggcatcaccaagccggctattcgccgtttggccagaggaggaggcattaagagaatcaacggtctcatctacgaggagactcgcaggcgacctcacgatctttttggaaaacgtcattcacgatgctgtgagctacactgagcacgctcgccaaaagacagtgaccgccttggatgtcgtttaagcgcttcaagaaacaggccaggactctctatggattaggtgataaatgtggcatccgtaagtatttttgagttttaaggttttccattttatcatgaaatcaatgagcgtaggtagtgtctagcaagtgttattaaaattgcagcaacttacaattcgccctaccaacgggttctcgactgctgtgccagatagaagtgctcgacatagaaaaaaacataacataattagtctccccaaaacgacaaacgaaacagggcgaaggcgtaaggtgacgacactccacagaacctagatcaagaaccattattcttcaattactctcttataaaaatctattgtgtcagttttaagcgtccgtgcataactctcattcattcttcacttagactctagcttctaccccacttgccagtgaacacaatgaataaaaaaacacaacaaccgactacacttccctaaattaaacataatgatataacgcgcaacagtgaaaatctacgggacaaagaacaatgaaatagactaaccttcgacttctgatttagcatgcaaagaaacagactgatgagcacactacccatcgtaccagcacactctttgccatgagctaaa

SEQ ID NO: 3562 - DNA, 544 bp, Brassica napus
gagtacgcggggacatcgaaaacacacaagcgaatctcaatttaaaactttccgagaaaagaaaaatgtctgggcgaggaaaaggaggaaagggattgggaaagggaggagccaagaggcacaggaaggtcctccgtgacaacatccagggcatcacgaagcctgcgattcgtcgtttagctagaagaggtggcgtgaagcgtatcagcggtttgatctacgaggagactcgcggtgttctcaagatctttctcgagaatgtgattcgtgatgccgttacttacactgagcacgctaggaggaagacggtgacggcgatggatgttgtctacgcgttgaagaggcagggacgaactttatatggattcggcggttgatgggatgattttgtaaatcgcgtttgtctttagggtttgtttaatctattaaagctgttttagagtttcgtttagaatgtttcagcgttttgaattgaatgaaaacactttttctctactagcttttcaaaattgtcggtatagttaagctgaatcgtcgttttaac

SEQ ID NO: 3563 - DNA, 506 bp, Gossypium hirsutum
ctcaagtttccaatttcgttattcaaatcattcaagtttcttaattttcattcgatatcgaagatgtcgggaaggggaaagggaggcaagggacttggcaagggaggagcgaagcgccaccgtaaggttctccgtgacaacatccagggcatcacaaagccggcaattcgacgcctggctcgtaggggaggagtgaaacgtatcagtggcttaatctacgaggaaacccgtggagtcctcaagatcttcttggagaacgtcattcgcgatgctgtcacctacaccgaacacgctaggagaaagacggtgaccgccatggatgtggtttatgcactgaagaggcagggcaggactttgtatggatttggcggttaaatgatttagggtttaggtttgtaattaggggagctttggtaatgtttagtcgaaatagcaagttgggtcttgttgttcgatgttgtgatttgtaacccgtgctatcaattgcatattttattgaaatttga

SEQ ID NO: 3564 - DNA, 738 bp, Cryptomeria japonica
  misc_feature (2)..(2): n is a, c, g, or t
gnttctaacgattttctccacggaatatcaattggattcctcgagtcacagggtttcctgaaaatgtcagggcgcggtaaaggaggcaagggtttgggaaagggaggtgcaaagcggcacaggaaggtgctgcgagataacattcagggcatcacaaagcctgcgattaggcgtctggcaaggcgtggaggcgtgaagcgtataagcgggctcatctatgaagaaactaggggagttctcaagatctttttggaaaatgttattcgggatgccgtgacatacacagagcatgccaggcgtaagaccgttacggccatggatgtggtgtacgcgctcaagaggcagggccgcacactctatggcttcggcggctgagtttttccttcaaagtcttgcggtcaagaatggtgtctttcgacaccgcctcttgttacaggaaatgtgtttacatgtgatattgaaagcgtttagctgttttggatgccgtaaagttcaggatcgtagtgtgtgcatcattttgttatggttgcgatgcattgctagggggttcctgtaatacaacagctagggttaatgttaaagcttcaatgattctttacgaagtttgaagattttaggagttcatattttttttttagactgtagctccgttactttcgaatgtgccgtgaggcgaatcagagtgtttcaaagctgttcgttctctggagctttttaatgacatccaaataattttcc

SEQ ID NO: 3565 - DNA, 603 bp, Festuca arundinacea
ggcacgaggcacgaatccccactccccctcacacacctcgaaccaagagcagattcctcagccatgtcgggccgcggcaagggaggtaaggggctgggcaagggcggcgccaagcgccaccgcaaggtgctccgcgacaacatccagggcatcaccaagccggccatccgccgccttgcccgccgcggcggcgtgaagcgcatctcgggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggaggctagaggcttctcctcctctttgtcttcgttcgcgccaagcccgtcgcctcctcgccgtcaacagcctgttgtctttcccagtgtctctgttctgttccatgttcagtagctttagttggaattggaacgatgttactagttcgccgcctgtccttcgcaaaatctctctagctagcttgtactacctctgtatgggcctggatctgaaatcgaatatattatcttccactg

SEQ ID NO: 3566 - DNA, 575 bp, Festuca arundinacea
  misc_feature (383)..(383): n is a, c, g, or t
  misc_feature (396)..(396): n is a, c, g, or t
  misc_feature (566)..(566): n is a, c, g, or t
tgcacgaggcaccaccgctcctcgagttccattagctcgcagcagctccagtcaaggtcggccatgtcgggccgcggcaagggaggcaaggggctcggcaagggcggcgccaagcgccacaggaaggtcctccgcgacaacatccagggcatcaccaagccggccatccggcgccttgctcgccgtggcggcgtgaagcgcatctccggcctcatctacgaggagacccgcggcgtcctcaagatcttcctcgagaacgtcatccgcgacgccgtcacctacaccgagcacgctcgccgcaagaccgtcactgccatggacgtcgtctacgccctcaagcgccagggccgcaccctctacggcttcggcggctagaggcctcncctcttcgtccgngccgaacccgtcgcctcctcgccgtcaacaacctgttgtcttcctcagtgtgttctgttctgttcggtagctgtagttggaacaatgttactactagttcttcacttgtccatcgctaaatctacctagctagtttgtagctctgtacgagcctgaaatcgaatatattntcttccccc

SEQ ID NO: 3567 - DNA, 488 bp, Zingiber officinale
gcacgaggcctcgtgccgaattcggcacgaggatttcttgtacttcttttacctcgttcgtcgacatgtccggccgcggcaagggaggcaaggggctcggcaaaggcggagctaagcgccaccgcaaggtccttcgcgacaacatccagggcatcactaagccggcgatccgccgcctcgcccgacgcggcggcgtcaagcgcatcagcggcctcatctacgaggagacccgtggcgtcctcaagatctttctcgagaacgtcatccgcgacgccgtcacctacaccgagcacgcccgccgcaaaaccgtcaccgccatggacgtcgtctacgccctcaagcgccagggccgcaccctctacggtttcggcggctgatactttcctattctttagggttagggtttgcactaagatgtagctcttgaatcatgtaatcaaatatgtgaatgcgcttttttcctatcaaggatgcattgctcaaaaaaa

SEQ ID NO: 3568 - DNA, 550 bp, Ipomoea nil
  misc_feature (30)..(30): n is a, c, g, or t
  misc_feature (34)..(34): n is a, c, g, or t
  misc_feature (40)..(40): n is a, c, g, or t
  misc_feature (47)..(47): n is a, c, g, or t
  misc_feature (53)..(53): n is a, c, g, or t
  misc_feature (57)..(58): n is a, c, g, or t
gccggggacgcgatcaaaagtcaggtcagntttncttagngaagaanagaagnattnnctgaaaatgtctgggcgtggaaagggcggcaagggtttgggaaagggaggagctaaacgtcaccgtaaggttctccgggacaacatccaaggcatcacgaagccggccattcgccgtctggctcgccgtggtggagtgaagcgtatctccggcctcatctacgaggagactcgcggcgtcctcaagatcttcctcgagaacgttatccgcgacgctgttacctacactgagcacgctcgccggaagacggtcactgcaatggacgtcgtgtatgctctcaagagacagggccgcactctgtacggattcggcggttaggtttcgaaatcgtcggtgtatatcttggtggtgttttggtctagggttgatggttagggttagattgggcgttctgttctgaattaatctcagattgattgtttcaatgttactctgatttcaatctactgaatttcagttctaaaaaaaaaaaactttacccttcccatcatc

SEQ ID NO: 3569 - DNA, 559 bp, Lactuca sativa
cggggacacttccatttgcatttcttcgaatcacgaagtttcagatttcggagtaatttgaagatgtcaggacgtggaaagggaggaaagggtttgggaaagggaggtgcgaagcgtcatcgtaaggttctgcgagacaacatccagggaatcacaaaaccggcgatacgacgtctggcgagaagaggaggtgtgaaacgtatcagcggtttgatctacgaggaaactcgcggagttcttaagatctttctagaaaatgtcatcagagatgctgttacctacacagagcacgcacgccggaaaactgtcactgccatggatgtagtgtacgcgctcaagagacaaggccgaactctgtatggattcggtggttagggttttcaaggtctgaaaagagtctgtgggtattggtcttaggttagggatttctactgcttgttcaaatcaaatcaaatgttgttagtacttagtctaagcctcggatcattgtaccaaaatagaaatactcgactgatttcttatctcgatgtttccaaaatcaaaatgcttttgggcaaaa

SEQ ID NO: 3570 - DNA, 514 bp, Lactuca sativa
  misc_feature (34)..(35): n is a, c, g, or t
  misc_feature (49)..(49): n is a, c, g, or t
  misc_feature (132)..(132): n is a, c, g, or t
  misc_feature (393)..(393): n is a, c, g, or t
cggggacacttccatttgcatttcttcgaatcannaagtttcagatttnggagtaatttgaagatgtcaggacgtggaaagggaggaaagggtttgggaaagggaggtgcgaagcgtcatcgtaaggttctncgagacaacatccagggaatcacaaaaccggcgatacgacgtctggcgagaagaggaggtgtgaaacgtatcagcggtttgatctacgaggaaactcgcggagttcttaagatctttctagaaaatgtcatcagagatgctgttacctacacagagcacgcacgccggaaaactgtcactgccatggatgtagtgtacgcgctcaagagacaaggccgaactctgtatggattcggtggttagggttttcaatgtccgaanatagtctgtgggtattggtgttaggttagtgatttctactgcttgttcaaatcaaatgttgttagtactctgtgtaagactcgaatcattttaccaaaaaaatagaagcacttgactgatt

SEQ ID NO: 3571 - DNA, 561 bp, Raphanus sativus
  misc_feature (87)..(87): n is a, c, g, or t
atatcgtcaaactcgttttactatcctctccgatcgattattcaggagcttcggaatcaagaaatgtcgggaagaggaaaaggaggnaagggattggggaagggaggagcgaagaggcacaggaaggtgcttagggataacatccagggtatcaccaagcctgccattcgtcgtcttgctcgcagaggtggtgtcaagcgtattagcggcctcatttacgaggagaccagaggagtcctcaagatctttctcgagaatgtcatccgcgacgccgtcacctacacggagcacgctaggaggaagactgttacggctatggatgttgtctatgctttgaagaggcaaggacgcactctctacggattcggcggttaatcgaacggttgagattttaataggagacggaattagtgtgttgtttctgttatcatccacttgtttagtagtaaaaagtaaaacaaggagctgtgtcttgttaagccaatttgatgttccatgtagctagctaaaattcagcaatctctgattggattcttaaatgaaaattctgtttgaaaacca

SEQ ID NO: 3572 - DNA, 604 bp, Fragaria vesca
cttcaattctctcatcttccatctcaatcaagcttttctcttcttcaattttccattgagaaaatgtcaggtcgcggcaagggaggcaagggattgggcaagggaggagccaagcgtcacaggaaggtcctcagggataacatccagggcatcaccaagcctgctattcgccgtttggctcgcagaggcggcgtcaagcgtatctccggtctcatctatgaagagaccagaggcgtcctcaagatcttccttgagaacgtcatccgtgacgccgtcacctacaccgagcacgcccggaggaagactgtcaccgccatggacgtcgtgtatgctctcaagaggcagggaaggaccctctatggtttcggaggttagggtttctggaggagaaagtcttgctgtcaagaatagtgttgggatctggtgttggtttggtttatggaagtagtgttatcaagtgttttagggtttctatggtttttaatttgtaattagtagtctggtttaggcttctgggatttcgaatgggtttgtgctagtttatgatttgcaattccttctctggattgcagtttctgaatgatattgaaaagcctgttccttt

SEQ ID NO: 3573 - DNA, 341 bp, Triphysaria pusilla
tcttcaaaatcacagtttcctaatctcaaacagcaaaatccgaaaatgtcaggccgcggcaaaggaggcaagggcttgggaaagggaggagcaaagcgtcatcgtaaggtgctgagggacaacattcagggtatcaccaagcccgcaattcgtcgtctggcccgcagaggtggagtcaagcgtatcagcgggctcatctatgaggagacccgtggtgtgttgaagatctttttggagaatgtcatccgtgacgccgtcacctacactgagcacgctcgccggaaaactgtcaccgcaatggatgttgtctatgctttgaagaggcagggccgcactctgta

SEQ ID NO: 3574 - DNA, 598 bp, Triticum aestivum
caccaccgctcctcgaccttcatccgctctctcagctcgaaccaaggcgagttcgtcggcgaccatgtctgggcgcggcaagggaggcaagggtctcggcaagggcggcgccaagcgccaccggaaggtgctgcgcgacaacatccagggcatcaccaagccggccatccggcgcctggctcggagaggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctaggcgtccaccttcgtccgcagctcgtcgccgcctcgtcgtcagtcaacaactccgccccgctgtggccccgggcgcgaggaaactgccatgtcttatgttcagtagctgtagccggaacaatgtcacctgttcccccatttgtctatcgcagaatctctctagttaccttgtagctccatgagcccagttgtgaaatcgaatatatcgtctttcccgtgcaaa

SEQ ID NO: 3575 - DNA, 600 bp, Triticum aestivum
gcaccaccgctcctcctccaatcccacattcggtcgcagctcgaaccaaggagggatcgtcagccatgtccgggcgcggcaagggaggcaaggggctcggcaagggcggcgccaagcggcacaggaaggtgctgcgcgacaacatccagggcatcaccaagccggcgatccggcgcctggcgaggaggggcggcgtgaagcgcatctcggggctcatctacgaggagacccgcggcgtgctcaagatcttcctcgagaacgtcatccgcgacgccgtcacctacaccgagcacgcccgacgcaagaccgtcaccgccatggacgtcgtctacgcgctcaagcgccagggccgcaccctctacggcttcggcggctaggcttttcctcgcccccctcccctgcagatatcccaaaagcttgatggaaccgcggcttgtttagctctctatttgctctgtagttcgaactgaatcgtggaacaaagtgcttcgcatatgttgctggaaatcaaacttgtctcagtgaaataccgtgtctctcattttgttctgctgcatctctgttaatgtaaaattgttcttctgtgaaaaaaaaaaaaaa

SEQ ID NO: 3576 - DNA, 1022 bp, Triticum aestivum
ccgatcagccaccgcagctaccacaaagacaagtcaacctcaccggagagaaaggagaagcgaagatgtcggggcgcggcaagggaggcaagggtctgggcaagggcggcgccaagcgccaccggaaggtgctgcgggacaacatccagggcatcaccaagccggcgatccggcgcctggcgcggcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcgggggctaggctccggcgaggcgaatcgagctcgcaccacttgatcagatgttcagattagcagtagctaggcgttgttcagtgttcacggtgatcgatgtaatttatgatgtatggtgcttgttcgctggaatggatcaaatcgcagttatttacccttaaaaaaaaaaacaaacggcggaccctccaaaatttccccctcagggccccagcattaccgtcccccactctcctggaccaagggggcccccatggggagccggtttacacagctaggcccgggcggcgctttccaacccccgtgaacgggaaaactgccccccctgggatctcagggtaagggaaccccagctctcgtcgggtggcaatatttggacccaaccaccccaccacagaattgaagcccccacggcaagcctaaaaacccgaacacggcaacaggggggttacataagtggccatcgcccggcggcacgcgaaactccgcgccacgggcgtcatggactcacgacaactcttaaacaacgcgggcccccagtgcctcgccagaggtcggggcgctactcaaaactctccactccccgaagcgccgtattttgcgcgcccccagccaactcccacggggccgtcgtcacctgactccacaccccggcc

SEQ ID NO: 3577 - DNA, 578 bp, Triticum aestivum
gcacgagcagcaacacccacacttacagagaagccaatctcgccggagagggaagcgtcgaggatgtcgggccgcggcaagggagggaaggggctgggcaagggcggcgccaagcgccaccggaaggtgctccgggacaacatccagggcatcaccaagccggccatccgtcgtctcgctcgccgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggattcggcggctaggccacgccggtccagcagaacccacctcgcgccgccagattcactagctagccatggttgttcagtgttcattgtcttcggtgtaatggaacggccgcatctcgctgctgtctgttgttcagtgtactgtgtttggatgtactaggatggaatggaaatcgcggcgttttacccctgaattcgtctgcagtctcttgctctgt

SEQ ID NO: 3578 - DNA, 570 bp, Triticum aestivum
cacccatcaccactcctcccccaatccaactcgcgcagcagctccaagaggatcgtcagcgaccatgtccgggcgcggcaagggcggcaaggggctcggcaagggcggcgccaagcgccaccggaaggtgctgcgcgacaacatccagggcatcaccaagccggccatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggccgctggcccccgccagatggtcgtcagtcttcgtcgccgcctgcagattccgatgtgttagtccgcccgttcctagtagtgttgcgctcaagaaatctcagatggaaaccgccttgtttccccatttcctctgtatggttaactgaatcatgaaattatgtaatgaagatgttggcatccgttcgaactgaa

SEQ ID NO: 3579 - DNA, 569 bp, Triticum aestivum
caccactcctccaatccgacattttttctcgcagctcgagccaaggggagttcgtcggcgaccatgtccgggcgcggcaagggagggaaggggctcggcaagggcggcgccaagcgccacaggaaggtgctccgcgacaacatccagggcatcaccaagccggccatccggaggctcgctcggaggggcggcgtcaagcgcatctcggggctcatctacgaggagacccgaggcgtgctcaagatcttcctcgagaacgtcatccgcgacgccgtcacctacacggagcacgcccgccgcaagaccgtcaccgccatggacgtcgtctacgccctcaagcgccagggccgcaccctctacggcttcggcggctaggcccctcgtggtcgtcaatcttcgttgcccccctgccgcttcctaaagctcgatgattatctgacttgtctagttcgctatttcccctgtagttccaagtgaatcatgaaacaaagctattcgcatctggagtttggacatcgagcttgtctttgtgcaaatacagtgtttgtgattttgtctcgctggttggt

SEQ ID NO: 3580 - DNA, 578 bp, Triticum aestivum
gaattcggcacgaggcaccgttcctccgattccacatccgctcgcagctcgagatcgtcagccatgtccgggcgcggcaagggaggcaaggggctcgggaagggcggcgccaagcgccacaggaaggtgctgcgcgacaacatccagggcatcaccaagccggcgatccggcggctggcgcggcgcggcggcgtgaagcgcatctcggggctcatctacgaggagacccgcggcgtgctgaagatcttcctcgagaacgtcatccgcgacgccgtcacctacaccgagcacgcccgacgcaagaccgtcaccgccatggacgtcgtctacgcgctcaagcgccagggccgcaccctctacggcttcggcggctagggccgtccgacggtcgtcggtctttgtcgccgcctgcagattccaaaagcttgatgaaaccccgacttgtctagttatagctgtttcctctgtagttcgaactgaatcgtggaacaaagttatttgcgtaccttgtcggaaatgaaacttgtctctgtcagtctgtcgtaaatctgattttgttcgctggttggtcttctgca

SEQ ID NO: 3581 - DNA, 691 bp, Triticum aestivum
  misc_feature (663)..(663): n is a, c, g, or t
  misc_feature (676)..(676): n is a, c, g, or t
  misc_feature (683)..(683): n is a, c, g, or t
tgcactttcatcttcaactttgtagataaagcaatttttcagataatgcctaacctttatctgaaacatattagataaccagatgaggtctcgacgccgtccctcagattccactacatccgctcgcagcttgagatcgtcagccatgtccgggcgcggcaagggcgggaagggactcggcaaggggggcgccaagcgccaccggaaggtgctgcgggacaacatccagggcatcaccaagccggcgatccggcggctggcgcggaggggtggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggtccggccgactgtcgcctgtcttcgtcgcagcctgcagattccaaaagcttgatggaaccctgacttgttcagttcgctatttcctctgtctgtagttcgttggaaatgaaacttgtctctgtcagtctgtcgtaaatctgattttgttcgctggttggtcttctgcatctctgttcggtacgattgttgtttcctttgtgatgncttgagtaggctnccgtatnaatcgaac

SEQ ID NO: 3582 - DNA, 636 bp, Triticum aestivum
  misc_feature (622)..(622): n is a, c, g, or t
cccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttaggggacatgtctctgtgtgatgctttctgaggtagtattgctgcaatagctgtgtaatccatcgcttctgcaatgaagcgctttgaagcatgctacgtatgttgtgtctgtgggtgattgtatttctggtagtaacagtgattcttcctgaattttggataatacaagctcattcgcagtagtttctgatgtaatcatgtcttatcgtttganagaaaaaaaaaaaa

SEQ ID NO: 3583 - DNA, 800 bp, Triticum aestivum
  misc_feature (780)..(780): n is a, c, g, or t
  misc_feature (798)..(798): n is a, c, g, or t
caccaccgctcctccaatccgacattttctcgcagcccgaaccaaggcgagttcgtcggcgaccatgtctgggcgcggcaagggaggcaaggggctcgggaagggcggcgccaagcgccacaggaaggtgctgcgcgacaacatccagggcatcacgaagccggcgatccggcgcctcgctcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggcccttcgtggtcgtcaatcttcgtctcccccctgcagatttctaaagctcgatgagaacctgacttgtctagttcgctatttcccctgtagttccaagtgaatcatgaaacaaagctattcgcatctggagtttggaaatcgagcttgtctttgtgcaaataccgtgtttgtgattttgtctcgctggttggtctgctgcatctctgtcatgtagtacgatagttgtttcttctgtgatgttaggttttgtgcgcttggtagtgagattgatttgcaatccttttacaaggattaggaacatcatctgctctgtatctgctatttgttctgatgcatttgtactgggaaccattcatgatccttctattttgcagcaatgtgtgtaattgagattgggattantctgcatttcataaatcnat

SEQ ID NO: 3584 - DNA, 667 bp, Gossypium hirsutum
ccacgcgtccgccttcatctatcatcagttgctggacgtggcaagggcggcaagggtctcggcaagggcggtgccaagcgtcaccgaaagattttgcgagacaacattcaaggaatcaccaagcccgctatccgacgtctcgctcgtcgtggcggtgtcaagcgtatttctgctatgatctacgaggagacccgtggtgttctcaagaccttcctcgagggtgtcatccgcgacgctgtcacctacactgagcacgccaagcgcaagaccgtcacctccctcgacgtcgtctacgctctcaagcgacagggacgtaccctctatggtttcggtggttaaacaactttctaccttgatggttcgctcttcagaaggattattcagttgcgcttgtacggcactgggatggatgtatttgactaaggcgttggggaaacggatatgatattaccataggcgtcatggaagacgaccttgcaaatgaataccacattgaacattgatcaaaaaaaaaaaaaaaaaaaagggggggcccgttttaaggggtccaattttttctttccccgggggttgggaaaataaaaaagtttttttttattgggggccccccctaaatttccaattcccgcgcgcgccgcggtgtttataacaacgcgcggggaagggg

SEQ ID NO: 3585 - DNA, 423 bp, Helianthus annuus
ccacgcgtccggtctggaaaaggaaaaggaggaaaagggctgggcaaagtcggagcaaagcgtcaccggaaagttctccgtgataacatccagggtatcacaaagccggcgattcggggtttggctcgccgtgacggcgttaagccaatcaacgggcttatctacgaggagccacgtggcgtcttgaagatatttttggaaaatgttattcgtgattcggtaacccacccaaagcatgctcgccgaaaaacggttactactatggatgtggtttatgcgttgaaacgacagggccgttctcttttcggttttggtggttagggtttgttttgtttttctcagatctgttagtttgaatttgtttacacatctgggtacctgaagcttttaatgcaatgcgattatggttttaaaaaaaaaaaa

SEQ ID NO: 3586 - DNA, 798 bp, Lactuca sativa
  misc_feature (560)..(560): n is a, c, g, or t
  misc_feature (589)..(589): n is a, c, g, or t
catattcatctctctatagaaatccgaagcttttttcagtttgcgtagtgattattccaacaatgtcaggacgtggaaagggtggaaagggtcttggtaagggaggagcgaagcgtcatcggaaagttctccgtgataacattcagggaatcacaaagccagctatcaggaggttagcgaggagaggaggtgtaaagaggatcagtggtctgatctatgaagaaaccagaggtgtactgaaaatctttttggaaaatgtgattcgtgatgcagttacatacactgagcatgctcgaaggaagactgtaactgcaatggatgttgtctacgctctgaagaggcaaggaaagactctttacggatttggaggctgagatccataaatggttcttcgtaccctcactgttctattttcttttcgttcttgtagtggttctatctataaaatttccattttttagatctagtagctttatgtaaatcgattgcttcaatccttaaaaaggatgatattaatttaatctactgcctttgtttaagaaggacgcccaaaaatgtanccgtcaagtgcaaggatgttggcatcacngctctccacatcaagctccgtgctaccggtggtaacggaaccaagacccctggtcctggcgcccagagtgctcttcgtgctctcgcccgtgccggtatgcgtattggacgtattgaggatgtgacccctgttcccaccgattctacccgtcgcaagggaggtcgtcgtggtcgtcgtttgtagacgttgtattctcgcatacaattgtt

SEQ ID NO: 3587 - DNA, 503 bp, Raphanus sativus
  misc_feature (178)..(178): n is a, c, g, or t
  misc_feature (210)..(210): n is a, c, g, or t
  misc_feature (266)..(266): n is a, c, g, or t
ggaacacacagcaatcacaaaaaaaaagagagagaaataattcagaaaaattcagaagaaaaatgtcgggtcgtggaaagggaggcaagggtttggggaaaggaggagcgaagcgacacaggaaggtcctgagagacaacatccagggaatcaccaagcctgcgatacgccgtcttgntcgtagaggaggcgtgaagcgtatcagcggtntgatatacgaggagacacgtggagtgctcaagatctttttggagaacgtcatccgngacgccgtcacatacaccgagcacgcgcgtaggaagacggtcaccgctatggatgtggtgtatgctctcaagaggcaaggcaggactctctatggattcggcggctagggttttacaatttgttttttcttttttttttttggtttttaatcgactcagatgtgatttttgttttagtaagtttcagtttgctttttttgtatcatcgagaaatatatgaaattcaatatttgaaca

SEQ ID NO: 3588 - DNA, 518 bp, Selaginella moellendorffii
gggttcttcgatttgctgttccgccttccatttcttcaggtaatcttctcgtcgcggcggcaatgtctggaaggggaaagggaggaaagggtttgggcaagggcggtgccaagcgccaccgcaagcatctccgcgacaacatccagggcatcaccaagccggcaatccggcgcctggctcgtaggggcggcgtgaagcgtatcagcggtctcatctacgaggaaaccaggggagttctcaagatcttcctggagaatgtgatcagggacgccgttacatacaccgagcacgcgcggcgcaagacggtcaccgccatggatgtggtgtacgcgctcaagcggcagggaaggacgctctacggatttgggggctagagcctggaagaaatctctggaaaatttctcgtttcctctccttttctaactagtaggaagaagaagattctttccttgtccactgtaatatgctctctcgatcgctatatgatcctttgatcaatctaagcctttttatagtta

SEQ ID NO: 3589 - DNA, 619 bp, Picea glauca
accatcgtcatcattcattttaattgtctgagggcaggacaagaatcgttagcaaggatgtctgggcgtggaaagggagggaagggtttgggaaagggaggtgccaagaggcacaggaaggtcttgagagatagcattcagggcatcaccaaacctgccatcaggcgtctcgccaggagaggaggtgttaagcgcatcagtgggctcatctatgaagagaccagaggcgtcctcaagatcttcttggagaatgtgatcagagatgccgtgacctacacagagcacgccaggagaaagaccgtgacagccatggatgtcgtctactcattgaagaggcagggccgaaccctctatggattcggaggctgagaagtctctgcctgactattaatcatatttcttaatgctcatcatggtgtgtttccaccagtctccttttcacgtcattatatgtaatagctgatcagatcgtgagcactgtgttttgggctgttaatagaattgccaacattgttagtaatggcgttattttcagctgctgtaactgaaaatgcttctaattcagggtgtggaaattttggtcaataaatgaaagttctctttggtccttcataaaaaa

SEQ ID NO: 3590 - DNA, 330 bp, Triphysaria pusilla
tttcaaatcgaaacagttttcacaatttttgcagaacaaaaatgtcaggacgcggcaagggcggtaagggtttgggaaagggcggtgccaagcgccaccgcaaagtcctccgcgacaacatccaaggtatcaccaagccggccattcgccggttggctcgtcgtggtggagttaagcgaatcagcggtttgatttacgaggaaacacgaggcgtcctcaagatatttttggagaacgtcatccgtgacgctgtcacctacaccgagcacgctcgccgcaagactgtcactgccatggacgttgtctacgctctcaagagacagggtcgta

SEQ ID NO: 3591 - DNA, 411 bp, Triticum aestivum
  misc_feature (290)..(290): n is a, c, g, or t
  misc_feature (299)..(299): n is a, c, g, or t
caagggtctgggcaagggcggcgcgaagcgccaccggaaggtgctccgcgacaacatccagggcatcaccaagccggcgatccggaggctggctaggaggggtggcgtgaagcgcatctcggggctcatctacgaaggagacccgcggcgtgctcaaagatctttctccgagaacgtcatccgcgacgccgtcacctacaccgagcacgcgcgccgcaaagacccgtgaccgccatggacgtcctctacgcgctcaaagcgccaagggcccgcaccctcctacggttccnggaggctangctagggcctccttcgtatccggggactgggttaagggaatgtctcctgtgtgatctttccggaggtaatattgctgcataactgtgtaaccaacccttccgcaatgaacgt

SEQ ID NO: 3592 - DNA, 628 bp, Malus domestica
tttccgtgctgctagagcggttggcttcagcaacttttcattacatagaagataaggtggaaaatgttttgaacgttaagaaatatgttcaagaattcactagcaatctcaaagctattcaagctgtgcttcaggacgcagagcgaaggcaagtggaggaggaaagcgtgagaaactggttggatagccgcaaggaaatatcttaccagatgggggatgtgctggacgagtggaactatgaccttctgaggcaacaggttgagaagcaagaaagagaaggcgcagctgctcttgttcatgaaaagaagtaatccaagcttgaaacaaaatgtctgggcctggcaaaggaggcaaaggtctaggaaagggaagagcaaaacgtcactgtaaggttctctgcgacaacatccagggcatcaccaagtcgaccatccgccgttcggctcgcagaggcggtgtaaagcgtatcagcggcttgatctacgaggagacacgtggcgtgctcaagatcttcttggagaacgtgatcataggcgttgtgacatacaccgagcatgctagccgcaagacagtgacctccatggatgtggtctaagcactctagaggtagggcaggaccctttacggg

SEQ ID NO: 3593 - DNA, 443 bp, Gossypium hirsutum
atttcccccaaaataaaaactttcccccaaatgtcaggaagaggaaaaggaggtacaggtctcggaaaaggaggacccaagaggcatcctaaggtcctaagggataccctccaaggtatcactaaccccgccatccgtcgtttgggggggggggggaggagttaagagaatcagtggcttgatctatgaagaaaccagaggagtgttgaagattttcttggagaacgtcattcgcgatgccgtggacttacactgagccccctagaagggagaccgtcacggtcatggatgttgtttatgctttgaaaaggccaggcccccctcctccatggcttggggggctaatttttccgtttcttggtccggttctattgcaccctggggggggggggggtaccaacagggggttttctttaaaaaaaatcttttctccctctaaaaaa

SEQ ID NO: 3594 - DNA, 561 bp, Zea mays
  misc_feature (81)..(81): n is a, c, g, or t
gtgttcaattactaaatcttcttgtaggaaccaatgtatgggtccaactaagcggcgatgtctgggggcggctagggcggnaatgcgctgggcaaggttgatgagaaacgccaccgtatagttctccgcgacaacatggagggaatcacgaagccggcaatcctaaggctggcgaggatgggcggcgcgaaccgtatctccgggcttatatacgaagagacccgcggcctactcaaaatcttcctcgagaatgtcatccgcgacgcggtcacctacaccgagcacgctcgccgcaagaccgtcaccgccatggatgttgtatacgccctcaaccgccaagaacgcactctgtacaggttctggtggtctgaacccctcctcatccccctcaaggacttgataaaatattttctcccccccgccccggctaattcaattgagatttcccacataaaaaaccctactatatactctcaccccctcgggacaaacaccttcctcgctgtgcttggttgccactcagtatggtgtgcctggggatcaccccacaccacaaaaatt

SEQ ID NO: 3595 - DNA, 790 bp, Saccharum officinarum
ggggttaaactataaggatgggggggctagtatgatttgagttgaaattgtgtaacgggatagaaatttttacaccaggaatcattttatggtctatgtttagcgcaaagttttaatagggattcactataggggtaattgtgtaaagctttagagttcgggtttcgagattttagggttggacctagggttgttcaggttcacccctaccaacaggcaagcatttggaagaaaaatccccaatccctttgtcttcgcgggggaaggtgttggggcgcggtcaagggcgtaaggggcttgggcaaggtcgggtcgaagggtcaccggaaggtgttccgggacaacattgaggggattatgaagccggcgatccggaggttggcttggaggggcggggtgaagcgcatctttggggttatttacgaggagacccgcggcgtggtcaagatcttcctcgagaaagtcatctgggacgccgtcacctacaccgagcacgcgggccgcaagaccgtcaccgccatggaagtcgtttacgcgctcaagcgccagggccgcaccctttacggttttggaggttaggccggccgcgcctcgcccgtttcctttgtccgcctgtgttgccgtcgctgtggttgtagtgttgctgcaattcgctagttgtgcctgggtgagaaaaaaaatgctactgtggcaagcatgttgcatatgttgtttgtttttgattgagtcttattctgaagaaatatgccaatgatacttggtcaaggttcaagcatgccccatttgttct

SEQ ID NO: 3596 - DNA, 384 bp, Lolium multiflorum
agcgtggtcgcggccgaggtacgcggggggaccacgtttgccattgctctcgctttgcaccactactctccccaaccaataaccaacaacttgtggtcatgtctggacgcggaaaaggcggaaagggactcggaaagagcggtgctaagcgccatcgcaagattctccgtgacaacattcagggtatcaccaagcccgctatccgtcgtctcgctcgtcgtggtggtgtgaagcgtatttctggcctcatctacgaagagacacgaggtgttctcaagacattcctcgaaggcgtcatccgcgactctgtgacctacactgagcatgcgaagagaaagacggtgacggccctcgacgtcgtgtacctgcccgggcggccgctcg

SEQ ID NO: 3597 - DNA, 288 bp, Orobanche aegyptiaca
tactttttttatcttcaaatttctgtgtgaaaatgtctggtcgtggaaagggaggcaagggattgggcaaaggaggagcgaagaggcacaggaaggtgcttagggataacatccagggtatcacaaagcccgcaattcgccgattggctcgtaggggaggcgtgaagcgtatttctggtctgatatatgaggagacacgtggcgtgctgaagatctttctagagaacgtgattcgtgatgctgttacctacactgagcacgccaggagaaagactgttactgctatgg

SEQ ID NO: 3598 - DNA, 304 bp, Triphysaria pusilla
tcaaaaaaacaacagcttattaaatttacatctttttctaagcgaaaatgtctggccgtggaaagggaggcaaaggcctaggcaagggcggcgcaaaacgtcaccgtaaggtgctccgtgacaacatccaagggatcacgaagccggcgatccggcgcctggcgaggagaggcggagtgaagagaatcagcggtctgatatacgaggagaccagaggcgttctgaagatatttctagagaacgtgattagagatgcggtgacttacacagagcacgctcggagaaagaccgtcaccgccatgga

SEQ ID NO: 3599 - DNA, 471 bp, Brassica rapa
  misc_feature (55)..(55): n is a, c, g, or t
agaggcaaaggaggcaaggggttgggcaaaggaggagcgaagaggcacccctttngttctgagagacaacatccaaggaatcaccaagcctgcgatcaggcgtctcgctcgtagaggaggcgtgaagagaatcagcgggttgatctacgaagagaccagaggagttctgaagatctttctcgagaatgtgattagagacgccgtgacgtacacggagcacgcgaggaggaagacggttacggcgatggacgttgtttatgctttgaagaggcaagggcgtactctttatggattcggtggttaaaaccggtttaagatttcggtttggtttatgggtgctacttaattaagtcttgctgtcaagaaatctagtaggttttaggctttatcactcctttgctggtttgtttctttgtttgtgtaatttctcttttgggatttataaaagaatcaattactcaaaaaaaaaaa

SEQ ID NO: 3600 - DNA, 498 bp, Cichorium intybus
atcgaattcatttagcaataggcagagagaaaacatgtcaggaagaggaaaaggaggcaagggtattgggaaagggaggagccaagcgtcatcggaaggttctccgggacaacatccaaggtatcaccaagccggcgatccgccgtctggcaaggagaggcggtgttaagcgcatcagtggcctaatctatgaggaaacccgtggagttttgaagatctttcttgaaaatgtcatccgtgacgctgtcacatacaccgagcatgctcgccggaaaactgttacggccatggatgtcgtttatgctttgaagcgccaaggccgtactctctacgggtttggtggttaagagaatttgtggttctagggttcttgattggcagcgaggtcttaatctctgtcttttgatagcttctgtaatccgaagtgatattacctgtaattgaagctcttaatacaatatcacttatcctaaaaaaaggccgtaaaaattttccggc

SEQ ID NO: 3601 - DNA, 859 bp, Camellia sinensis
atgcaaactcatctttctcctctgacaagcccttgaagtttcctctctgtgtcactttctctctctatgaaaatgtctggtcgtggcaggggcggcaagggtttgggcaaaggaggagccaagcggcaatggaagggcctacgggacaacatccagggtatcactacgactgccattcctggtctggctcccacagggggaatccagaggatcagtgggctcatctatgaagagactcgcggtgttctcaagatcttccttgagaatgttattcgtgatgctgtgacctaccctgagcacgctcgaaggaagactgtgactgccatggatgtcttctatgctttgaataggcaggagaggactctcgatgggtttggctggtgagttgtcactggtgtctttgttaaggtttggcaaaggtaacatacatggactgtttgattgtgttgattgtcgatcaggtgcttgtgtcttttgtagtttaatgtactgcatttgtgactgcttgattggagatgtagcttgtctgcatgactatgatatatgtgtacacaaccaagattgtaatagtcctctgtcaagtggacatgtaagatggcacatatatgttgggcgactgtcactgatctagaccttcaccgctagatacctacaactgatgttccctctagcgcgggtctatgtgcgagctcgtacgtcgtctcggatgtacctgttgtactgcgatcaagagggcatcagcatcacaacttccgctgcatgatactgaggggaagctgcaggtggtaaaggatgtagggctacaaggagtgatcgaaatgacattacttgaccctacagccagtcagccagattcagt

SEQ ID NO: 3602 - DNA, 881 bp, Camellia sinensis
tatcggccattacggccggggaatgcaaactcatctttctcctctgacaagcccttgaagtttcctctctgtgtcactttctctctctatgaaaatgtctggtcgtggcaggggcggcaagggtttgggcaaaggaggagccaagcggcaatggaagggcctacgggacaacatccagggtatcactacgactgccattcctggtctggctcccacagggggaatccagaggatcagtgggctcatctatgaagagactcgcggtgttctcaagatcttccttgagaatgttattcgtgatgctgtgacctaccctgagcacgctcgaaggaagactgtgactgccatggatgtcttctatgctttgaataggcaggagaggactctcgatgggtttggctggtgagttgtcactggtgtctttgttaaggtttggcaaaggtaacatacatggactgtttgattgtgttgattgtcgatcaggtgcttgtgtcttttgtagtttaatgtactgcatttgtgactgcttgattggagatgtagcttgtctgcatgactatgatatatgtgtacacaaccaagattgtaatagtcctctgtcaagtggacatgtaagatggcacatatatgttgggcgactgtcactgatctagaccttcaccgctagatacctacaactgatgttccctctagcgcgggtctatgtgcgagctcgtacgtcgtctcggatgtacctgttgtactgcgatcaagagggcatcagcatcacaacttccgctgcatgatactgaggggaagctgcaggtggtaaaggatgtagggctacaaggagtgatcgaaatgacattacttgaccctacagccagtcagccagattcagt

SEQ ID NO: 3603 - DNA, 427 bp, Avena sativa
ggcaagggaggcaaggggctcggcaagggtggcgccaagcgccacaggaaggtgctgcgcgacaacatccagggcatcaccaagccggcgatccggcgcctggccaggaggggcggcgtcaagcgcatctccgggctcatctacgaggagacccgcggcgtcctcaagatcttcctcgagaacgtcatccgcgacgctgtcacctacaccgagcacgcccgccgcaagactgtcactgccatggacgttgtctacgccctcaagcgccagggccgcaccctctacggcttcggtctccgtcggcgccgcctgttgcagattccgatgtttattgcgctgtttccttagtagatcgagatgtgtaacttggaagacgtggaggaaagttgttcgtatctgaaatcgaattcagacttgtttctgtgca

SEQ ID NO: 3604 - DNA, 523 bp, Avena sativa
ggcaagggaggcaaggggctcggcaagggcggcgccaagcgccacaggaaggtgctgcgcgacaacatccagggcatcaccaagccggcgatccggcgcctggccaggaggggcggcgtcaagcgcatctccgggctcatctacgaggagacccgcggcgtcctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggtctccgtcaacgccgcctgctgcagattccgatgtttatttcgctgtttccttagtagatcgagatgtagcctgaagtcgtggagcaaaggtgttcgtatctgaatttcgaatccagacttgtttctgtgcagatactgtgcttctgttgtgtctctgcgtttgtgcatgtccggtgctgttccatctggttggcaaaattgtgcgcgactgcttggttttgtgcctaaa

SEQ ID NO: 3605 - DNA, 574 bp, Arabidopsis thaliana
tctgagaatcaaaagcaattcttcttcacacagtagcgaaaaaaagaaatctaattctctcgagaaaatgtctggtcgtggaaagggaggaaaaggcttgggtaaaggaggagccaagcgtcacaggaaggttctgagagacaacatccaaggaatcaccaagcctgccattcgaagattggctcgtagaggtggagtcaagcgtattagtggtctcatctacgaggagacacgtggcgtcctcaagatctttctcgagaacgtaattcgtgatgctgtcacttacaccgagcacgctaggaggaagactgtgaccgccatggatgttgtctacgctctcaagaggcaaggaaggactctctacggattcggcggttaatcagggtttttcagatttgtgtttggagatctgtttctggaaattagatttgagaatttcaatgtaggtattttagtaaatgtagcaagatttgatttcctttttttgctatttcgcttttgtaatgtgttttcatttgctaaattctcaacaatggaaacacgcaatttggtgaaagttcgtttgattactcat

SEQ ID NO: 3606 - DNA, 537 bp, Beta vulgaris
  misc_feature (34)..(34): n is a, c, g, or t
  misc_feature (476)..(476): n is a, c, g, or t
cacaacccaaaacaattcaaacacaaaaaatcanagaaagaagaaaacccaaaaagaggagagagaaaatgtcaggaagaggaaagggaggtaagggtttaggaaagggtggcgcaaagaggcacagaaaggtgttgagagacaacatccagggtatcactaagcctgctattcgtaggttggctcgaagaggtggagtgaagaggattagtggtctgatttatgaagaaactcgtggtgttttgaagatctttttggaaaatgttattcgtgatgctgtcacttacactgagcatgctcgccgtaaaactgttactgccatggatgtcgtctatgctcttaagaggcaaggtcgtactctttacggtttcggtggttaggttttgttttactagggtttgttgttaattaggttttgttttaatggtataatttcagttgattagggaaattaaaggaggtttgaatctctgtanttgtaattggtaaatcagttgttatatgaaatattttgatcacttttgattgtgatacatg

SEQ ID NO: 3607 - DNA, 738 bp, Brassica napus
gagtcaaatcatcatctgaatctaaaactcaaccatctaaatctcgagaaactttccagaaaaaaaatgtcgggaagaggaaagggaggaaagggactgggcaaaggaggagcgaagaggcacaggaaggttctgagagacaacatccaaggaatcaccaagcctgcgattaggcgtctcgctcgtagaggaggcgtgaagagaatcagcgggctgatctacgaggagaccagaggagttctgaagatctttctcgagaatgtaattagagacgccgtgacgtacacggagcacgcgaggaggaagacggtgacggcgatggatgttgtttatgctttgaagaggcaagggcgcactctctatggattcggtggttaaaaccggtttaagatttcgatttggtttctgggtgctacttattaagtcttgctgtcaagaaatctagtaggttttaggctttatcactactttgctggtttgtttctttgtttgtgtaatttctcttttggggatttataaaaaatcaattattcagttctcccacaaaaaaaaaaaagaaccaaattacaccgacctcacacaccaaacaaaacaccacatcaaaccaccctaaaaacaacaaaacaaacctaggtggggggcccgcctagaggatccaagtttacgaacccggggatgcgaagtcaataccttttctagaggggcgccaaaattcaattcacggggcgccgttttaaa

SEQ ID NO: 3608 - DNA, 544 bp, Festuca arundinacea
  misc_feature (51)..(51): n is a, c, g, or t
ggcacgaggcacaggccacagcacacacgagtcgaactcaccggagaaaanggaaagccgtcggagatgtcgggccgcggcaagggaggcaaggggctgggcaagggcggcgccaagcgccaccggaaggtgctccgggacaacatccagggcatcaccaagccggcgatccggcggctggcacgccgcggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgacagggacgcaccctctacggcttcggcggctaggcggccagatttagaagctagcctctgtttagggttcatggtctgctgtcgagtagttgcagtatctcgctgtcgtgtgctctggtcttgttaggacgaagtggtgactgtaagactgttggtttcgtagaatggaatgaaaatttcactagttcacccttaaaaa

SEQ ID NO: 3609 - DNA, 589 bp, Festuca arundinacea
  misc_feature (28)..(28): n is a, c, g, or t
ggcacgaggtccacacttccacagcaantccaattcctctcgtccaactccaacagatctccgacgatgtccggccgcggcaagggaggcaaggggctgggcaagggcggcgccaagcgccaccgcaaggtgctccgcgacaacatccaggggatcaccaagccggccatccggcgcctcgcccgccgcggcggcgtgaagcgcatctccgggctcatctacgaggagacccgcggcgtgctcaagatcttcctcgagaacgtcatccgcgacgccgtcacctacaccgagcacgcgcgacgcaagaccgtcaccgccatggacgtcgtctacgcgctcaagcgccaggggcgaaccctctacggcttcggcggctgagtgagccccctggtgacgccggcgaaactaccctgctgcctgctgtttcttctcgttgcgttgtgctttagtccccccgcccccgtgttttagttcagtataatctgttgtgaatctggtgtgctggcaacggcggcttctgtagtgagatccaacttctagttgtaactcatgtactttcctttgctgcaatgaaaagttagtttccatc

SEQ ID NO: 3610 - DNA, 540 bp, Ipomoea nil
gaccgagcaatcaaaattgtttgaaaggtcagatttccttagcgaagaagagaagaaattttcgaagatgtctgggcgcggaaagggcggtaagggtttgggaaagggtggagcgaaacgacaccgtaaggtcctccgggacaacatccagggcatcacgaagccggccattcgccgtcttgctcgccgtggtggagtgaagcgtatctccggcctcatctacgaggagactcgcggcgtcctcaagatcttcctcgagaacgtcatccgcgacgctgttacctacactgagcacgctcgccggaagacggtcactgcgatggacgtcgtctatgctctcaagagacagggccgcactctgtacggattcggtggttaggtttttatatcggcggtgtatatttttggtggtgtttaggtctagggttgattattaaggttaaattgggcgttctgttctgaatcaatctccgattgatgattgttacaatgttaatctgatttaagtccaatgattttcagttcttttgaaaaaaaaaa

SEQ ID NO: 3611 - DNA, 546 bp, Lactuca sativa
cggggatctcactcctcactcaataagaactcaaattcagcatctcatcttgagcttgtttcaacaatgtcgggacgtgggaagggaggcaagggactcggaaagggaggagcaaagcgacacaggaaggttcttcgggataacatccagggtatcaccaaacccgccatccggagattggctcgtcgaggaggtgtcaaacgtatcagtggcttgatctatgaagaaactcgtggtgttctcaagatctttctcgagaatgtcatcagagatgccgtaacctacactgaacatgctcgccgcaaaactgtaactgcaatggatgtcgtctatgctttgaaacgacaaggccgtaccctttatgggtttggtggttaggtttagggtttgggttatgaattagtgtgtattcactgtagatcgtattcgatttctccttcgttgtatcctgtttgaatatcgttgtcataccccatctcggggtatgggtttatgctatgaaaattccccttttttctataatcgttttgagtttcatcattgaaa

SEQ ID NO: 3612 - DNA, 541 bp, Lactuca sativa
ccatattcgtctctttatagaaatccgaagctttttttttcagtttgcgtagtgatcattccaacaatgtcaggacgtggaaagggtggaaagggccttggcaagggaggagcaaagcgtcatcggaaagttctccgtgataacatccagggaataaccaagccggcgatcaggaggttagcgaggagaggaggtgtaaagagaatcagtggtctgatctatgaagaaaccagaggtgtacttaaaatctttttggaaaatgttattcgtgatgcagttacatacactgagcatgctcgaaggaagactgtaactgcaatggatgttgtctacgctctgaagaggcaaggaaggactctttacggatttggaggctgagatccataaatggttcttcgtaccattactgttctgttttcttttagttttggtagtgggcctatctaccaaatttccattttttagatctggtagcttgatgtaaatggattgcttcaatccttaagaaggacaatattaatttaatctactgattttgttt

SEQ ID NO: 3613 - DNA, 420 bp, Lotus japonicus
ctcatctcagttcatctccaatctccatcttctcaccgatttcagttcgattttctgagtgacagcatgtctgggcgtggaaaaggaggcaagggattgggaaagggaggagcgaaacgacaccgtaaggttctccgcgacaacattcagggaatcacgaagccagcgattcggcgattggctcgcaggggtggcgtgaagcgtatcagtggcttgatctatgaggagactcgtggtgttctcaagatctttctcgagaatgtgattcgtgatgctgttacctacactgagcatgctaggaggaagactgttactgccatggatgtggtgtatgctctcaagagacagggaaggaccctttacggatttgggggttagggttttggtattctagtttcatatgttactgtttgtctttga

SEQ ID NO: 3614 - DNA, 566 bp, Raphanus sativus
  misc_feature (22)..(22): n is a, c, g, or t
ggaatctcattttgcaatcctntccgtcgcatattatttctaaaggtatcgaagctttgtgaagagatgtcaggaagaggaaagggaggaaagggattgggaaagggaggagccaagaggcacaggaaggtgctgagagacaacatccaaggtatcaccaagcctgccatccgtcgtcttgctcgccgaggtggagtcaagcgtataagcggtctcatctacgaagagaccagaggagtcctcaagatcttcctcgagaatgtcatccgcgatgccgtcacctacaccgagcacgccaggaggaagaccgtcaccgccatggatgtcgtctatgctttgaagaggcagggacgcactctctacggtttcggcggttaaatcaaatcgacggagttgggaattagggtttcgaaagtttggttaatttcgctggcgttgtgaacttgattagtaaaagtaaatctaggagtttgtttttgttgttgttctgtctctcgtccttaaatcaatgtggtcttattgtagctgagaaaaatcttaaatggaagttggattgaattaataag

SEQ ID NO: 3615 - DNA, 564 bp, Raphanus sativus
gaatctcatttgcaatcctcgccgtcgcatagctcttattctaaaggtatcgaaagttgtgaagagatgtcaggaagaggaaagggaggaaagggattgggaaagggaggagccaagaggcacaggaaggtgctgagagacaacatccaaggtatcaccaagcctgccatccgtcgtcttgctcgtcgaggtggcgtcaagcgtattagcggtctgatctacgaggagaccagaggagtcctcaagatcttcctcgagaatgtcatccgcgacgccgtcacatacaccgagcacgccaggagaaagaccgtcaccgccatggatgtggtttatgctttgaagaggcaaggacgcactctctacggtttcggcggttaaatcaaatcgacggagttgggaattagggtttcgaaagtttggggaatttatctggcgtttgtgaaacttgattagtaaaaaagtaaatcgaggagtttgtttttgttgttttgctgtctctcgtcgttaaattaatgtggtcttattgtagctggggaaatcttaaatgagagttagattgaatta

SEQ ID NO: 3616 - DNA, 467 bp, Rosa hybrid cultivar
gacatcagaatcatcccaactctctcatcctcatcaaaatcaaaatcagagtttctctccggtgaaaatgtcaggccgcggcaagggaggcaaggggttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgtcacctacacggagcatgcccggaggaagaccgtcaccgccatggatgtcgtctatgctctcaagaggcaaggaaggaccctttacggtttcggaggttgatatggggattctactattatatattgggtatttagtttagaagtgattctagtagtttattgttgttagatttgggtttttttttttt

SEQ ID NO: 3617 - DNA, 441 bp, Secale cereale
ggagaaattcccaattccttcgtcctcctcgccgcgagacgcacacagcagagcggagagtgagaagatgtccgggcgcggtaagggcggcaaggggctcggcaaaggcggggcgaagcggcacaggaaggttctgcgggacaacatccaggggatcaccaagccggcgatccggcggctggcgcggaggggcggcgtgaagcgcatctccgggctcatctacgaggagacccgcggcgtgctcaagatcttcctcgagaacgtcatccgcgacgccgtcacctacaccgagcacgcgcgccgcaagaccgtcaccgccatggacgtcgtgtacgcgctcaagcgccagggccgtaccctgtatggcttcggcggttaggggatagctagctaggcttgaatgtgtctatcgggtagctgctctgcgaatgcttgtgcctg

SEQ ID NO: 3618 - DNA, 611 bp, Fragaria vesca
ctcaattctctcttctttcatcaaaatcaaacactctctctctctccttcaaatttttcgttgagaaaatgtcagggcgcggcaagggaggcaagggattgggaaagggaggagccaagcgtcacaggaaggtcctcagggataacatccagggcatcaccaagcccgccatccgccgtttggctcgcagaggcggcgtcaagcgtatctccggtcttatctacgaagagaccagaggagtcctcaagatctttctcgagaacgtcatccgtgacgccgtcacttacaccgagcacgctcgcaggaagacagtcaccgccatggatgttgtttatgctttgaagaggcaagggaggaccctctacggattcgggggttgatctgggaattcttgttttacgtatcgtctttttagtttggtagtgattctggtggtctatggttagatctgggtttaattagttttgggttgttgaacttgctgttcatgtaatttgcgactttattttggttcaatggaagtttaatttatccgtaaaccttttcgttctgggtttgttcttctcagatgttcgtaagcctttaaaaattttgtcatctgaattgaaatt

SEQ ID NO: 3619 - DNA, 598 bp, Triticum aestivum
caatctcatcgcccaccaccaaaacaatccaatccaatcccaccgtagagaggggagaagcgcggaggatgtcgggccgcggcaagggaggcaaggggctgggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggctaggccgagggttcatcgatccagctcgcgacgccgccgtccgaccgagagtagtagtgctatctatctagttgctgtctagggttcgtggttctccgtgcaagagcagtggtatctccttggtgtttgctcccgtcttgtgagctgatgttgctgttgtagagatgtactggaagaagtttggaatggaaattgcagcagtttatccctgaaaaaaaaaa

SEQ ID NO: 3620 - DNA, 579 bp, Triticum aestivum
ccgcaacaagcaccaccagcaacccacacagagcagccaagcgaagctcgccggagagggaagcgaagatgtccggccgcggcaagggagggaaggggctcggcaagggcggcgccaagcgccaccggaaggtgctccgcgacaacatccagggcatcaccaagccggccatccgccgtctggcgcgcaggggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtcgtctacgccctcaagcgccagggccgcaccctctacggattcggcggctaggccccgacggtccagtcgaatccacctcgcgccgccagtttcgtagctagccatcggttgttcagtgttcggtgtaatggaatggccgcatctcgctgctgtctgttgtttcgatgtagaatggaaatatctgcattttacccctgaattcgtctgcaatctcttgctctgttgttaaatcttacaagtgcgctttgtt

SEQ ID NO: 3621 - DNA, 551 bp, Triticum aestivum
gcgttatgtccgcaacaacctccaccagcaacaaaagcgaagctcgccggagagagaagcgtcgaagatgtcgggccgcggcaagggagggaaggggctcggcaagggcggcgccaagcgccaccggaaggtgctccgggacaacatccagggcatcaccaagccggccatccgtcgtttggctcggcgtggcggggtgaagcgcatctcggggctcatctacgaggagacccggggcgtgctcaagatcttcctcgagaacgtcatccgcgacgccgtcacctacacggagcacgcccgccgcaagaccgtcaccgccatggacgtcgtctacgccctcaagcgccagggccgcaccctctacggattcggcggctaggccaagcgaatcggcccccgccatcagatttgtgctcgtagctagctatggctgtgtagtgttcatgggcttgggtgtaatggccgcatctcgctgctgtatgtcctggccttgactgttctttggatgtagctctgggatggaatggaaattgaagcagcttacccttgaa

SEQ ID NO: 3622 - DNA, 692 bp, Triticum aestivum
  misc_feature (665)..(666): n is a, c, g, or t
ggcacgaggcaccacagctcctcctccatttgcatctcactcagctccaaggaagaagccgtcagccatgtccggccgcggcaagggagggaaggggctgggcaagggaggcgccaagcgccaccggaaggtgctgcgcgacaacatccagggcatcaccaagccggccatccggcggctggcgcggcggggcggcgtgaagcgcatctcggggctcatctacgaggagacccgcggcgtgctcaagatcttcctcgagaacgtcatccgcgacgccgtgacctacaccgagcacgcccgacgcaagaccgtcaccgccatggacgtcgtctacgccctcaagcgccagggacgcaccctctacggattcggcggctgacctgcgcccgctgctgcccaatcgagtcgaccctgctagctgctgctgctattctcgtgctatggtttcgcttctgaattcagagtgtgtgagttgttgctccgtcggtctgtatagttagtggaaggcaatggatctgaatgcaatcgaaattgttggtttttgcaagaaatgaatctgaatgaaatggagattgtaccgcatctcgctatgattgtaccttctggcttgttcctgtacattccaaaattaataacaagaaacgccattgggacctttttcctgnnaaacaaagacatcatactctccctcc

SEQ ID NO: 3623 - DNA, 627 bp, Triticum aestivum
atatcaccccaccaccacaccgccgcaacaaccaccaccagcaacacacacacacagagaagcgaagatgtctggccgcggcaagggagggaagggtctcggcaagggcggcgccaagcgccaccggaaggtgctccgcgacaacatccagggcatcaccaagccggccatccgtcgtctcgctcggaggggcggcgtgaagcgcatctcggggctcatctacgaggagacccgcggagtgctcaagatcttcctggagaacgtcatccgcgacgccgtcacctacaccgagcacgcccgccgcaagaccgtgaccgccatggacgtcgtctacgcgctcaagcgccaggggcgaaccctctacggcttcggcggctaggcctgcgcccgctgctccagtctccgtcgactctgactctgctagctgctgttctggtgctatgcgtttcgtttctgaatgcgtgcgtgcgtgcgttgctgttccatcggtctgtgtagttagtggatggcgatggatctgaatgcagtaagttcgtcagagtgcgtgtgttgttctatcggtctctgtagtcagttcctctgtggaaggcgatggatatgaatgcaatgggattgttggttcttcct

SEQ ID NO: 3624 - DNA, 524 bp, Triticum aestivum
tccaccgtagccaccacacagacaagtcaacctcaccgaggagaagagaagaaaagagaagcgagaagatgtcgggccgtggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccgccaccaccaccagattaggagctagcccatgtgtagggttcgtggtcctcgttgtaatcgcagtatctcgctgttgttcgctgtgttctgtaggatcgaatggaatggaattgaaattaaactagttcgtcgttgaaaaa

SEQ ID NO: 3625 - DNA, 618 bp, Triticum aestivum
atctctttccacccaccaaaccccgctccaaaatccccaaatcccctctcttccgaagctactcagccatgtcggggcgcggcaagggcggcaaggggctcggcaagggcggcgccaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccggaagaccgtcaccgccatggacgtcgtctacgcgctcaagcgccagggacgcaccctgtacggattcggcggctgaggagccgcggcgcttgctggccggccgtggcgcacaagccctggctcgcggtcaagaaagtggaggagaggagaaagctgtagttgatctgggttccatgccttctatgattagtagtaatatctgtagtagcagtagctggttgttcaatggttgcttcagtgttctgaatttctgatgggcaaacactgtgtttgccgagatatatgaatccagagttaacaaaattgtcctaaaa

SEQ ID NO: 3626 - DNA, 699 bp, Triticum aestivum
ttcccctccaaatccacccgatccaatctgcccgctcgcagctccaaggaaggaggaagccgtcgaccatgtccggccgcggcaagggcgggaaggggctgggcaagggcggcgccaagcgccaccggaaggtgctccgcgacaacatccagggcatcaccaagccggccatccgccgtctggcccgcaggggcggcgtgaagcgcatctccgggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggattcggcggctaggccccctgctccgtccagtctttgctctcccggctgttacatctgtccgagcgcgtgtgttgttcaatcgttggtgagtgtttggtctgtgtagttagtgcaaggcgatgtgtatgaatgcaatggaatcagcgttggtattaatactatcttttccgcatctctcgatgcgttatatcctactctgctgcgtctttgttcgatgcttgtgtgattcagtacgctgtattcgtttaatttggttttagctgaatgagcgacaaaatttcgtcgctgcattcatatttgggtatgcagaaacattctctgaaaaaaaaaa

SEQ ID NO: 3627 - DNA, 681 bp, Triticum aestivum
  misc_feature (637)..(637): n is a, c, g, or t
  misc_feature (673)..(673): n is a, c, g, or t
accagttcatccatccgatcccatctgcccgctcgcagctccaaggaaggaaggaagccttcagccatgtctggccgcggcaagggcgggaaggggctgggcaagggcggagccaagcgacaccggaaggtgctgcgggacaacatccagggcatcaccaagccggcgatccggcgcctggcgcggcggggcggcgtgaagcgcatctcggggctcatctacgaggagacccgcggcgtgctcaagatcttccttgagaacgtcatccgcgacgccgtcacctacaccgagcacgcccgccgcaagaccgtcaccgccatggacgtcgtctacgcgctcaagcgacagggacgcaccctctacggattcggaggctgattgacctgctccgtctggtctcttcccccgctgttccatctgtccgagtgcgtgtgttgttgttccgtcattgggtttggtctgtgtagttagtgcaaggcggtgtgtatggatgcaatggaaccagcgttggtattatcttaactgcatctctcgatatgttatagttttatatcctactctgcttgtgtgattcagtgacgctgcgttcgcttaattcagtttttagctgaatgagcaccaaaatttgggtatgcanaaacattctctgaatttaaatgtgtttctttatcanaaaaaaaa

SEQ ID NO: 3628 - DNA, 548 bp, Triticum aestivum
acagaaaacaaaatccccaaatccatcttcgtccccgggaaagaaagagagagagagagcagccgagatgtctgggcgcggcaagggcggcaaggggctcggcaagggcggggcgaagcggcacaggaaggtgctgcgcgacaacatccagggcatcacgaagccggcgatccggcggctggcgcgtcggggcggcgtgaagcgcatctcggggctcatctacgaggagacccgcggcgtgctcaagatcttcctcgagaacgtcatccgcgacgccgtcacctacacggagcacgcgcgccgcaagaccgtcaccgccatggacgttgtctacgcgctcaagcgccagggccgcaccctctacggcttcggcggctaggctttcctttcctcgtagcggcttgtttacggagtgcctgtgcatcctggcggtgtttggtgtcgaatgttgtgttcctgatgtaacagtgcctgttgcagtgaagtaaatcctggtgtcttatttgcaaaaatgcagtgattgtgccccttttaatccaaaaaaaaaa

SEQ ID NO: 3629 - DNA, 587 bp, Manihot esculenta
  misc_feature (18)..(20): n is a, c, g, or t
  misc_feature (24)..(24): n is a, c, g, or t
  misc_feature (27)..(27): n is a, c, g, or t
  misc_feature (29)..(31): n is a, c, g, or t
  misc_feature (33)..(34): n is a, c, g, or t
  misc_feature (36)..(36): n is a, c, g, or t
  misc_feature (38)..(43): n is a, c, g, or t
  misc_feature (45)..(47): n is a, c, g, or t
  misc_feature (53)..(53): n is a, c, g, or t
  misc_feature (55)..(55): n is a, c, g, or t
  misc_feature (57)..(59): n is a, c, g, or t
  misc_feature (67)..(67): n is a, c, g, or t
  misc_feature (586)..(586): n is a, c, g, or t
agcactctctttccctcnnnttcntcnannnanncnannnnnnannnccttcntntnnncaaaaatntctggccgtggcaagggaggcaagggactaggaaagggaggagccaaacgtcaccgcaaagttcttcgcgataacatccaaggcatcacaaagccagcaattcggcgattggctcgcagaggtggtgtaaagcgtatcagtggattgatctatgaggagacccgtggagtgctcaagatcttccttgagaatgtgattagagatgctgtgacctacacagaacacgctcgccggaagactgttacggccatggatgtggtgtatgcattgaagagacaaggcagaaccctttatgggtttggtggttagggctttggattgggattttaagtcttgctgtcaagaaattgtgtagtttttgggctatgtatgtgttgagaagggtaggttggtaattttggattagtgtaagcaattcaatagattaggcctttggttttggttttgaccatgcttttgggttttgttgtaactatgctgaagttggaatgcaacgaaatgaaatgggggtgtttgatnc

SEQ ID NO: 3630 - DNA, 605 bp, Raphanus sativus
ggacaattcaactctaacttcgattcttcttcagcaccaaactttctcaatcgaaaaaaaaacatgtcgggccgtggaaagggaggaaagggtttgggcaaaggaggagcgaagcgtcacaggaaggttctgagagacaacatccagggaatcaccaagcctgcgattcggagattggctcgtagaggtggagtcaagcgtatcatcggtctcatctacgaggagacacgtggcgtcctcaagatctttttggagaacgtcatccgtgatgcagtcacctacaccgagcacgccaggaggaagacggtgaccgccatggatgtcgtctatgctttgaagaggcaggggaggactctctacggtttcggcggttaagtggcgtttcttagattcgcgtttgcgtttctgtgtttcttttctggggatttcttatcaaatcttgtttcttatttgcgtttgcgtttgaattatgtttgggtacgggcgtttatgtgttgcggtagcgtttcgttttatatgtaaattaggccttttattagcgatgcaatgtcgaatcaatccgttggttatgttctggagaaatataattcgaattttattttcca

SEQ ID NO: 3631 - DNA, 848 bp, Picea glauca
aactcatcgcaattcttcacttgtcctcttatcattttggttgagtgcagagaaacgaagaaggatgtctgggcgtggaaagggaggtaagggtttggggaagggaggagccaagaggcacaggaaagttctcagagataatattcagggcatcaccaagcccgccattaggcgtctcgccaggcgaggaggagtcaagcgcatcagcgggcttatctatgaagagacgagaggcgtcttgaagatcttcttggagaatgtaattagagatgccgtaacgtatacagagcatgcaaggagaaagactgtcacagccatggatgtcgtctactccctcaagaggcagggccgaaccctctacggctttggaggctgaaaagggtcactcgctgctactcaattttgtttgttattctcagtggcggtgtctctttttgagaaattgtgacctcgtctgccctggcaagtgccgaatgtcttgccttcccgaaggttgcaggggtttctgttttttatgacttgttttagggcacattccttgggtgtgtttttccattctaattctctaatttcttttagggcttttgaaccctaccaggggttgtaactgtttttgtgttcatccatgaaggagtctgtaaggtgtattatatatggaatacaattggaggttctcccttcgcgtaatatttgtaagacgatggtctttgcatgattgtttttaaaagacttcgcaattggcatcttctggctggtatgaagcttggctcagctattgcacagttgtttatcattgaagaaatattgcaatttagtaacgaaaactgctgttaggtttccccaaaaaa

SEQ ID NO: 3632 - DNA, 797 bp, Picea glauca
  misc_feature (11)..(11): n is a, c, g, or t
  misc_feature (24)..(24): n is a, c, g, or t
  misc_feature (233)..(233): n is a, c, g, or t
  misc_feature (477)..(477): n is a, c, g, or t
  misc_feature (545)..(545): n is a, c, g, or t
  misc_feature (552)..(552): n is a, c, g, or t
  misc_feature (694)..(694): n is a, c, g, or t
  misc_feature (790)..(791): n is a, c, g, or t
tactgttcgtngccattcttcacntcatcattttggttgaaagcagcggtaggcagcgagaaacgatgtcggggcgtggaaaggggggcaagggtttgggaaagggaggtgccaagaggcacaggaaggtgctcagagataacattcagggcatcaccaaacctgccatcaggcgtctcgccaggagaggaggcgtcaagcgcatcagtgggctcatctatgaagagaccagnggtgtcctcaagatcttcttggagaatgttatcagagatgccgtgacatatacagagcacgccaggagaaagaccgtgacggccatggatgtcgtctactctttgaaaaggcagggccgaaccctatacggcttcggaggctgagaagtctcactcgactgttattcattactcactctcatttatggtgtttctagacaccaccttcgtatctgtgggaaattttaaacctggcgagtactcngaagtgttgactgcattgctttagttgaagtttgtagggatttattcagttggtcaatggagaacctntctatgntgccctatttccaattgccttggccatagttttctgaacagaaaatccttcaatctgatcagtctactgtttacattgtgtacgtatgatgatctgggataattcgcaagtcggattgtgcaattgtgataatctggatcanttcaaaagtcaatagccagggtaagagggcagttttgaattgaataaagtcacagctgtgggattattgtcaatttttaattattaaatttgttcnnaaaaaa

SEQ ID NO: 3633 - DNA, 964 bp, Picea glauca
attgcagttcaatccaacattttctttgaagttgaaatcagcggccagaagtgagaacggaaggatgtctgggcgtggaaagggagggaagggtttgggaaaggggggtgccaagaggcacaggaaagttctcagagataacattcagggcatcaccaagcctgctatcaggcgtcttgccaggagaggaggcgtcaagcgtatcagcggcctcatatatgaagagacgagaggcgtcttgaagatcttcttggagaatgtgattagagatgccgtgacgtacacagagcacgccaggagaaagaccgtgacagctatggatgtcgtctattcattgaagaggcagggccgaaccctctacggctttggaggctaagaaattctgctttgacgttattcattcattaatggtgtcttttgacaccacctctatttctctgggagggtttaagccatttgatgtggctggatgttggttgcatttttatttttttccgagtctgcagaggtttattttggtgggaattgcgtgtagtcataattcctagagattttgtagtggtatttttttagggaggtggggtttcctttatggttttgaattaaattcttagagtgaagctagggtttcaaagtaccttccaatcgacgggagcgagatttggtggggaaaaatctatacacacgtatgccctgactgcgttatcagatcttaagatgtacagattataaaggagatcctgaagcggtgggaatttcttctgtgtgttgatttcttttgctctccgtttgacattcgtttgcgtttttgtattgttgccgagcttcccctattggctatttgcttttttgcagttctatttatttacagggaactcttcgatgtagtgaatttaaaaaataacaataaaaaatatctcatgaataataatttatgggatggagttgttttcaattcaaaaaa

SEQ ID NO: 3634 - DNA, 535 bp, Triphysaria pusilla
  misc_feature (53)..(53): n is a, c, g, or t
  misc_feature (69)..(69): n is a, c, g, or t
  misc_feature (360)..(360): n is a, c, g, or t
  misc_feature (369)..(369): n is a, c, g, or t
acaaatcaacaatcagctcagttttcatttcttcagtctgataaccactactntgcgataaaaatgtcnggccgtggcaagggaggcaaggggcttggcaagggcggagcaaagcgacatcgcaaggtgctccgtgataacatccagggcataacgaagccggcgatccggcgtctggcaaggagaggtggagtgaagagaatcagtggtctgatatacgaggagacaagaggagttttgaagatatttcttgagaatgttatcagagacgctgtgacctacaccgagcacgctaggaggaagacggtgactgccatggatgttgtctatgctttgaagaggcagggccgtactctttanggattcggnggttaatttttgtatttctaccctctttcttattttcattgttcttttttttttttttcctttccggccttgatttgaagttcagattgttggtgatttgtagatcgtggcttctgtcagtgtaattgaacgatttacaagtaatggcaaatctcagtttttaata

SEQ ID NO: 3635 - DNA, 603 bp, Triticum aestivum
  misc_feature (62)..(62): n is a, c, g, or t
gcgtggtcgcgcccgaggtccaattccatccgctcggagctccaagccaccatcatgtccgnccgcggcaagggcgggaagggtctgggcaagggcggcgccaagcgccaccggaacatgctgcgggacacaatccagggcatcacgaagccggctatccggcgtctggctcgcaggggcggcgtgaagcgcatctcggggctcatctacgaggagactcgcggcgtgctcaagatcttcctcgagaacgtcatccgcgacgccgtcacctacaccgagcacgcccgccgcaagaccgtcaccgccatggacgtcgtctacgcgctcaagcgacaggggcgcaccctctacggcttcggcggctgatctgctgccgctccgtccagtctctgccagctcctgttccatctgccggagtgcgcgtgttgttctgtcgttgtgtgcagtagggtcttcctgaatatggatgcatctctcgatatgtttctgtaagcttgttaaattcttcccagccagaaagattaggagataatgaaccaatctccgagcaaatattacagtaaactgcaacaggtgtgaatgacatttgggcttatagaaaca

SEQ ID NO: 3636 - DNA, 676 bp, Hordeum vulgare
agggcgagaagttgctgctgggcgagggcgagaaggtggtgggcgagggcgagaaggtgctgggcaagcgcggcgccaagggcgggaagggccggggcaagggaggcgccaagcgccaccggaaggtggtgcgggaccacctgaacggcatcaccaagccggccatccgccgtctggcccgccgtggcggcgtgaagcgcatctcggggctcatctacgaggaggcccgccatgtgctcaaggtgttcctggaggccaccgtccgcgacgccctcacctgcagcgagcactcccgccgcaagaccgtcaccgccatggacgtcgtctacgccctcaagcgccagggacgcaccctctacggcttcggcggctaggccgcgccgatccggtccggccgaacccgcctcgcgcctcctccatattagcagtagcagttagcttcggcgtagatcatggaatgcagtagtagtactagctagtagcatggcttttctctctgttgttaggatgtggtactagtagagcatggaatgggaatctccatcgttttatccctggattcgtcttaaatcgcttgctctgctgtgaaatgtggtcggtgtgttccccattttctatcgctgtatgcgtcttcgaactgtttaaatcgcgataagcaggtgatttgttttggctt

SEQ ID NO: 3637 - DNA, 399 bp, Brassica juncea
agtacgcgggggtcaaatctcatttgctgtagcctccgtctccaatcaattaacagatctacagaaacgatgtcaggaagaggaaagggaggaaagggactgggaaaaggaggagcgaagagacacaggaaggtgctgagggataacatccaaggtatcaccaagcctgcgattcgtcgtcttgctcgcagaggtggtgtcaagcgcatcagcggtctgatctacgaggagaccagaggagtcctcaagatcttcctcgagaatgtcatccgcgacgccgttacttacaccgagcacgctaggaggaagaccgttactgctatggatgtggtctatgctttgaagaggcaaggacgtactctctacggattcggcggttaaaactacgatggattagcg

SEQ ID NO: 3638 - DNA, 562 bp, Brassica rapa
aacagagaatcttctccaacactaaagttttctcaagaaaaagaaaaaacccaatttccatcggaaaaaatgtcgggtcgtggaaagggaggaaagggtttgggcaaaggaggagccaagcgtcacaggaaggttcttagagacaacatccagggaatcaccaagccggcgattcggaggctggcacgcagaggtggagtcaagcgtatcagtggtttgatctacgaggagacacgtggcgtcctcaagatctttttggagaacgttattcgtgacgctgtgacatacactgagcacgctaggaggaagactgtgactgcgatggatgtggtctacgcgttgaagaggcaagggaggacgctttacgggtttggtggttaagggactttttagattcgcgttttgcgtttctgcggttcttatggaagtttctaatcgaatcatgttttccttagcgtttgtgttttgaattccgtttgagttcggtcttttatgttgcgttagcgtttcgttatatgtaattacgcattttatctatgaagctattcgagtttatgattcg

SEQ ID NO: 3639 - DNA, 1238 bp, Beta vulgaris
gcacgaggagcaaataagcaaacaatactactccaaaagaaaacttaaaagtcaaaggagagagaaaaaaatgtcaggaagaggaaagggaggaaaagggttaggaaagggaggagcaaagaggcataggaaggttttgagagataacattcagggtatcactaagcctgcaattcgtcgattggctcgacgaggcggtgttaaaaggataagtggtcttatctatgaagaaactcgaggtgttcttaagatctttttggagaatgttattagagatgcagttacttacactgagcatgctcgtcgtaaaactgttactgccatggatgttgtttatgctttaaagagacagggtcgtactctttatggttttgggggttagattttgtttgctgtttttcaatttcaatgtaattgcaaattagatggtttatatgaaatggatgcgtttttaaataaaaaaaaaaaaaaaaaactcgagttttttttttttttttttgaaaataaactcggtccttatattagaattgcaaataagaaaatgttggcatcacaaaaatttgctagtcactacaaccaaaacgccacccaaaaccaacacagtaagatcataatcttttaaaacaaaattaattcagaaccctaaactaccgctaactgatcaaatgaaatttctgggccactttcgagcattggaaaacataattaacatagaagattttgagtgaccaaagttgtcacaaacccacaaatagctagcccctactccttttggaacaaaattcccaaagggaaatttatctcccttccccgaaaggacaacctcgtaaactggcccaacccctggggctggccaaaatgtttgcaatccccccccccacgtttgggatagttaaacgggtaaattaaaatcccggccttactcctgaaaaaatttggattcccaacctttatttgcttcttttaaccccccgggggcacaggaaatttttgaacccccccgccattcccagggtgggggaaattaggaaggttggaaatttaaggggaatttccgaattaacaccctcaggccaattgacccattcccgtttcccttggggtcacaaaaaactttcccccaggggtccctcgggaagacggattttgccaacttggggccttggacccccatttttttggcaaacctttaagggtcccccaatttttttttaaaaccgctcttcccgcactatgaa

SEQ ID NO: 3640 - DNA, 628 bp, Brassica napus
  misc_feature (14)..(14): n is a, c, g, or t
  misc_feature (18)..(18): n is a, c, g, or t
  misc_feature (21)..(21): n is a, c, g, or t
  misc_feature (23)..(24): n is a, c, g, or t
  misc_feature (28)..(29): n is a, c, g, or t
  misc_feature (33)..(36): n is a, c, g, or t
  misc_feature (43)..(43): n is a, c, g, or t
aaaaaaaaaaaaanaaantcnannctannctcnnnntcttctncatcacaaactttctcaatcggaaaaaaatgtcgggccgtggaaagggaggaaagggtttgggcaaaggaggagccaagcgtcacaggaaggttctgagagacaacatccaagggatcaccaagccggcgattcggagactggctcgtagaggtggagtcaaacgtatcagtggtctcatctacgaggagacacgtggcgtcctcaagatctttttggagaacgtcatccgtgatgccgttacttacaccgagcacgccaggaggaagacggtgaccgccatggacgtcgtctatgctctgaagaggcaggggaggactctctacgggttcggcggttaagggtcttcttagattcgcgtttgcgtttctgggtttcttttccggaaatttctaatcaaatcatgttctacttagcgtttgcgtttgaattatgtctgggtacggcgtttatgtgttgcggtagcgtttcgttttatatgtaattgcgccttttatcttatgtttttagcgatgcaatgtcgaagtaatccaaggttaagtttctggtaaaatatattcgaatttttttttttttttttggtaac

SEQ ID NO: 3641 - DNA, 588 bp, Lactuca sativa
  misc_feature (9)..(9): n is a, c, g, or t
gcgggggangtctgttcttcgtttccctcctctacagaagcttttattaagactttcaatcaatttgaaaatgtcaggacgtggaaagggaggaaagggattgggaaagggaggagcgaaacgtcataggaaggttctccgtgacaacattcaggggatcacgaagccggcgatccgtcgtctggcgaggagaggcggtgtgaagcgtatcagtggtttgatatacgaagagactcgtggagtattgaagatctttttggagaatgtgatcagagacgccgttacatacacagaacatgctcgccggaaaactgttacagccatggatgtcgtgtatgcgttgaagaggcaaggccgtactctttacggatttggtggttaaggtttgtctgtttagaaaaagtcttgctatcaagaaagaaaagggttaaggttagggttagagttcttcctatttgggtcgggttgggatccacattgttgtttaaatttactcgatttaatgtaattagttggctatgcaatgaatgagttgatgcttattttaaccttactgttctaattgatttgacagttacttgtctaaaa

SEQ ID NO: 3642 - DNA, 528 bp, Lactuca sativa
  misc_feature (527)..(527): n is a, c, g, or t
cttggcggggacattcatcctccatctcttcctcagaaacttgaaattcaagaacttgtttcatttgacaatgtctggccgtggaaagggtggaaaagggttgggtaagggaggagcaaagcgtcatcggaaagttctcagggataacatccagggaatcactaagccagcgatcaggagactggcgaggagaggaggagtgaagaggatcagcggtctgatctatgaagagacacgaggtgttttgaagatctttttggagaatgttattcgtgatgctgtcacctacactgaacacgctcgtaggaagactgtgacagctatggatgttgtgtatgctttgaagaggcagggaagaactttgtatggattcggaggttaatagatctaagaagtgggtagtgaatattttgcttaagttggtgtaatgaatcatgtctgtttttgggacaatttggttacatgatatcaatgttttgttgtttgggatgtgtaattgaatggaaatcttttatgatttgaccaana

SEQ ID NO: 3643 - DNA, 574 bp, Raphanus sativus
gggaaactacaactgagaatcttctttattttctcaaggaaaaaaaaatccaattcccatcggaaagaaatgtcgggtcgtggaaagggaggaaagggtttgggcaaaggaggagccaagcgtcacaggaaggttctgagagacaacatccagggaatcaccaagcctgctattcggaggttggctcgcaggggtggagtcaagcgtatcagtggtctgatctacgaggagacacgtggagtcctcaagatctttttggagaacgtcatccgtgacgccgtgacatacaccgagcacgctaggaggaagactgtgacggccatggatgtcgtctatgcgttgaagaggcaagggaggacgctttacggattcggcggttaagggtcttttgagattcgcgtttgcgtttctgggtttcatttaggtgttcttctggaaatttctaatcaaatcgtgttatccagtgttttcgtttttaattctgtttgggtacggtctttgtgtgttgcggtagcgtttcgttacatgtaatgtaattacgcattttatcaatgaagctgttcgagtttatgta

SEQ ID NO: 3644 - DNA, 539 bp, Triticum aestivum
cccacagaaaaatccccaattccttcgtcttcctcttcgcggacgcacacagcagagcacacagcgagaagatgtccgggcgcggcaagggcggcaaggggctgggcaagggcggggcgaagcggcacaggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccgtcacctacaccgagcacgcgcgccgcaagaccgtcactgccatggacgtcgtgtacgcgctcaagcgccagggccgcaccctgtacggcttcggcggttaggggatagctagcttcagtgtgtctaccaggtcgctgctccgcgaatgcttgtgcctgtggtttaatttaatgcttgttgtgaggaagtgctatctggatttgtttctctgttcaatatcgtcagtccagccattgcttctgatttgaaaaaaaaaa

SEQ ID NO: 3645 - DNA, 516 bp, Triticum aestivum
  misc_feature (2)..(2): n is a, c, g, or t
gnccgaggttcgctctacacctcaccaagacaggtctacctcaccggagagaaaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccagattagagtgtctggggttcgtggtcgttgatgtaattgcagcatctcgctgttgtttgctatcttctgtagaatggaatggaatggaaattgaactagtttatccttgaaattttgcagtc

SEQ ID NO: 3646 - DNA, 576 bp, Triticum aestivum
gaattcggcacgaggagcacttcctcttcttcccaatctcgcacacctctcggagctaggcggagcggcgatgtcggggcgcggcaagggcggcaaggggctgggcaagggcggcgccaagcgccaccggaaggtgctccgcgacaacatccagggcatcaccaagccggcgatccggaggctggccaggaggggcggcgtgaagcgcatctccggcctcatctacgaggagacacgcggcgtgctcaagatcttcctcgagaacgtcatccgcgacgccgtcacctacacagagcacgcccgccgcaagaccgtcaccgccatggacgtcgtctacgcgctcaagcgccagggccgcaccctctacggcttcggaggctagatccgtgggttccgcgggtggcggtagcggtagttgggactgtgtctgtcgtgtgtcctctgtgatgtgtgctgtgggagatgggatttgctaccgctttggcgtgcgtcgttgtgttccgtgtcttgtgttcataggctgtaataccttgttgcggtcaatgaaactagttctgttctgaatccaaaaaaaaa

SEQ ID NO: 3647 - DNA, 737 bp, Triticum aestivum
acatcaccagcagccaccaccgttcctccgattctacatctgctcgcagctcgaagaggatcgtcagccatgtccggccgcggcaagggaggcaaggggctcggcaagggaggcgcgaagcgccaccggaaggtgctgcgggacaacatccagggcatcaccaagccggcgatccggcggctggcccgtaggggcggcgtgaagcgcatctcggggctcatctacgaggagacccgcggtgtgctcaagatcttcctcgagaacgtcatccgcgatgccgtcacctacaccgagcacgcccgacgcaagaccgtcaccgccatggacgtcgtctacgcgctcaagcgccagggccgcaccctctacggattcggcggctaggccaccaccagatcagtagcctgatagtcgggtgtagtcgcagcatctcgctgctgtttgtcctgccttgtttgttctctggatgtacttctgtactaggatggaatggaaattgcagcagtttacccttgaattcgtacctagtctgtgggtctgttgatgtttgttcgtgcgcgtggtcagatgttaccagtgcgttcttcagttgtcttgctctgtaaatttcagcccccaaatctgattgtgtaggcttcggtgtttggatcctattttgtggtggattcaaaccaaaccatattgtgattggcttctgtgtttggtggatagaaatcaaatcctattttctgttggtttca

SEQ ID NO: 3648 - DNA, 654 bp, Triticum aestivum
  misc_feature (3)..(3): n is a, c, g, or t
  misc_feature (11)..(11): n is a, c, g, or t
ggnctgcaggnaattcggcacgaaaatccccaaatcccctctcttcccaagctactcggagcaggcagccatgtcggggcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctgtacggcttcggcggctgaagagccgcggcgctggctggccctggcgcacaagccctggctcgcggtcaagaaatcgaaggaggagagaaagctgtagttgatttgggttctgtgccttccatgcttagtactagtagtatcctatgcttagtagtttgcttccgtgttctgaacctgatgggcaaatactgtgttcgccgagttatatgattcagttaacgaattgttctctagttatgaattatgctaatgacgatgctattctgttttaaaactctttgtgctaccgc

SEQ ID NO: 3649 - DNA, 622 bp, Triticum aestivum
aattcggcacgagcgagccaccaccgttcctccgattccacatccgctcgcagcttgagaccgtcagccatgtccgggcgcggcaagggaggcaagggtctcggcaagggcggcgccaagcgccacaggaaggttctgcgcgacaacatccagggcatcaccaagccggcgatccggcgcctggcgcggaggggcggcgtgaagcgcatctccggcctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgtcagggccgcaccctctacggcttcggcggttagggccggccggccgacggtcgtcactctttgtcgccgcctgcagattccagaagcctgatgaaaccccgacttgtttagttcgccattttctctgtagctcgaactgaatcgtggaacaaagttattcgcatgtgttgttggaaatgaaacttgtctctgctaatgccgtgtttctgattttgtcttgctggttggtctctgttgggtacgatattgaggtggtgatgagttgatttgccat

SEQ ID NO: 3650 - DNA, 573 bp, Triticum aestivum
caagccaccaccgctcctcgacctccatccgctctctcaactcgaaccaaggcgagttcgtcagcgaccatgtccgggcgcggcaagggaggcaaggggctgggcaagggcggcgccaagcgccaccggaaggtgctccgcgacaacatccagggcatcaccaagccggcgatccggcgcctcgctcggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggataggcgccccccttcgtcagcaactctgccccgctgtggccgcagacgggagaagtctgccatgtcttatgttcagtagctgtagccggaacaatgtcacctgttctcccatctgtctatcgcagaatctctctagttaccttgtagctccatgagcccagtcgtgtaatcgaatatatcgtcttaccgtgcaaa

SEQ ID NO: 3651 - DNA, 790 bp, Triticum aestivum
  misc_feature (526)..(526): n is a, c, g, or t
  misc_feature (546)..(546): n is a, c, g, or t
  misc_feature (550)..(550): n is a, c, g, or t
  misc_feature (676)..(676): n is a, c, g, or t
cggcacgagccaaatccatccgatccaatctgcccgctcgcagctccacggaaggaagccgcgtcaaccatgtcgggccgcggcaagggcgggaaggggctgggcaagggcggcgccaagcgccaccggaaggtgctgcgggacaacatccagggcatcaccaagccggccatccggcggctggcccggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcaccctctacggattcggcggctaggccccctgctccgtccagtctctgctcccgctgttccatctgtccgactgcatgtgtatgaatcgttggtgagggtttggtctgtagttagtgtaaggcgatgtgtatgaatgtaatggggaatcagagttggtattatcttggntgcatctctgctgcgtgttnattngatgcgtttgtgatccattgaggctgtatttgcttaattcagtttttagctgaatgagcgccaaaatttgggtatgcacaaacgttctctggatttaaatgtgtttcttcaccagccattctgttntgcattctgaaactctggaattggtctgaatgttgctgtttcatcggttggttttatctgtgtagttagtggatggcgatggttatgaatgcaatggaatcagtgttctcgcga

SEQ ID NO: 3652 - DNA, 555 bp, Triticum aestivum
acctcatcgctctacacctcacaaagacaggtcaacctcaccgaggagaagaaaggagaagcgagaaggatgtcggggcgcggcaagggaggcaagggtctgggcaagggcggcgccaagcgccaccggaaggtcctccgcgacaacatccagggtatcaccaagccggcgatccgtcgtctggcgcgtcggggcggcgtgaagcgcatctcggggctcatctacgaagagacccgcggcgtgctcaagatcttcctcgagaacgtcatccgcgacgccgtcacctacaccgagcacgcccgccgcaagaccgtcaccgccatggacgtcgtctacgccctcaagcgccagggacgcaccctctacggattcggaggctaggccaccaccgccgccagattagagtgtctagggttcgtggtctttgatgtaatcgcagtatctcgctgttgtttgctatcttctgtagaatggaattgaatggaaatcgaactagtttatccttgaaattctgcagtctgtgtctgattcgtgataaaatcgttctattgcgtt

SEQ ID NO: 3653 - DNA, 577 bp, Zea mays
atggcacaaatcctgctggcctcgagctctcttcaaggaaattcaaagtcacagcggcgaatctctcggcgatgtctggccgcagcaagggcgggaagggtctgagcaatggcggcaccgagcgccaccacaaggtgctgcgtgacaacatccaggacatcaccaagccggtcatcatcatgttggagaggaggggcggcgacaaccgcatctccgggctcatctaccaggagaccagcggcgtgctcaagatcttcctctacaacctcatccgcgacgccctcacctacaccgagcacgcccgccacaagactgtgaccgccatggacgttgtctacgctctcaagcgccagggccgcaccctctacggtttcggcggttaggtcgcccctctcccggtggcgaattacagtagtggcggtggcagtcgtggttgttgttcttggtctagttagtctgtgttgtcataatcagtgctattttctgtggtggttgtactgcatccttctagtaactagtccatgtactgcaatatcctcgctgctgtaatcaagggaatgtcctcgtttcaaggcgg

SEQ ID NO: 3654 - DNA, 625 bp, Elaeis guineensis
tggcgaattccgagatccttcttagtcgtggtcgtgcaagagagaggggagcgagaagaattggagatgtcggggcgaggcaagggaggcaagggattggggaagggcggggcgaagcggcaccgcaaggtccttcgcgataacattcagggcatcacgaagcccgccatccgccgtctagcccgccgcggcggcgtcaagcgcatcagcggcctcatttacgaggagacacgcggcgtccttaaggtttttcttgagaacgtcatccgcgacgccgtcacctacacagagcacgcccgccggaagacggtcaccgccatggacgtcgtctacgccctcaagcgccagggccgcaccctctacggcttcggcggttaaaagaagaaagaaaagaatgcacatcagtgatttgttccatttctagggttagggttagggttttctcacctgttgctgtttcatctttcttgatgtaaaaaagaatttaaagaaaaacaaatattttccccgttgcttcacatgaatgtttttctgatttcatttgaatgtaagtttaggatatcagatgaagtactatgatttgaactttgtaatgataacagttactttttagccccttttttct

SEQ ID NO: 3655 - DNA, 683 bp, Picea glauca
  misc_feature (63)..(63): n is a, c, g, or t
  misc_feature (349)..(349): n is a, c, g, or t
  misc_feature (370)..(370): n is a, c, g, or t
  misc_feature (382)..(382): n is a, c, g, or t
  misc_feature (447)..(447): n is a, c, g, or t
  misc_feature (481)..(481): n is a, c, g, or t
  misc_feature (550)..(550): n is a, c, g, or t
  misc_feature (554)..(554): n is a, c, g, or t
  misc_feature (576)..(576): n is a, c, g, or t
gcacgagggagaggcagagtacgaggtgagagcaaagaagaaagaagaaatacagcaaggagnaaaaatgtcaggccgaggaaagggaggaaagggtttgggcaagggaggtgccaagaggcacaggaaggtgctgagagataacattcaagggattaccaagcctgccatcaggcgtcttgccaggaggggaggcgtgaagcgcatcagcggtctcatctacgaagagaccagaggcgtcctcaagatattcttggagaatgtgatcagggatgccgtcacatacactgagcacgctcggagaaagacggtgactgccatggatgtcgtctattccctgaagaggcanggcaggaccctctatggcttnggaggttaactnatcctgttgcttatttttcatcattttcatacccccacggtgtcttttgacaccaccagtcctcntctggaaatgcgcaacctttcttgggtctttcangtttttgagtagtaggcttggtatttatttggatttcactggtctatttttggtgatgtaagatttatngttnagtttggatgagcgctgggttngatactgtattgaaaaatggtttaaagcacttgattatctgtttctgttttggggtttttatttgagcagcaacaatacaagaatgaaattaattttcgccaaaaaa

SEQ ID NO: 3656 - DNA, 325 bp, Hordeum vulgare
gcggcgccaagcgccatcggaaggtgctccgggacaacatccagggcatcaccaagccggccatccgtcttctcgcgcgcaggggcggcgtgaagcgcatctcggggctcatctacgaagaaccctcggcgtgctcaagatcttcctcgagaacgtcatccgcgacgcagtcacctacaccgagcacgcccgccgcaccaccgtcaccgtcatggacgtcgtctacgcactcaagcgccagggacgcaccctctacggcttcggaggctaggccgtcaaccatatttatattgttctagggtcgactggtcgttgatgtaaccgc

SEQ ID NO: 3657 - DNA, 499 bp, Zea mays
cccagaaaaatccccagttctttggtccgcgtcaaagaggcgccgccgatgtatgggcccggcaagcccggcaagggtatgggcaagggcggcgttaagcgccaccgcaaggtgctccgggacaacatgcagggcatcaccaacccgcccatccggaggctggctagcacgggtggcgtgaagcgcttctcggggctcatttactagaaggcccgcggcgtgctcaagatctttctcgagaacgtcatccgggacgccgtcacttacaccgagcacgggccccgcaagaccgtgcccgccatggacgttgtttacgcgctcaagccccagggccccaccctttacggcttcggaggttagcctagacgcctttttatagtcgcggactggttaggggacatgtctttgtgtgatgctttctgaggtagtattgctgcaatagctgtgtaatccatcgcttctgcaatgaagcgctttgaagcagttgctacgtatgttg

SEQ ID NO: 3658 - DNA, 491 bp, Saccharum officinarum
cattacaagtgccagcaccgaacctctcggttacggtgatgtcggggcgcggcaagggcggcaaggggctgggcaagggcggctccaagcgccagcgcaaggcgctgcgcgacatcatccagagcataaccaagcccgcgatccggaggctggcgaggaggggcggcgtcaagcacatctacgggctcatgtaccaggagacgcgcggtgtgctcaagatcttgctggagaacataatccgccacaccgtcacctacaccaagcacacccgccgcaagaccagtaccgccatggacgtcgtctacgcgctcaagcgccacagccgaaccctctacggcttctgcggctacgtcattcctcatccagtggtgaactgcatgtggtggcggacggggtccagttcagtgccgcgtatagagtgctctagactatctgtgtccatgctgcgtccacaggagtctgagctatatctacgctctgagggaaggtga

SEQ ID NO: 3659 - DNA, 487 bp, Saccharum officinarum
gccccttcgaggcgccggcggcggcgaaatcggggcggggacagggagacaagggtctgggcaagggcggcgcgaaaggcaaccggaaggtgctccgcgaaaacattcaggggatcaccaaaccggcgatccggaggttggcccggaggggcggcgttaagggcatttcgggggttatttaagaggagacccccggggtggtcaagattttccttgagaaagttattcgggaagccgttacctaaaccgagcatgggggccgcaagaccgttaccgccatggaagttgtttaagcggtcaagcggcagggccgcaccctttacgggtttggagggtaggggcctttttgtaactggggaacggttggggaaaatttttttttgtcgctgtgggttgtaatgttgctgcagttgctgcgtttgtggatgtaatcctacagtatgtttttgcaatgaagaaatgggagtaatgatgttttgccaatagt

SEQ ID NO: 3660 - DNA, 378 bp, Jatropha curcas
gtaccgggccccccccggaaagttctccgagataatatttagggcatcacaaagcccgcaatccgacgactcgctagacgtggaggagtaaagcgtatcagtggcttaatctatgaggaaacaagaggtgttctaaagatctttcttgagaatgtaattagagatgctgttacttacaccgaacacgctcgccggaaaactgtcacagcgatggacgttgtttatgccttgaagagacaaggtaggactctttatggttttggtggttagagagatttaggttaggactggggattttgtttgtagcagtggcaaatcattaggaattaatgttttgattttgtattttaatccaaggttttgatgcttgtcttcaga

SEQ ID NO: 3661 - DNA, 344 bp, Triphysaria pusilla
  misc_feature (79)..(80): n is a, c, g, or t
ccccctagcgtgatcccgtgcgggccgcgctcttgcccggtgggattataaaaccggctggggagaaaaaaaaggcggnnagggtttgggaaagggcggcgcccagcgccatcgcatagttctccgcgacaacatccaaggcatcaccaagccagccattcgccggttagctcgccgtggtggagttaaacgaatcagcggcttggtctaccaagagactcgcggcgtcctcaagatcttcctagagaacgtcatccgtgatgccgttacctacactgagcacgctcgccgtaagaccgtctcagccatggacgtcgtatatgctctctaggggcaaggccgta

SEQ ID NO: 3662 - DNA, 547 bp, Festuca arundinacea
  misc_feature (57)..(58): n is a, c, g, or t
  misc_feature (60)..(60): n is a, c, g, or t
  misc_feature (66)..(67): n is a, c, g, or t
  misc_feature (71)..(71): n is a, c, g, or t
  misc_feature (73)..(73): n is a, c, g, or t
  misc_feature (77)..(77): n is a, c, g, or t
  misc_feature (95)..(95): n is a, c, g, or t
  misc_feature (137)..(137): n is a, c, g, or t
  misc_feature (209)..(209): n is a, c, g, or t
  misc_feature (212)..(212): n is a, c, g, or t
  misc_feature (296)..(296): n is a, c, g, or t
  misc_feature (383)..(387): n is a, c, g, or t
  misc_feature (402)..(402): n is a, c, g, or t
  misc_feature (404)..(404): n is a, c, g, or t
  misc_feature (408)..(408): n is a, c, g, or t
  misc_feature (414)..(414): n is a, c, g, or t
  misc_feature (417)..(417): n is a, c, g, or t
  misc_feature (430)..(430): n is a, c, g, or t
  misc_feature (446)..(446): n is a, c, g, or t
  misc_feature (448)..(448): n is a, c, g, or t
  misc_feature (460)..(460): n is a, c, g, or t
  misc_feature (466)..(466): n is a, c, g, or t
ggcacgaggcacgaatccccactccccctcacacacctctcgcagcaagaccagatnncncagccnngtcngnccgnggcaagggaggcaagggnctgggcaagggcggcgccaagcgccaccggaaggtgctccgngacaacatccagggcatcaccaagccggccatccgccgcctcgcccgccgcggcggcgtcaagcgcatctcnggnctcatctacgaggagacccgcggcgtgctcaagatcttcctcgagaacgtcatccgcgacgccgtcacctacaccgagcacgcncgccgcaagaccgtcaccgccatggacgtcgtctacgcgctcaagcgccagggacgcaccctctacggattcggaggctagaggccnnnnncatcttcgtccgcgncngacncgtcgnctnctcgccggcaacngcctgttgtctttccngntgtgttctgttntgttcngtagctgtggttggaacggtgttgttagtttcgcatctctcctttgcagaatctctcttgctagcttgtagctctgtacgg

SEQ ID NO: 3663 - DNA, 463 bp, Raphanus sativus
  misc_feature (173)..(173): n is a, c, g, or t
  misc_feature (176)..(176): n is a, c, g, or t
  misc_feature (217)..(217): n is a, c, g, or t
  misc_feature (247)..(247): n is a, c, g, or t
  misc_feature (268)..(268): n is a, c, g, or t
  misc_feature (328)..(328): n is a, c, g, or t
  misc_feature (358)..(358): n is a, c, g, or t
gggtcaaatctcattttcctgtaaatctccatctccgatcaattcaacagatctaacagaaacgatgtcgggaagaggaaagggaggaaagggactgggaaagggaggagctaagaggcacaggaaagtgctgagggataacatccaaggcatcaccaagcccgcgatccgtngtntcgctcgcagaggtggagtcaagcgtatcagtggcctgatntacgaggagaccagaggagtcctcaagatnttcctcgagaacgtcatccgngacgccgtcacctacaccgagcacgcgcgcaggaagactgttactgctatggatgtggtntatgctctcaagaggcaaggacgcactctntacgggttcggcggttaattcaacgatggttgggggtttagggtcgttaaattgtagctaaatcttgtgctgttaagttctcaattgaaagtgatgtctttgtta

SEQ ID NO: 3664 - DNA, 1028 bp, Citrus sinensis
caggccattcaaatttctcacttaaattctctttcaagggacagcagaaagtcttttaagttcctcgctaaaatgtctggccgcggtaagggaggcaagggattggggaagggaggtgccaagcgtcaccgtaaggtgcttcgcgacaacattcagggtatcacaaagccagcaatccgacgtttggctcgtagaggtggagtcaagcgtatcagtggcttgatctacgaagagacacgtggcgtcctgaagatattcttggagaacgtcatccgtcacgccgtgacctacactgaacacgccaaggagaaaaaccgtgaaccgcgatggacgtccttttaccctctccagaaaggcgggggcaggactcttttatggattttggggggttaattgtctttagggtctggggaaataaaatgttaataaaatctttacccctaaaacttttgatctgggaaaaaggggggcccctttaaaaaatttgtttatttaagggttgcccggcttttttaaaatttccattccaaaataaacacctttatcctttttaaattttaaaaaaaatatatttttttaaaattttttccccacaaaatataccggccaacttttttttttgctcctccccaaatggggaccccaaaatttttttaatttttttttaaaaccacccctttttttttttaaaaaaaaaaaaaaaaaaaaaaaagggggggcgccgcccccccaaaaaaaaaagagaaacacaaaccctaattaatacctaccggcggcggttgtgaacaagacctacaacattttcttctttcctttatatagtgggtccccccccacaacttttacatcttttttcctccccgcgccccgcccgcgcctctttctaaaaaaaaaaaatacgccggcagacgattggtaggagagaaaaaaaacaaacccacgcccaggtggtgttaattcaaaactcactcatcacctcttctaattttatataatctacccagcctttaactctcctactttatgac

SEQ ID NO: 3665 - DNA, 596 bp, Festuca arundinacea
  misc_feature (579)..(579): n is a, c, g, or t
ggcacgaggaccaccttccaccaccgcctcctcgagttcaatccgctcgcagcagctgcagtcaaggtcagccatgtcgggccgcggcaagggaggcaaggggctcggcaagggcggcgccaagcgccaccgcaaggtgctccgcgacaacatccagggcatcaccaagccggccatccggcgcctcgctcgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggacgcaccctctacggcttcggcggctagaggccttcctcctcttcgtccgcgccgaacccgtcgcctcctcgcctcgccgtcaacagcctgttgtcttctagtgtgttctgttctgttcagtagctgtagttggaacaatgttactagttcgccttctgtccgtcgcaagatctatctagctagcttgtaatagctctgtatgagcccagatctgaaatcgnttatattatcttccccc

SEQ ID NO: 3666 - DNA, 599 bp, Festuca arundinacea
  misc_feature (71)..(71): n is a, c, g, or t
ggcacgaggcaccaccagcaccaccgctcctcgagttcaatccgttcgcagcagctcgagtcaaggtcagncatgtcgggccgcggcaagggaggcaaggggctcggcaagggcggcgccaagcgccaccgcaaggtcctccgcgacaacatccagggcatcaccaagccggcgatccggcgccttgcccgccgtggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctagaggcctctcctcctcctcgtccgcgctgaacccgtcgcctcctcgcctcgccgtcaacagcctgttgtcttccgcagtgtgttctgttctgtgttcggtagttgtagttggaaccatgttactagttcgccatttgtccttcgcaagatctacctagctagcttgtaatagctctgtatgagcctagatctgaattcgaatatattatctccccc

SEQ ID NO: 3667 - DNA, 616 bp, Ipomoea nil
caaatctacttgtccattttacctctcactccacaaattccaaaccctagatttcttccttcactctgcaaaaatgtccggccgtggaaagggaggcaagggattgggcaagggaggagccaagcgtcacaggaaggtgcttcgcgacaacatccaggggatcaccaagccggccattcgccgtctggctcgtagaggaggcgtgaagcgtatctccggcctcatctacgaggagaccaggggagtcctcaaaatcttcctcgagaatgtgatcagagacgccgtgacctacactgagcacgctcggaggaagaccgtgactgcgatggacgtcgtctacgccctcaagaggcagggcaggactctgtacggtttcggaggctaggatattgtgagctattggatgttcgtctgtgtgattgcagatctgttcgactatttccttttagctgttagtcctgtgtttaggttctaggtagcgattgcctgcttgtttcgtgattggcaatttagaagtaaatgtagtattctgttgcagttaagcattgctaataccttttctgattttgtgaatcaatacaactttatctgctctatgaaaattgaatttcattcc

SEQ ID NO: 3668 - DNA, 580 bp, Lactuca sativa
ggcggggattcagtatattcatctctctacagaaatccgaagctttttcagtttgcgaagtgattattccaacaatgtcaggacgtggaaagggtggaaagggtcttggcaagggaggagcaaagcgtcatcggaaagttctccgtgataacattcagggaatcacaaagccagctatcaggaggttagcgaggaggggaggtgtaaagaggatcagtggtctgatctatgaagaaaccagaggtgtactgaaaatatttttggaaaatgttattcgtgatgcagttacatacactgagcatgctcgaaggaagactgtaactgcaatggatgttgtctacgctctgaagaggcaaggaaggactctttacggatttggaggctgagacccataatggattcttcataccttcttatatctattttctcaccctttcattttggtagtgatttcgtttatcaaattgtgactgtggatctatctacgaaattttcatcttttagatctggtagctttatgtaaatcgaatgtttcaatcctcaaaaaggacaatattaatttgatctactgctttttgtt

SEQ ID NO: 3669 - DNA, 531 bp, Rosa hybrid cultivar
  misc_feature (295)..(295): n is a, c, g, or t
  misc_feature (355)..(355): n is a, c, g, or t
  misc_feature (518)..(518): n is a, c, g, or t
gacatcaaaccatctcaattctctcatcttccatcaaaaacagagtttctctcctttaaattttccggtgaaaatgtcaggccgcggcaagggaggcaaggggttgggcaaaggaggagccaagcgtcacaggaaggttctgagggataacatccagggcatcaccaagcccgccattcgccgtttggctcgcagaggcggcgtcaagcgtatctccggtctcatctacgaagagacccgaggtgtcctcaagatcttcctcgagaacgtcatccgtgacgccgtcacctacacngagcacgcccggaggaagaccgtcaccgccatggatgtcgtctatgctctcaagaggcanggaaggaccctttatggatttgggggttaaatggttgggtattagtgtagggttggttccaaaatttggatttagatctgggtgtaacgaatactctgtggttaagtttgctgttcatgtaatttggacgtatttagaagtaatagaactttgatttcccaanaaaaaaaaaaaaa

SEQ ID NO: 3670 - DNA, 624 bp, Triticum aestivum
cgggagacgtgccaccaccgctcctccaatcccacattcgctccaagctcgaacaaaggagagaccgtcagccatgtccgggcgcggcaagggaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggccgcaccctctacggcttcggcggctaggctcgtcctcgcctccctgcaaattccgatgtgcttgttcgcatgtgcgcaggagtctcgctgtcgagaaaacttagctgaaatgaaatccccatgtttatctccgctgtttccttcgtaggattagctgtatcgtcaaacaaagctgttcgcatctgaagcttgagtccaatcttgtgtctacgcaaaaattgtggttctgttgtgatttttaccactgggctgttgcaaaaaaaaaa

SEQ ID NO: 3671 - DNA, 576 bp, Triticum aestivum
atctcgccacaccgccgaccaccaccagcaacacacacacagcagccaagcgaagctcgccgcagatcgaagatgtcgggccgcggcaagggcgggaaggggctgggcaagggtggcgccaagcgccaccgaaaggttctccgcgacaacatccagggcatcaccaagccggccatccgtcggctggcgcggcggggcggcgtgaagcgcatctcggggctcatctacgaggagacccgcggtgtgctcaagatcttcctggagaacgtcatccgcgacgccgtcacctacaccgagcacgcccgccgcaagaccgtcaccgccatggacgttgtctacgccctcaagcgccagggccgcaccctctacggattcggcggctaggccgcgccggtccactcatatccacgtcgcgccgccagattagtagctagccatggttgttcagtgttcatggtcttgggtgtaatggtcgcatctcgccgctgtatgtcctggccatgattgttgtttggatgtagtcagatctgggatggaattgaagtggtttacccttgaattcttctgcaatctctc

SEQ ID NO: 3672 - DNA, 665 bp, Triticum aestivum
  misc_feature (7)..(7): n is a, c, g, or t
tgcaggnaattcggcacgagggccgcaacacacacagagaagccaatctcgccggagaaagaagcgtcgacgatgtccggccgcggcaagggagggaaggggctgggcaagggcggcgccaagcgccaccggaaggtgctgcgcgacaacatccagggcatcaccaagccggccatccgtcgtctggctcggcgtggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggacgcaccctctacggattcggcggctaggccgcgccggtccagcagaacccacctcccgccgccagattcactagctagccatcggtcgtccgtgttcatggtctttgttgtaatggaacggccgcatctcgctgctgtctgttgtttcgatgtagtactactagcatggaatggaaatctcagcgtttttacccctgaattcgtctgcagtctcttagttgtgagctttgttgaatcttagcagttatttcgtattgcctgtcactgtaattttctgccccaaatccattgtgttggtgtcggtgtgc

SEQ ID NO: 3673 - DNA, 601 bp, Triticum aestivum
acaatcatcccaccagccgccaccaccaccgctcctcatccgtttccatctcagtcagctccaagcagtcaaccatgtccggccgcggcaagggcgggaagggcctcggcaagggcggcgcgaagcgtcatcggaaggtgctgcgggacaacatccagggcatcaccaagccggcgatccgtcgtctggctcgccgtggcggcgtgaagcgcatctcggggctcatctacgaggagacccgaggcgtgctcaagatcttcctcgagaacgtcatccgcgacgccgtcacctacaccgagcacgcccgccgcaagaccgtcaccgccatggacgtcgtctacgcgctcaagcgacagggacgcaccctctacggcttcggcggctgacctgcgcctgctgctgctccatcgagtcgactctgctggatgctgctcctgttctcgtgctacggtttcgtttctgagtgcgtgagtttggtgttctgtcggtctgtgtagtctgtgcctttgtggaaggcgatgggtctgaatgtaatggaattgttggttcttgcaagaaatgaatctgaatgcaacggaaaaattgtactgcaaaaaaaaaa

SEQ ID NO: 3674 - DNA, 580 bp, Triticum aestivum
ggcaacagccaccaccaggccagcagcgcgcacacacaccagccaagctcgccggagagagaagcctcgaagatgtccggccgcggcaagggagggaaggggctgggcaagggcggcgcaaagcgccaccggaaggtgctgcgcgacaacatccagggcatcaccaagccggccatccgccgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagacagtcaccgccatggacgtcgtctacgcgctcaagcgccagggccgcaccctctacggcttcggcggctaggccgcgcccgtccactcgaatccacctcgcgctggtagccagattcgtagcatatatagctagctatgggtgtccactgttcattgtcttcattgtaatggccgcatctcgctgctcttgttcagtgttcagtgattggatgtacatcagtgatactagaatggaaatcgcagcattttaccctcgaaaaaaaaaa

SEQ ID NO: 3675 - DNA, 551 bp, Triticum aestivum
acattaccaaccaccaccgctcctccaaccccacattagctcatcagcagctcgaagaggatcgtcggcgaccatgtccgggcgcggcaagggaggcaaggggctcggcaagggcggcgccaagcgccacaggaaggtgctgcgcgacaacatccagggcatcaccaagccggcgatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggctcgtcctcgccccccctcctgcagatccccaaagtttgatgataccgcgacttgtctagttctctgtatgctctgtagttcgaactgaatcgtggaacaaagttattcgcatatgttgctggaaatcaaacccctgtctgtgcaaataccgtgtttctgaattt

SEQ ID NO: 3676 - DNA, 529 bp, Triticum aestivum
acagcaccagcagccaccaccgttcctccgattccactacatccgctcgcaggtcgaagaggatcgtcagccatgtccgggcgcggcaagggaggcaaggggctcggcaagggcggcgccaagcgccaccggaaggtgctgcgcgacaacatccagggcatcaccaagccggcgatccggcgcctggcgcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctttatggcttcggcggctaggttctttgtcgcctcctgcagattccaaaagcttgatggaaccctgacttgttcagttcgctgtttcctctgtctgtgtagttcgaactgaatcgtggaacaaagtaatttgcatatcttgttggaaatgatacttgtctttgtc

SEQ ID NO: 3677 - DNA, 1318 bp, Pinus taeda
  misc_feature (760)..(760): n is a, c, g, or t
cggccggggatcgtctgttattcttcatcttcattgttcgagtatcagaggaatttaccttcaggaaagatgtctgggcgtggaaagggaggcaagggtttggggaaaggtggtgccaagaggcacaggaaggtgctgcgagataacattcagggcattaccaagcctgccatcaggcgtcttgccaggagaggaggtgtcaagcgtatcagtgggctcatctatgaagagaccagaggtgttttgaagatcttcttggagaatgtgatcagagatgccgtgacatacacagagcacgccaggagaaagaccgtgacggcaatggatgttgtctactccctaaagaggcagggccgaaccctttacggcttcggaggctgagaagtttcgattcgtgtctctggtttttgatcatttctttaccaatggtgtctgttgacaccacccttttctatttgggaatggtaaccttgataggtccttctatttattgagcagattgtggtttctttttaagggtattaatgagatttacagtaattgttagtaacggggatgttttaagcttttattgctgaaagttgcctgtatttcgtagcctgaaagttgcagtcgattaataaacgttatctttggcttttgtgattagcggtgaaggtatttggtgatttttcaacgttagtggtctctttgcttcggggaaaatggctcagaaagaaagacaagggttttaggcagttgtagcaaggaaaccctaatnctgattgcaggaaagtaaatgacggaacgaaaccctaatcttggtgctcttctataatttagttgtcttcgatgcagaacgcctggcatttatttgctgggtttcatcgtacatttgtctgtgtttttaccaggatgagtcaactcatttttaacaataaccaaatggtaagctactgtattgctacctggttcttttgggtcaattccatttcctcggcagtgcaatttaatggtggatgttaaatcagactcgccccccttataaaatggtggttgaacattagccagggaatcttgtaaggattgtggaagaagccccttctgctatggagatgattcactaaaggggttcgctgcgttcgccacagtcgatatctatggtccaagtgaatgagtcctagctgagaagcctcaacaggttttaaagatatacagaacgcacttatccgatatcttttaaggtattgctactcctttgtggacccccatgagctctcagagagtactggatcttgtaaatccatacttgtggaatttgaatatgtaactatagcga

SEQ ID NO: 3678 - DNA, 602 bp, Secale cereale
tcggcacgaggccgctccctcgacctctatccgctctcccagctcgaaccaaggtagatcgtcggcgaccatgtccgggcgcggcaagggaggcaagggtctcggcaagggcggcgccaagcgccacaggaaggtgctgcgcgacaacatccagggcatcaccaagcctgccatccggcgcctggctcggaggggcggcgtgaagcgcatctccggcctcatctacgaggagacccgcggcgtgctcaagatcttcctcgagaacgtcatccgcgacacagtcacctacaccgagcacgcccgccgcaagaccgtcacagccatggacgtcgtctacgcgctcaagcgccagggccgcaccctctacggcttcggcggctaggctcttccttgccccctgcagaatccgatgtgcttgtcggcctgtgcgcaggagtctcgctgtccagaaaactttagccgaaatgaattccacatgtttatccccgctgtttcctaagtaggattagctgtatcgtggatcaaaaagctgttcgcatctgaagtttgagtccaatcttgtgtctatcccaaatattctgctgcgctgttgcaattgtgat

SEQ ID NO: 3679 - DNA, 674 bp, Glycine max
aaaatcacaatccctaattccccaaaattttctctgaagaagaagcaacaatgtctggtcgcggaaaagggaggcaagggtttgggaaagggtggagcgaagaggcatcgcaaggtgctccgcgacaacatccagggaatcacgaaacccgcgattcggaggctagccagaagaggcggcgtgaaaagaatcagcggcttgatctacgaggaaaccaggggtgtgctcaagatcttcctcgagaacgtcattcgcgacgccgtcacctacaccgagcacgctaggagaaagaccgtcacggccatggacgtcgtttacgcgctcaagaggcagggaagaaccctctacggtttcggaggctgagggcttgggctttttctgggcctggatttgttcttcgctgggctttaaaatgttgttgggaatttgtgttttgtttaatggttatgtatattatcttctgctcggtaatgcaagacttactcaagtttcttctattattctaatttctactaataattgcatcctagttagtgtgaatttgaagtaaatttagtgaatgacaaatggttatatgaatttcgtgtgttgaatactttctatttggattttcgttgtatgtgataattcggctactgtggattaagttgaagttcaagctaagcgttcttggc

SEQ ID NO: 3680 - DNA, 473 bp, Triticum aestivum
  misc_feature (342)..(342): n is a, c, g, or t
  misc_feature (363)..(363): n is a, c, g, or t
  misc_feature (384)..(384): n is a, c, g, or t
  misc_feature (422)..(422): n is a, c, g, or t
  misc_feature (425)..(425): n is a, c, g, or t
  misc_feature (460)..(460): n is a, c, g, or t
  misc_feature (466)..(466): n is a, c, g, or t
cttcaaacctatcaattcatctccagtagcaaaccctacattcacaatcaccatcattaactcaacttaactcgaaaatgacaggacgtggaaaaggaggcaaagggctcggaaagggtggtgcgaaaagacatagaaaaatcctacgggacaatattcaaggaataactaaacctgccatacgccgtctggcacgcagaggaggcgtcaagcgtatttcagctatgatatatgaagaaacccgtggagtcctcaaaactttcctcgagggggttattagagatgctgtgacttacactgagcatgccaagaggaagacagtcacaagtttagatgttgtcnacgcgctaaagaggcaagggnagaaccctatacgggtttggnggttaacttagttgggaagaccaaaacacacccgtgcnaangtgaaatgagggaggagttattagggcgagggaangggtanccaaatt

SEQ ID NO: 3681 - DNA, 553 bp, Triticum aestivum
atcagactccctccaaagcaggcagcagctcctcttcttcctaatcacactatctcggagaggagcggccatgtctgggcgcgacaagggcggcaaggggctgggcaagggcggcgccaagcggcaccggaaggtcctccgcgacaacatccagggcatcaccaagccggcgatccggaggctggccaggaggggcggcgtgaagcgcatctccggcctcatctacgaggagacccgcggcgtcctcaagatcttcctcgagaacgtcatccgcgacgccgtcacctacaccgagcacgcccgccgcaaaaccgtcaccgccatggacgtcgtctacgcgctcaagcgccagggccgcaccctctacggcttcggaggctagatttgtgtggtgaagcaacttcctcgtttgctctgtgatctgtgctgtcgtagatgagatttactgatttggcgtgcgccggttgtattctgtcatggggttcagtaggctgtgtaataccttgctctgtacttctgttcaatgcaatcacttctattctgaaaaaaaaaa

SEQ ID NO: 3682 - DNA, 564 bp, Festuca arundinacea
ggcacgaggggaaggtcctccgcgacaacatccagggcatcaccaagccggccatccgcaggctcgcccgccgcggcggcgtcaagcgcatctcgggcctcatctacgaggagacccgcggcgtcctcaagatcttcctcgagaacgtcatccgcgacgccgtcacctacaccgagcacgccagacgcaagaccgtcaccgccatggacgtcgtctacgcgctcaagcgacagggacgcaccctctacggattcggcggctgaggacatcagtcgcggcgctgcatggccgtgtgccggaagtcttggctcgcggtcaagaaactgaggagacgaggaaaccgtattactagttgattttggttccctgctttaattccattggtagtagttgtagcagcatcgtcagcagtgctagagtgtttggtcgtgcaaagtttgttctgtgttttctttcatcttctcagcttctgatgggcaaatatcgtgtttgccgagttatatgattccagcactagtaacaaggttgtccttcagctttgaattaggccatcaacattctgtt

SEQ ID NO: 3683 - DNA, 712 bp, Solanum tuberosum
tattaaggagtttaattcattaaacgatttgaatcaactattagagaacattgaacttgcaattgtctcttataatcccaacttcgttaatgcagaataggagggagaatgtctaataggcgttaaagcaaatcctgtaacaccatcttaaacatgttgcacagatttgccaaattcaaaaccctagaaacttcatcttcttcaaatttctctgtgaaaatgtctggccatggaaagggaggcaagggattgggaaagggaggagccaagaggcacaggaaggttctaagagataacatccagggtatcactaagccagctattcgcaggcttgctcgtaggggtggtgtgaagcgtatctccggtctgatctatgaggagacccgtggagtattgaagatctttttggagaatgtgattcgtgactctgtcacctacaccgagcatgccaggaggaagactgttactgctatggatgttgtctatgccctcaagagacagggaaggactctctatggatttggcggttagattctggagtttggttggtgtaatggtagtaactgtaggtttagtttacattgcgtttgtggctggtgtagctgtggattttaattctctgtagcttctttttgggtcttgttgttaagctctatattttgttaatattcaagtaatcaagttcacctttccagaaaaacaaaacaaaaaa

SEQ ID NO: 3684 - DNA, 633 bp, Picea glauca
  misc_feature (5)..(6): n is a, c, g, or t
ggganngacggagtgcttgtttacagggcaaagaaaggcaggccagagaatagaagaaacagaaacatgtctgggcgtggaaagggaggcaagggtttggggaaaggaggtgcgaagaggcacaggaaggttttgagagataatatccaggggataacaaagccggccataaggcgtcttgccaggaggggaggcgtcaagcgcatcagcggcctcatctacgaagaaacgaggggggttttgaagatcttcttggagaatgtcatcaaggacgccgtcacttacactgagcacgcccggaggaagaccgtcactgccatggatgttgtctattctctcaagaggcagggcaggaccctctatggcttcggtggctgagtaacctaaaatggactgtgcaacccgagttctcaaactccaatctctcagtccattcatttttccttctgttctttctttcatggtgtttcttgacaccaccctactgtgcctctggaagttcttccctgttgctgtctgtcaaaatctggagcaaaaacagaaaataggtgtgcttgagacatcttgttacaggtttaaaatgttaatctacaatgcttgtcttttttaatttattttggcttcaataaaaaa

SEQ ID NO: 3685 - DNA, 588 bp, Saccharum officinarum
cagctcaccccaccaacagcaagcaatcgaaaaaaaatccccaatcccctcgtctccgcggcgaaggtgtcggggcgcggcaagggcggcaggggcttgggcaagggcggcgcgaagcgtcaccggaaggtgctccgcgacaacatccaggggatcacgaagccggcgatccggaggctggctcggaggggcggcgtgaagcgcatctctgggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggtttcggcggctaggccggccgcgcctcgcccgtctccttcgtccgcctgtgttgccgtcgctgtggttgtagtgttgctgcaattcgctagttgtgcctgggtgagaaaaaaaatgctactgtggcaagcatgttgcatatgttgtctgtttctgattgagtcttattctgaagaaatatgccaatgatacttgctcaaggttcaagcatgccccatttgttc

SEQ ID NO: 3686 - DNA, 466 bp, Pisum sativum
cagacaagtgcttcgtgacaacatccagggaattaccaagcctgcaattcgccgtttggccagaagaggcggtgtgaagagaatcagtggtctcatctatgaagaaactcgtggcgttctcaagatctttctcgagaacgttattcgtgatgctgtgacatacacagagcacgctaggaggaaaaccgttaccgccatggatgtggtttatgctctcaagaggcagggaaggactctctacggtttcggtggttgattttaggattcaatttagggtttcgtattatctagctgcggttagatgtaaatgtatgttaaaaatcagggaatattccaatttgtaatcttgttttggttcattcaggttaggtcagttttttatctgtttgagctgaactgttacaagtagttgtgattcttgatttggaagtttatcttaatgaagaatactctcttttcttcaatt

SEQ ID NO: 3687 - DNA, 786 bp, Hordeum vulgare
cagccacaccgcaggtcctcctccgttccgttcccaaactccgtcaaccatgtccggccgcggcaagggcgggaagggcctgggcaagggcggcgcgaagcgccaccggaaggtgctgcgggacaacatccagggcatcaccaagccggccatccaactgctggcgcggcgcggcagcatgaagcgcatctcggggctcatctacgaggagacccgcggcgtgctcaagatctggctggagaacgtgatgcgcgacgccgtcacctacaccgagcactcccggcgtaggaccgtgaccggcatggacggtgtctacgcgctgaatcaccatggcgcgtccctctgctgattcggatgttgatctatatggctagttcgcgtccgacttctacctacttgctggctatcgtgccgacatagaggtgtgccctggagagttgtaccggtgcaactcagtgtgagagtggcatccgccatgccgagtgccagagggcagtgcttagtgcaaagggagtggagtgtagagctagagttgtcggttaggaacgagaagggcccgtcgatctggccgaagaggcccgagacagcgtgaggcggtgatcataatattctctgtagcacggtgttggagattagtgaacgataatgtgcgccagtattcacgtgccgctctggtagcggcggagtatagagctgagtccgagtatgggcggaggatagtgcccgagaatgacctagtcagtggcggaggtagcgcgtggtggcccatgtacttgtctagccgag

SEQ ID NO: 3688 - DNA, 378 bp, Rosa hybrid cultivar
gaaggttctcagggataacatccagggcatcaccaagcctgccattcgccgtttggctcgcagaggcggcgtcaagcgtatctccggtctcatctacgaagagaccagaggtgttctcaagatctttctcgagaacgtcatccgtgacgccgtcacttacactgagcacgctcggaggaagaccgtcaccgccatggatgtcgtctatgctttgaagaggcagggaaggaccctctatggatttgggggttaaatcagattagggtttgtttaggatttgggtttcagatctgggtgtgatgaaaattctgctgttaatgtaatttgcatccttataatcaagtaatacatgtttgatttcttaggaaaaaaaaaaaa

SEQ ID NO: 3689 - DNA, 434 bp, Triticum aestivum
  misc_feature (40)..(40): n is a, c, g, or t
  misc_feature (123)..(123): n is a, c, g, or t
  misc_feature (153)..(153): n is a, c, g, or t
  misc_feature (189)..(189): n is a, c, g, or t
  misc_feature (206)..(206): n is a, c, g, or t
  misc_feature (218)..(218): n is a, c, g, or t
  misc_feature (233)..(233): n is a, c, g, or t
  misc_feature (235)..(235): n is a, c, g, or t
  misc_feature (250)..(250): n is a, c, g, or t
  misc_feature (264)..(264): n is a, c, g, or t
  misc_feature (326)..(326): n is a, c, g, or t
  misc_feature (329)..(329): n is a, c, g, or t
  misc_feature (381)..(381): n is a, c, g, or t
tgtccggccgcggcaagggcgggaagggcctcggcaaggntcggcgcgaagcgtcatcggaaggtgatgagggacaacatccagggcatcaccaagccggcgatccgtcgtctggctcgccgnggcggcgtgaagcgcatctcggggctcatntacgaggagacccgaggcgtgctcaagatcttcctngagaacgtcatccgcgncgccgtcacctncaccgagcacgcccncngcaagaccgttaccnccatggacgtcgtntacgcgctcaagcgacagggacgcaccctatacggcttcggcggctgacctgcgcctgctgntgntccatcgagtcgtactctgctggatgtatgctcctgttctcgtgctacggtntcgtttactgagtgtcgtgagttggtgttctgtcggtactgtgtagtcatgtg

SEQ ID NO: 3690 - DNA, 297 bp, Sesamum indicum
aagattttcgaattgcagaaaaatgtcgggacggggcaagggcggcaagggtttgggaaagggcggagctaaccgccaccgcaaggtcctacgtgataacattcaaggaataacaaagccggccattcgccggttggctcgtcgaggcggcgttaagcgaatcagcggattaatctacgaagagacgcgtggcgttctgaagattctcctggaaaacgtcactaggtgatgctgggaactacaccgaaaacgcccgccgcaaaagtgttactgccatggatgtggtctatgcacctc

SEQ ID NO: 3691 - DNA, 1013 bp, Triticum aestivum
tcgacccacgcgtccgacgatacgtaacgtaacggcatgacagcggccgcccttttttaattttgttcatttccaagaaaggtatttgcatatcttgtgtggaaatgaaaagaaaaaaaaaaaaaaaaaatcatccccagcggccaccaccggtcctccgattccaccacatccgttcgcaggtcgagatcgtgagccatgtccgggcgcggcaagggaggcaaggggctgggcaagggcggatccaagggccaccggaaggtgctgccctacaaggtgcaggggggtggcaagccggtgatccggtggatggcgcagaatgggcggcgtgaagctcatctcggggctcatctacgaggagacccgcggggtgctcaaaatcttcctcgagaaggttatccgggatgccgatacctacactgagcacgcccgccgcaagaccgtgaccgccgtggacgtcgtctacccgctcaagggccagggttgcaccctctagggattcggaggataggtcctgccgaatgtcgtctgtttctgtcgccgcctggagatccgcaaagcttgatggaactctgactttttcagttcgctgattactcaatctgtgtagtacgaactgagtcgtggaacaaagtaatttgcatatcttgttggaaatgaaaaaaaaaaaaaaggggcggggggtctagattatccccgaaggggcccgaaattacggatacgcagcatccttgtacaagggggcccctatagtgggcggattataaactaggccttggggggcttttaaaaacgtggggcgtggaaaaaatggtacattgggttcttggaaaggcaccctaacttttgggggggggaatattgggaaaactccccaaaggaatttaaggccctaaggtagaaataaaattttaaggggtaaaggtgttgaaaaaaagggacatacctggggcgggaaaagttggggttcgggagttgaggtgaggaaaatttaatcccggggggaagggtgt

SEQ ID NO: 3692 - DNA, 378 bp, Artemisia annua
aaggttctccgtgacaacatccaaggtatcactaagcccgccatccgtcgtttggctcgtagaggtggagtgaagcgtatcagtgggcttatctacgaagagacacgtggcgtgctgaaggatctttttggagaatgtgattcgtgatgctgtgacctacactgagcatgcgaggaggaagactgttactgctatggatgttgtctatgctctcaagaggcaaggccgtaccctttacggtttcggcggttaagtttgttggatctagggtttcgaagttggggcttattgttgttatgtttagtgattaatgattaatatctgattaatcatttcagtttgtatttcgtgttctatgtttaatgaaatgaaatgaaa

SEQ ID NO: 3693 - DNA, 577 bp, Brassica rapa
aaactacaacagagaatcttctccaacactaaagttttctcaagaaaaagaaaaaacccaatttccatcggaaaaaatgtcgggtcgtggaaagggaggaaagggtttgggcaaaggaggagccaagcgtcacaggaaggttctgagagacaacatccagggaatcaccaagccggcgattcggaggctggcacgtagaggtggagtcaagcgtatcagtggtttgatctacgaggagacacgtggcgtcctcaagatctttttggagaacgttattcgtgacgctgtgacctacactgagcacgccagaaggaagactgtgactgcgatggatgtggtctacgcgttgaagaggcaagggaggacgctttacggattcggcggttaagggactttttagattcgcgttttgcgtttctgggtttctttagtcgtgttcttatggaagtttctaatcaaatcatgttttccttagcgtttgtgttttgaattccgtttgagttcggtcttttatgttgcgttagcgtttcgttatatgtaattacgcattttatctatgaagctattcgagtttatg

SEQ ID NO: 3694 - DNA, 792 bp, Gossypium hirsutum
  misc_feature (553)..(553): n is a, c, g, or t
  misc_feature (557)..(557): n is a, c, g, or t
  misc_feature (559)..(559): n is a, c, g, or t
aacagttgcgattcagtattctctattcttcttcgtcctctgaaattttctttgaaattccagcttttcactacaatgtcaggaagaggaaagggaggtaaggggctcggaaagggaggagccaagaggcataggaaggtcttaagggacaacattcagggcattaccaagcctgcgattcgccgtttggctcgtaggggaggtgtgaagagaattagcggtttgatctacgaagaaacccgaggcgtattgaagatcttcttggagaacgtgattcgtgatgcagtgacatacactgagcacgccagaaggaagactgttaccgccatggatgttgtttatgccttgaaaaggcaaggcaggactctctatggttttggaggttaagtttagtacactattgtattttaggctttgcagtattatgcttattatggtagaataatggatcttggctatagatccatggccttaatgtaattgctgcagttcgttgctggtgttactgtgattcttaatatatgaaatgctctcaaaggatttcaatcaactntgcntntgcgtgcatcccattgaattattatatggctatttaacgtagtgttttacttggaaattagtacttgtgggtgcctcttatctcaacgacgggtggctttaggtttctgttctctctgtccaaagtattggttgaatagtgacacccaagcatgacaaagacattggcacacaactttgtacagtaaggacgttattctatatgaagatgtaattgtatcggacacattggtt

SEQ ID NO: 3695 - DNA, 593 bp, Festuca arundinacea
ggcacgaggccgccaccagcaccacctctcctcgagttcaatccgctcgcagcagcagctccagtcgaggtcagccatgtcgggccgcggcaagggaggcaaggggctcggcaagggcggcgccaagcgccacaggaaggtgctccgcgacaacatccagggcatcaccaagccggccatccgccgcctggcccgccgtggcggcgtgaagcgcatctccgggctcatctacgaggagacccgcggcgtgctcaagatcttcctcgagaacgtcatccgcgacgccgtcacctacaccgagcacgcccgccgcaagaccgtcacagccatggacgtcgtctacgcgctcaagcgccagggccgcaccctctacggcttcggcggctagaagcctcttcgtccgcgccgaacccgtcgcctcctcgccgtcaacagcctgttgtcttcctcagtgtgttctgttccgttcagtagctgtagctggaaccatgttactactagttcttcacttgtccatcgcaagatctatctagctagcctgtaatagctctgtacgagcctagatctgaaatcgaatatattatctccccccc

SEQ ID NO: 3696 - DNA, 564 bp, Festuca arundinacea
  misc_feature (355)..(355): n is a, c, g, or t
ggcacgaggcatcctaccagcaacgcccacacacgagtcaaactcatcgccgcagaaaagggaaaactcaccggagatgtcgggccgcggcaaggggggcaaggggctgggcaagggcggcgccaagcgccaccggaaggtgctgcgggacaacatccagggcatcaccaagccggccatccgccgcctggcgcgtcgcggcggcgtcaagcgcatctcggggctcatctacgaggagacccgcggcgtgctcaagatcttcctcgagaacgtcatccgcgacgccgtcacctacacggagcacgccaggcgcaagaccgtcaccgccatggacgtcgtctacgcgctcaagcgncagggacgcacgctctacggattcggcggttaggaagggcagggtccgttgcttgcgcctcgcggagtcagatttaggaagctagcctctgtttacggttccattgtctgttgtggagtagtagttgcagcgtctcgctgttgttcgctctggggtgactccgtgactgtaaggctgttggtttggtagaatggaattgaaatttacct

SEQ ID NO: 3697 - DNA, 614 bp, Festuca arundinacea
ggcacgaggctcatcctaccagcaacacccacccacgagtcaaactcaccggaggagaaggaaaatccgccggagatgtcgggccgcggcaagggaggcaaggggctgggcaagggcggcgccaagcgccaccggaaggtgctccgggacaacatccagggcatcaccaagccggccatccgccgcctggcgcgccgcggcggcgtcaagcgcatctcggggctcatctacgaggagacccgcggcgtgctcaagatcttcctcgagaacgtcatccgcgacgccgtcacctacaccgagcacgcaagacgcaagaccgtcaccgccatggacgtcgtctacgcgctcaagcgacaggggcgcaccctctacggattcggcggataggaaggccagatttagaaagctagctagcctctgtttagggttcatggtctggtgtcgagtagtagtcgcagtatctcgctgtcgtgtgctctggtcttgttaggacgaagtggtgactgtaagaatgttgatttggtaggttggaatgaaaatttcactagttcaccctttaaattcttctgcaatcccttagatctgtccatatgagttttgcaaggttctaaatc

SEQ ID NO: 3698 - DNA, 569 bp, Mesembryanthemum crystallinum
cggccgcgtcgacacacaatcagttccagtagtaaatcaaaacaagagagagagagagagagagaaagagagaaaaatgtcgggaagaggaaagggaggtaagggattgggaaagggaggagcaaagaggcacaggaaggtgttgagggacaacatccagggcatcaccaagcccgccattcgccgtctcgctcgtcgtggcggtgtcaagaggatcagcggcctaatctatgaagagactcgcggtgttctcaagatctttttggagaatgtcatccgtgatgctgtcacctacactgagcacgctcgtcgcaagacggttactgctatggatgttgtctatgctctcaagcgccaaggccgtactctttatggttttggtggttagattgttttccagtttgatacgtaatatgttgtttatggcgttatatatcaatggttagggtttgtgtttagttaattgaagatattcagatctcgatctgcttcatgtaattgcaaatttacaaggaatatacgagttctgaattgttacaatcccatcatacttccccttcttatccttt

SEQ ID NO: 3699 - DNA, 544 bp, Triticum aestivum
accacaccgccgcaacaagcaccaccagcaagccacacagagcagccaagcgaagctcgccggagagagaagcgaagatgtcgggccgcggcaagggagggaaggggctgggcaagggcggagccaagcgccaccggaaggtgctccgggacaacatccagggcatcaccaagccggccatccgtcgtctggctcgcaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggccgcaccctctacggcttcggcggctaggccgcgcccgtccggtcgaatccgcctcgcgccgccagattcgtagctagccatcggttgttcagtgttcattgtcttcgctgtaatggaatggccgcatctcgctgctgtctgttgtttcgatggaatggaaatctcagcattttatccctgaa

SEQ ID NO: 3700 - DNA, 495 bp, Triticum aestivum
ggctcccccgcacaccagaaaaaaaaattccccaattgtttgtctctgtcagtgaagaggtcgcggcggcggcggcgatgtcggggcgcggcaagggcggcaaggggctgggcaagggcggcgcgaagcgccaccggaaggtgctccgcgacaacatccagggcatcaccaagccggcgatccggaggctggcgcggaggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggcttcgggggctaggatgggctgggcgccctctcctcctttgagtctgtttaccggtccgaaacgactgaaatgttagctgatttatcgcgagagaaaatactattggttgacataaaaa

SEQ ID NO: 3701 - DNA, 590 bp, Beta vulgaris
  misc_feature (213)..(213): n is a, c, g, or t
  misc_feature (220)..(221): n is a, c, g, or t
  misc_feature (223)..(224): n is a, c, g, or t
  misc_feature (262)..(262): n is a, c, g, or t
  misc_feature (264)..(264): n is a, c, g, or t
ctctctcctaaaaaaatcctcttaactttctttctctctctaaaaatctctgaaaaaaaccaaaaaatgtctgggcgtggtaagggaggtaagggtttgggaaagggaggagcaaagcgtcacaggaaagttttaagagataacattcaaggtattacaaaacctgcaattcgtcgtcttgcaagaagaggtggtgtgaagcgtataagtggnttgatcnntnnagagacacgtggcgtgcttaagatcttcttggagaatntnattcgtgatgctgttacatacactgagcatgcgaggaggaagacggttaccgccatggatgttgtttatgctcttaaaaggcaaggaagaactttgtatggttttggaggttaaatttgaatgattttggtgttttctagggttttttatgaacaaatttggggatatttggtggtagtttgtgttttattgcgaaattagggtttagatggtgtagatctttgtcggggattagtgttttggattttatggtttggtactttttgtaattgaatcttatgatttcatgaaatgaatatcttgttcactctaattttcgttctttt

SEQ ID NO: 3702 - DNA, 737 bp, Saccharum officinarum
ggctcgtatccacggcatctcgaagcgcagcagtagcagcagcagcagccatggacgtgagcggagcgggagccggcgggaaggcgaagaagggcgcgggcgggcggaaggccggcggcgggccgaggaagaagtcggtgacgcggtccgtcaaggccgggctgcagttccccgtcggccgcatcgggcggtacctgaagaaggggcggtacgcgcagcgcgtgggcacgggcgcccccgtgtacctcgccgccgtcctcgagtacctggccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggtggcgtcctccccaacatcaaccccgtgctcctgcccaagaaggtcgccgagaaggccgcggccaaggagcccaagtcgcccaagaaggccgccaagtcccccaagaaggcatagggaggccgccattagcgctgtcatgttgaatgctcatgttcagtagatctgtaggtccgtagatggcacggtctctgcgctctagtgtcgtcgtcgttgttggaactgtttagtagatctgtgcattttggttggaaggagatttcagagatcagaattttgtacttgcaaaatgttctttgatttcagaaatcagatttacaatctgggtgc

SEQ ID NO: 3703 - DNA, 865 bp, Saccharum officinarum
  misc_feature (720)..(720): n is a, c, g, or t
atccacggcatctcgaagcgcagcagtagcagcagcagcagccatggacgtgagcggagcgggagccggcgggaaggcgaagaagggcgcgggcgggcggaaggccggcggcgggccgaggaagaagtcggtgacgcggtccgtcaaggccgggctgcagttccccgtcggccgcatcgggcggtacctgaagaaggggcggtacgcgcagcgcgtgggcacgggcgcccccgtgtacctcgccgccgtcctcgagtacctggccgccgaggtgctggagctggccgggaacgcggccagggacaacaagaagacccgcatcatcccgcgccacgtgctcctggccatccgcaacgacgaggagctcggcaagctgctggccggcgtcaccatcgctcacggtggcgtcctccccaacatcaaccccgtgctcctgcccaagaaggtcgccgagaaggcgtcggcggccaaggagcccaagtcgcccaagaaggccgccaagtcccccaagaaggcctagaggggtctccattgccgctgtgatgttgaatgctcatgttcagtagatctgtagtaggtttgtagatggcacggtctctgcgttgtactgtttagtagatctgtctgcattttggttggaaggagatttcagggatcagagttttacttgcaaaatgttctttgatttcagaaatcagattggcaatttgggcacgtttnatagaagaacaaattaaataataaaagggcggccgctctaaagaacaagctactacgcatgctgcaactcatagttttaataggaactaattaattattggcgtgttaacacgaatatcggaaacctgacgtaccaataaatgct

SEQ ID NO: 3704 - DNA, 677 bp, Saccharum officinarum
  misc_feature (81)..(81): n is a, c, g, or t
  misc_feature (372)..(372): n is a, c, g, or t
  misc_feature (618)..(618): n is a, c, g, or t
  misc_feature (640)..(640): n is a, c, g, or t
  misc_feature (642)..(643): n is a, c, g, or t
  misc_feature (651)..(651): n is a, c, g, or t
gcagcagcagccatggacgtgagcggagcgggagccggcgggaaggcgaagaagggcgcgggcgggcggaaggccggcggngggccgaggaagaagtcggtgacgcggtccgtcaaggccgggctgcagttccccgtcggccgcatcgggcggtacctgaagaagggccggtacgcgcagcgcgtgggcacgggcgcccccgtgtacctcgccgccgtcctcgagtacctggccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggnggcgtcctccccaacatcaaccccgtgctcctgcccaagaaggtcgccgagaaggccgcggccaaggagcccaagtcgcccaagaaggccgccaagtctcccaagaaggcatagggaggccgccattagcgctgtcatgttgaatgctcgtgttcagtagatctgtaggtctgtagatggcacggtctctgcgctctagtgtcgtcgtcgttgttggaactgtttagtagatctgtgcattttggnttggaaggagatttcagagatnannaatttgtncttgcaaaatgttctttgatttaaga

SEQ ID NO: 3705 - DNA, 847 bp, Sorghum bicolor
catccacacccacatcgcctctcaactcccacgctttctctcgatctcgaagcgcagcagcggcaaccggcggccatggacgtgagcggtgccggagcgggcgggaaggcgaagaagggcgcggcggggcgcaaggctggcgggccgaggaagaagtcggtgtcgcgttccgtcaaggccgggctgcagttccccgtcggccgtatcgggcggtacctcaagaagggccggtacgcgcagcgcgtcggcacgggcgcccccgtctacctcgccgccgtcctcgagtacctcgccgccgaggtgctggagctcgccggcaacgcggccagggacaacaagaagacgcgcatcatcccgcgccacgtgctcctggccatccgcaacgacgaggagctcggcaagttgctggccggcgtcaccatcgcccacggcggcgtcctccccaacattcacagcgtgcttctccccaagaaggtggccgagaaggcggccaaggagcccaagtcgcccaagaaggccgccaagtcccccaagaaggcatagagtgctctccagtctcctctcttaagagggaggtccctacattaccattagcgccgtgctggtagattagatcatgtttagtgttactacctctgtaacgttcttgttcttgctgctaattggaatggtttatctagtactagtacatctgtgcattttcgttggttggaactagatttcaaaaacaaaagtttgcgacgggaatcttgttttacagaggtagagattgtcaatacagtttggattactgttgaaccactttaactttaaacaacatgagcagagacaatatcttccattcatg

SEQ ID NO: 3706 - DNA, 737 bp, Sorghum bicolor
ctcaactcccacgctttctctcgatctcgaagcgcagcagcggcaaccggcggccatggacgtgagcggtgccggagcgggcgggaaggcgaagaagggcgcggcggggcgcaaggctggcgggccgaggaagaagtcggtgtcgcgttccgtcaaggccgggctgcagttccccgtcggccgtatcgggcggtacctcaagaagggccggtacgcgcagcgcgtcggcacgggcgcccccgtctacctcgccgccgtcctcgagtacctcgccgccgaggtgctggagctcgccggcaacgcggccagggacaacaagaagacgcgcatcatcccgcgccacgtgctcctggccatccgcaacgacgaggagctcggcaagttgctggccggcgtcaccatcgcccacggcggcgtcctccccaacattcacagcgtgcttctccccaagaaggtggccgagaaggcggccaaggagcccaagtcgcccaagaaggccgccaagtcccccaagaaggcatagagtgctctccagtctcctctcttaagagggaggtccctacattaccattagcgccgtgctggtagattagatcatgtttagtgttactacctctgtaacgttcttgttcttgctgctaattggaatggtttatctagtactagtacatctgtgcattttcgttggttggaactagatttcaaaaacaaaagtttgcgacgggaatcttgtttta

SEQ ID NO: 3707 - DNA, 701 bp, Saccharum officinarum
  misc_feature (9)..(9): n is a, c, g, or t
ataccccgncgaccttgcgtccggacacagattgcctctcaactctcgatctctctctcgatctcgaagcgcagcagcagcagcagcaaccgccggcggccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccccaacatccactctgtgctcctccccaagaaggtggccgagaaggcggccaaggagcccaagtcgcccaagaaggccgccaagtcccccaagaaggcctagagtgctctcgtctcttagaggacaagggaggctcctccattagtgctgtcctgttagattagatcatgtttagtgtacctctgtaacgttcttgttcttgctgctaattggaatggtttatctagtactagt

SEQ ID NO: 3708 - DNA, 911 bp, Saccharum officinarum
gacacagattgccactcaactctcaatctctctcccgatctcgaagccgcagcagcatccaggcagccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccccaacatccactctgtgctcctccccaagaaggtggccgagaaggcggccaaggagcccaagtcgcccaagaaggccgccaagtcccccaagaaggcgtagagtgctctcgtctcttgaggagaagggaggctcctccattagaccattaccattagtgctgtcctgttagattagatcatgtttagtgtacctctgtaacgttcttgttcttgctgctaattggaatggtttatctagtactagtacatctgtgcattttcgttggttgcaacaagatttcagaaaccagagtttgctacttgcaaaaagtgtgctcaacttctcatagaacctggatttggtaagtgggtcatatagtcataactgaaccgatagaagaaactagatacagtggtatgccagagaccagttgctcctaatggattgtatctctatggaaaaaaaatgtacatgcagcatgcacaaaagaagcag

SEQ ID NO: 3709 - DNA, 988 bp, Saccharum officinarum
tggaattttgggagaactggggaactaaacaagggcccacatacagacacagattgcctctcaactctcaatctctctctcgatctcgaagcagcagccagcagccatggacgtgagcggagcaggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctggagctcgccggcaacgcggccagggacaacaagaagacccgcatcatcccgcgccacgtcctcctggccatccgcaacgacgaggagctcggcaagctgctggccggcgtcaccatcgcccacggcggcgtcctccccaacatccactctgtgctcctccccaagaaggtggccgagaaggcggccaaggagcccaagtcgcccaagaaggccgccaagtcccccaagaaggcctagagtgctctcgtctcttaggggagaagggatgctcctccattagaccattaccattagtgttgtcctgttagattagatcatgtttagtgtacctctgtaacgttcttgttcttgctgctaattggaatggtttatctagtactagtacatctgtgcattttcgttggttgcaacaagatttcagaaaccagagttgctaaaaaaaaaaaaaaaaaaaaaaaaaaaaaggcggcgtctagagatcaagctagtacgctgctgaactattactttttatgtgtactaaatcattactgccgcgtttacacgtgggatggaaacctgcgttccaactatgcttgagacatccctttgcactgggtatacgaaggcccccgttcgcttcacaatgtccctgatggaatggaccccctt

SEQ ID NO: 3710 - DNA, 575 bp, Saccharum officinarum
gcagcagcagccatggacgtgagcggagcgggagccggcgggaaggcgaagaagggcgcgggcggtcggaaggccggcggtgggccgaggaagaagtcggtgacgcggtccgtcatggccgggctgcagttcctcgtcggccgcatcgggcggtacctgaagaagggccggtacgctcagcgcgtgggcacgggtgcccccgtgtacctcgccgccgtcctcgagtacctggccggcgaggtgctggagctggccgggaacgcggccagggacaacaagaagacccgtatcatcccgcgccacgtgctcctggccattcgcaacgacgaggagctcggcaagctgctggccggcgtcaccatcgctcacggcggcgtgctccccaacatcaaccccgtgctcctgcccaagaaggtcgccgagaaggcgtcggcggccaatgagcccaagtcgcccaagaaggccgtcaagtcccccaagaaggcctagaggggtctccattgccgctgtgatgttgaatgctcaggtttcatagatctggagtacgttttgtaaattggcacggtctttgcgtt

SEQ ID NO: 3711 - DNA, 671 bp, Cenchrus ciliaris
gcctctctcacccgcaggcctcctctcttcgatttccacagcgcagcagcagccagccagccggccatggacgttagcggagctggagccaccggcaaggtgaagaagggagcggccggtcgcaaggccggcggacccaggaagaagtctgtgtcgcggtccgtgaaggccgggctccagttccccgtcggccgcatcgggcgctacctcaagaagggccggtacgcgcagcgcgtcggcaccggcgcccccgtctacctcgccgccgtcctcgagtacctcgccgccgaggtgctggagctcgccggcaacgcggcgagggacaacaagaagacgcgcatcatcccgcgccacgtgctcctggcgatccgcaacgacgaggagctcggcaagctgctggctggcgtcaccatcgcccacggcggcgtcctccccaacatcaacccggtgctcctgcccaagaaggtggcggagaaggcggccgccaaggaggccaagtcgcccaagaaggccgccaagtctcccaagaaggcttagagaggcgcgccattagtgttgttcgatattcctgtctggtagatctgtagatgggatgacttctgaagtagggtacttactgtggctttgtgatatgtgcattgtcctggatgaattcagaaatcagagtttgt

SEQ ID NO: 3712 - DNA, 678 bp, Saccharum officinarum
ctcgcattcctccaatctccagagccctttctcctcgagaagccactcgaagcgcagctgcggccatggactccaccggcgccggagcgggagggaaggtgaagaagggagcgggcgggcgcaaggccggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgccgctgaggttctggagctcgccgggaacgcagccagggacaacaagaagacccgcatcatcccccgccacgtgctgcttgcgatccgcaacgacgaggagcttgggaagctgctggccggcgtgaccatcgcccacggtggcgtgctgcccaacatccactcagttctgctgcccaagaagacggcagagaaggcgtccagcaaggagcccaagtcgcccaagaaggctgccaagtcccccaagaaggcatagagtgtcgaggatgatttgatgttaagcgtcgtattacctgtgatgtgtaggttgtagatcgaatggatgtgcttggagattaaccggtcttgtagcaagttatctttgatttgcagtacaagaaatgcctagtttcttgaaa

SEQ ID NO: 3713 - DNA, 686 bp, Saccharum officinarum
cccacgcgtccgcgcattcctccaatctccagagcccattctcctccaagaagccactcgaagcgcagctgcgaccatggactccaccggcgccggagcgggagggaaggtgaagaagggagcgggcgggcgcaaagccggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgctgctgaggttctggagctcgccgggaacgcagccagggacaacaagaagacgcgcatcatcccccgccacgtgctgcttgcgatccgcaacgacgaggagcttgggaagctgctggccggcgtgaccatcgcccacggtggcgtgctgcccaacatccactcagttctgctgcccaagaagacggcagagaaggcgtccagcaaggagcccaagtcgcccaagaaggctgccaagtcccccaagaaggcatagagtgtcgaggatgatttgatgttaagcgtcgtactacctgtgatgtgtaggttgtagttcgaatggatgtgcttggagattaaccggtcttgtagcaagttatgtttgatttgcagtacaagaaatgcctagtttcttg

SEQ ID NO: 3714 - DNA, 710 bp, Saccharum officinarum
gcattcctccaatctccagagcccttctcctcgaagaagccactcgaagcgcagctgcggccatggactccaccggcgccggagcgggagggaaggtgaagaagggagcgggcgggcgcaaggcaggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgccgctgaggttctggagctcgccgggaacgcagccagggacaacaagaagacgcgcatcatcccccgccacgtgctgcttgcgatccgcaacgacgaggagcttgggaagctgctggccggcgtgaccatcgcccacggtggcgtgctgcccaacatccactcagttctgctgcccaagaagacggcagagaaggcgtccagcaaggagcccaagtcgcccaagaaggctgccaagtcccccaagaaggcatagagtgtcgaggatgatttgatgttaagcgtcgtactacctgtgatgtgtaggttgtagatcgattggatgtgcttggagattaaccggtcttgtagaaagttatgtttgatttgcagtacaagaaatgcctagtttcttgaaagttgaaacgtgtagttattttcatacctgtattcc

SEQ ID NO: 3715 - DNA, 828 bp, Saccharum officinarum
cacgctttcctccctcgtatccacggcatctcgccatggacgtgagcggagcgggagccggcgggaaggcgaagaagggcgcgggcgggcggaaggccggcggcgggccgaggaagaagtcggtgacgcggtccgtcaaggccgggctgcagttccccgtcggccgcatcgggcggtacctgaagaaggggcggtacgcgcagcgcgtgggcacgggcgcccccgtgtacctcgccgccgtcctcgagtacctggccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggtggcgtcctccctcaaccccgtgctcctgcccaagaaggtcgccgagaaggccgcggaagtcgcccaagaaggccgccaagtcccccaagaaggcatagggaggccgccattagcgctgtcatgttgaatgctcatgttcagtagatccgtagatggcacggtctctgcgttgtactgtttagtagatctgtctgcattttggttggaaggagatttcagggatcagagttttacttgcaaaatgttctttgatttcagaaatcagattggcaatttgggcacgtttaatagaagaacataattaaataataaaagggcggccgctctaaagaacaagctactacgcatgctgcaactcatagttttaataggaactaattaattattggcgtgttaacacgaatatcggaaacctgacgtaccaataaatgct

SEQ ID NO: 3716 - DNA, 734 bp, Saccharum officinarum
tgtcgtcgcctgcggtaccggtcccggatttccgggttggacccaggcttccgtgcattcctccaatctccagagcccttctcctcgaagaagccactcgaagcgcagctgcggccatggactccaccggcgccggagcgggagggaaggtgaagaagggagcgggcgggcgcaaggcaggcgggccgaggaagaagtcggtgtcgaggtccgtgaaggccgggctccagttccccgtcggccgcatcgggcgctacctgaagaagggccgctacgcgcagcgcgtcggcaccggggcccccgtctacctcgccgccgtcctcgagtacctcgccgctgaggttctggagctcgccgggaacgctgccagggacaacaagaagacgcgcatcatcccccgccacgtgctgcttgcgatccgcaacgacgaggagctcgggaagcttctggccggcgtgaccatcgcccacggcggcgtgctgcccaacatccactcggttctgctgcccaagaagacggcggagaaggcgtccagcggcgggagcaaggagcccaagtcgcccaagaaagccgccaagtcccccaagaaggcatagagtgtcgaggcagatctgatgtttagcgtcgtattacctgtgatgtgtaggctgtagatggaatggatgtgcttgagattaaccggtcctgtagcaagttatcttcgattcccagtacaagaaatgcctagtttcttg

SEQ ID NO: 3717 - DNA, 676 bp, Saccharum officinarum
ataccccgccgaccttgcgtccggacacagattgcctctcaactctcgatctctctctcgatttcgaagcgcagcagcagcagcagcaaccgccggccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccctccactctgtgctcctccccaagaaggtggccgagaaggcggccaaagtcgcccaagaaggccgccaagtcccccaagaaggcctagagtgctctcgtctcttagaggacaagggaggctcctctgctgtcctgttagattagatcatgtttagtgtacctctgtaacgttcttgttcttgctgctaattggaatggtttatctagtact

SEQ ID NO: 3718 - DNA, 1641 bp, Saccharum officinarum
gggttcagttctatatccatggggagtacaccaagtctcacagaggctacacgccagaccttgtggtttcgcacccgggggaactctcctgcagaggaagcctgtgtcaagaaatcagaatttgtttgacgacagctccctcatcctcattgtctacagcatagagaatcaagacaaggcaaaaccaagatcaagggatggcatcagtactggtcgtagccaagctgatgctcaggctctggcctgtgcctctggtggcaaagttgtgagcagcgcatggatcattgactccatagcagcttgcaaccttcaacctctttaaagttaagggagccttccatgctgccctaaatgtgtgcttgcatgcacagtagattgagtaacagacggacagaaaatagtgtaagtatcagtacactaggacagtaaggcctaggccttaggctgctccttcagtccttctagacctcctaggatgctcgcttcaagcggacatttgtatgtttaggcctcgtttagttcagagaattggtgagaaaaatactgtatcagaattcctgtagcatttcgtttgtatttggtaaaaattatctaaattttaactaactaggcttaaaatgttcgttttgcaaagtacaacaaaactgtacaattagtttttgatttcatcaacatttagtactccatgcatttgacgacattttgatgtgacgggaaattttcttttttatagtggaattttgggagaactggggaactaaacaagggcccacatacagacacagattgccactcaactctcaatctctctcccgatctcgagccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccctccactctgtgctcctccccaagaaggtggccgagaaggcggccaaagtcgcccaagaaggccgccaagtcccccaagaaggcgtagagtgctctcgtctcttgaggagaagggaggctcctccattagtgctgtcctgttagattagatcatgtttagtgtacctctgtaacgttcttgttcttgctgctaattggaatggtttatctagtactagtacatctgtgcattttcgttggttgcaacaagatttcagaaaccagagtttgctacttgcaaaaagtgtgctcaacttctcatagaacctggatttggtaagtgggtcatatagtcataactgaaccgatagaagaaactagatacagtggtatgccagagaccagttgctcctaatggattgtatctctatggaaaaaaaatgtacatgcagcatgcacaaaagaagcag

SEQ ID NO: 3719 - DNA, 679 bp, Gossypium hirsutum
gtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgt

SEQ ID NO: 3720 - DNA, 758 bp, Zea mays
ggcatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgccaagtcccccaagaaggcatagaggggcgggcgcctttaccgctgtgatgttgaatgctcgtgttcagtagatctttacgtctgtagtgtcgtcgttgttattggaactggttagtagatctgtgcattgtggttgaaacgtgattccctgatttcagaaatctaatttgcaatttgggtgcacaaatatactcgcaatggtttatatagt

SEQ ID NO: 3721 - DNA, 868 bp, Zea mays
ggcatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaatttaatggttatgtggaatcgctaaaaagacatggtcatccgtatctgcattgaagcataataacgaaactaattgccaagtgtcaataaaaataca

SEQ ID NO: 3722 - DNA, 804 bp, Sorghum bicolor
ggcatcaccagtcaccaccattcccaccactcaacttctcgcgcccagagcccccaaatttttctccactcgaccgcagcagcagcaagcagccatggacgccagcggagccggtggcaaggcgaagaagggggcggccgggcgcaaggctggcggccccaggaagaagtcggtgtcgcggtccgtcaaggccgggctgcagttccccgtcggccgcatcggtcggtacctcaagaagggccggtacgcgcagcgcgtgggcaccggcgcccccgtctacctcgcagccgtcctggagtacctcgccgccgaggtgctggagctggccgggaacgcggcgagggacaacaagaagacgcgcatcatcccgcgccacgtgctcctggccatccgcaacgacgaggagctcgggaagctgctggccggcgtcaccatcgcgcacggcggcgtcctccccaacatcaacccggtgctcctgcccaagaaggtggccgagaaggcggccagcggcggcagcaaggaggccaagtccccaaagaaggccgccaagtcccccaagaaggcttagaaagtagggagttcattagcgctgtgtaacatgttcgtgtttagatctgtggatgggatgtgttgtggtctagtttcctccctgtggcttatggtatgttcattttcattgagaagatcttcagaaatcagagctcgttgcatagtaatgttcacccacgaagttctgtttcctgctctgattttgcaattcgtcagtttgttgaatcagtaaatagatacgggaagtcatatctg

SEQ ID NO: 3723 - DNA, 711 bp, Sorghum bicolor
ggcatcaccagtcaccaccattcccaccactcaacttctcgcgcccagagcccccaaatttttctccactcgaccgcagcagcagcaagcagccatggacgccagcggagccggtggcaaggcgaagaagggggcggccgggcgcaaggctggcggccccaggaagaagtcggtgtcgcggtccgtcaaggccgggctgcagttccccgtcggccgcatcggtcggtacctcaagaagggccggtacgcgcagcgcgtgggcaccggcgcccccgtctacctcgcagccgtcctggagtacctcgccgccgaggtgctggagctggccgggaacgcggcgagggacaacaagaagacgcgcatcatcccgcgccacgtgctcctggccatccgcaacgacgaggagctcgggaagctgctggccggcgtcaccatcgcgcacggcggcgtcctccccaacatcaacccggtgctcctgcccaagaaggtggccgagaaggcggccagcggcggcagcaaggaggccaagtccccaaagaaggccgccaagtcccccaagaaggcttagaaagtagggagttcattagcgctgtgtaacatgttcgtgtttagatctgtggatgggatgtgttgtggtctagtttcctccctgtggcttatggtatgttcattttcattgagaagatcttcagaaatcagagctcgttgcat

SEQ ID NO: 3724 - DNA, 611 bp, Saccharum officinarum
  misc_feature (437)..(437): n is a, c, g, or t
  misc_feature (504)..(504): n is a, c, g, or t
  misc_feature (561)..(561): n is a, c, g, or t
cgaagcgcagcagtagcagcagcagcagccatggacgtgagcggagcgggagccggcgggaaggcgaataatggcgcgggcgggcggaaggccggcggcgggccgaggaagaagtcggtgacgcggtccgtcaaggccgggctgcagttccccgtcggccgcatctggcggtacctgaagaaggggcggtacgcgcagcgcgtgggcacgggcgcccccgtgtacctcgccgccgtcctctagtacctggccgccgaggtgctggagctggccgggaacgcggccagggacaacaagaagacccgcatcattccgcgccacgtgctcctggccatccgcaacgacgaggagctcggcaagctgctggccggcgtcaccatcgtccacggtggcgtcctccccaacatcaaccccgtgctcctacccaagaaggtcgncgagaaggccgcggccaaggagcccaagtcgtccaagaaggccgtcaagtcccccaagaaggcatanggaggccgccattagcgctgtcatgtttgatgctcatgttcagtagatctgtaggtncgtagattgcacggtctctgcgctctagtgttggtcgtcgtggtggaact

SEQ ID NO: 3725 - DNA, 706 bp, Sorghum bicolor
atctcgcactctcacattcctccgatctcccaagacctcctctgacccgagaagctactcgtagcgcagccgtggccatggactccacaggcgccggagcgggagggaaggtgaagaagggagcgggcgggcgcaaggccggcggcgggccgaggaagaagtcggtgtcgaggtccgttaaggccgggctccagttccccgtcggccgcatcgggcgctaccttaagaagggccggtacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccatcgcccacggcggtgtgttgcccaacatcaacccggttctgctgcccaagaagacggcggagaaggcgtccagcggcgggagcaaggagcccaagtcgcccaagaaggccgccaagtcccccaagaaggcatagattgtccagacagcttagcactaccttgttaccagtgatgcgttaagttgtagatgggatgaatgtggttggatgtgtacctgtgtttgcaagttctgatttataatggaaagaaatgccgtgtttcttaagtcgcaatgtctaat

SEQ ID NO: 3726 - DNA, 613 bp, Sorghum bicolor
tcgcactctcacattcctccgatctcccaagacctcctctgacccgagaagctactcgtagcgcagccgtggccatggactccacaggcgccggagcgggagggaaggtgaagaagggagcgggcgggcgcaaggccggcggcgggccgaggaagaagtcggtgtcgaggtccgttaaggccgggctccagttccccgtcggccgcatcgggcgctaccttaagaagggccggtacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccatcgcccacggcggtgtgttgcccaacatcaacccggttctgctgcccaagaagacggcggagaaggcgtccagcggcgggagcaaggagcccaagtcgcccaagaaggccgccaagtcccccaagaaggcatagattgtccagacagcttagcactaccttgttaccagtgatgcgttaagttgtagatg

SEQ ID NO: 3727 - DNA, 699 bp, Saccharum officinarum
cccacgcgtccgcgcattcctccgatctcccaagacctactctgacccgagaagctactcgtagcgcagccgcggccatggattccaccggcgctggagcgggagggaaggtgaagaagggagcgggcgggcgcaaggccggcgggccgaggaagaagtcggtgtcgaggtccgtgaaggccgggctccagttccccgtcggccgcatcggtcgctacctcaagaagggccgctacgcccagcgcgtcggcaccggcgcccccgtctacctcgccgccgtcctcgagtacctcgccgctgaggttctagagctcgccgggaacgctgccagggacaacaagaagacgcgcatcatcccacgccacgtgctgctcgcgatccgcaacgacgaggagctcggtaagctgctggccggcgtgaccatcgcccacggcggtgtgctgcccaacatcaacccggttctgctgcccaagaagacggcggagaaggcgtccagcggcgggagcaaggagcccaagtcgcccaagaaggccgccaagtcccccaagaaagcatagactgtccagcctgatccaatgtttagcactaccttgttaccagtgatgcgtagggtgtagatgggatgaatgtgcttggatgtgtacctgtctgctgcaagttgttctctgtgatttataatggaagaagaaatgccttgtt

SEQ ID NO: 3728 - DNA, 1205 bp, Saccharum officinarum
  misc_feature (3)..(6): n is a, c, g, or t
  misc_feature (746)..(746): n is a, c, g, or t
ttnnnnataaagtgtcgccgcggtaccgccgggacgtgaattggtgcggacgacccacgcgtgcgcgcgcccagagcccccaaaattttctcctctcaatcgcagcaggagcagcgagcagccatggacgccagcggagccggtggcaaggcgaagaagggtgcggccgggcgcaaggctggcggcccccggaagaagtcggtgtcgcggtccgtcaaggccgggctgcagttccccgtcggccgtatcgggcgctacctcaagaagggccggtacgcgcagcgcgtgggcacgggcgcccccgtctacctcgccgccgtcctggagtacctcgccgccgaggtgctggagctggccgggaacgcggcgagggacaacaagaagacgcgcatcatcccccgccacgtgctcctggccatccgcaacgacgaggagctcgggaagctgctggccggcgtcaccatcgcgcacggtggcgtcctccccaacatcaacccggtgctcctgcccaagaaggtggccgagaaggcggccagcggcggcagcaagcaggccaagtccccaaagaaggccgccaagtcccccaagaaggcttagaaagtaggggctccattagcactgtgttgtaacttgttcgtgtttagatctgtggatgggatgtgttctggtctactttcgtccttgtggcttatggtatgttcattttcatagagatcttcacacatcagacctcgttgcctgctacnaaaaaaccaagacacccgcatagatcatcatggctccagttagacccggtcgccggaccacccgcccaatcgtcgcgccacatgaccgcgtcaatccccacccaaagaggggcgccggttcaagagacccaattttatttcaggttgtttgcaacgataaactctatatgtgggcccaaattaaaataccggcgccgcctttaacagccgcgacggggaacacccggggttcccattttatggcttgagacatccccctctccccaggtggataaaacaaaaggcccccacatcccctccccaattgccccccatatgggaatgcaacccctcgagcgcataacccggtggttggtttacacagttcactacttccaccccaccgccctatgttttccttctttcccacgggggttcccaaactatgggccccagggtacttatttgaggccccccaaa

SEQ ID NO: 3729 - DNA, 559 bp, Zea mays
  misc_feature (99)..(99): n is a, c, g, or t
atcacaattcactccactcatcttttcgcgtttagaacctctaaaatttcccccactcgccagtcgcagcagcacctgtagccatggacgccagcggancggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgttcctccccaacatccactccgtgctcctgcccaagaaggcggcggaaaaagcggccagcgcccgcaacaaggaacccaagttccccaagaagggcgccaagtcccccaaaaaggcttagaaaa

SEQ ID NO: 3730 - DNA, 957 bp, Saccharum officinarum
cgcattcctccgatctcccaagacctcctctgacccgagaacctactcgtagcgcagccgcggccatggattccaccggcgccggagcgggagggaaggtgaagaaaggagcgggcgggcgcaaggccggcgggccgaggaagaagtcggtgtcgaggtctgtgaaggccggcctccagttccccgtcggccgcatcgggcgctacctgaagaagggccgctacgcgcagcgcgtcggcaccggcgcccccgtctacctcgccgccgtcctcgagtacctcgccgctgaggttctggagctcgccgggaacgctgccagggacaacaagaagacgcgcatcatcccgcgccacgtgctgctcgcgatccgcaacgacgaggagctcgggaagctgctggccggcgtgaccatcgcccacggcggcgtgctgcccaacatcaacccggttctgctgcccaagaagacggcggagaaggcgtccagcggcgggagcaaggagcccaagtcgcccaagaagggcgccaagtcccccaagaaggcatagactgtccagccagatccaatgtttagcactaccttgttaccagtgatgcgtaggttgtagatgggatgaatgtgcttggatgtgtacctgtctgctgcaagttgttctctgtgattaatggaagaagaaatgccttgttactagaaaaaaaaaaaaaagggcggccgtctaaggatcaagttactacgcggctgcgagtatagtctttatgtgcactaaatcattactgccgtgtttacacgcggatggaaacctgcgtaccattattgctgaaaaatcctttccattgcgatacgaaggccacggtgcctacacatgccactgaggaatggaccccctgacggcataaccgggggtgtgttcccaaggacttaatgcaagctaaccctcttttttttcttttttgccgtgc

SEQ ID NO: 3731 - DNA, 623 bp, Saccharum officinarum
ttccccataaagtgtcgccgcggtaccgccgggacgtgaattggtgcggacgacccacgcgtgcgcgcgcccagagcccccaaaattttctcctctagcagccatggacgccagcggagccggtggcaaggcgaagaagggtgcggccgggcgcaaggctggcggcccccggaagaagtcggtgtcgcggtccgtcaaggccgggctgcagttccccgtcggccgtatcgggcgctacctcaagaagggccggtacgcgcagcgcgtgggcacgggcgcccccgtctacctcgccgccgtcctggagtacctcgccgccgaggtgctggagctggccgggaacgcggcgagggacaacaagaagacgcgcatcatcccccgccacgtgctcctggccatccgcaacgacgaggagctcgggaagctgctggccggcgtcaccatcgcgcacggtggcgtcctccctcaacccggtgctcctgcccaagaaggtggccgagaaggcggccaaagtccccaaagaaggccgccaagtcccccaagaaggcttagaaagtaggggctccattagcactgtgttgtaacttgtcgtgtttagatctggatgtgttctggtctacttt

SEQ ID NO: 3732 - DNA, 597 bp, Saccharum officinarum
cgaagcgcagcagtagcagcagcagcagccatggacgtgagcggagcgggagccggcgggaaggcgaacaatggcgcgggcgggcggaaggccggcggcgggccgaggaagaagtaggtgacgcggtccgtcaaggccgggctgcagttacccgtcggccgcatcgggcggtacctgaagaaggggcggtacgcgcagcgcgtgggcacgggcgccctcgtgtacctcgccgccgtcctcgagtacctggccgacgaggtgctggagctggccgggaacgccgccagcgacaacatgaagacccgcatcatcccgcgccacgtgctcctggccatccgcaacgacgaggagctcggcaagctgctggccggcgtcaccatcgcccacggtggcgttctccacaacatcaaccccgtgctcctacccaagaaggtcgccgagaaggccgcggccaatgagcccaagtcgcccaagaaagccgccaagtcccccaagaaggcatatggaggccggcattaacgctgtcatgttgaatgctcatgttcagtaaatctgtatgtccgtagatggcacggtctctgcgctctagtgtcgtcg

SEQ ID NO: 3733 - DNA, 755 bp, Oryza sativa
catcgcgcactcgcattcgacgacccaagaaaaggaaaaaaaaagaaaaacaatcctccacgccttcgagcgcagcaggaaccagcttagctagactagccatggacgccgccggagccggagcgggtgggaagctgaagaagggagccgccgggaggaaggccggtgggccgaggaagaaggcggtgtcgcgctccgtcaaggccgggctccagttccccgtcggccgtatcggccgctacctcaagaagggccgctacgcgcagcgcatcggcaccggcgcccccgtctacctcgccgccgtcctcgagtacctcgccgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggcggccggcaagtcccccaagaaggcctagacgtcggcgcctcgctttgcttgtttagctggagtagattggacgggatgtgtgtctgttagtagtctgctgatgctgttgatctaatctatagtggtgtcgttgaaccttgtgtctgttcaagaagataaatctaagatatgttaaatttttcttcagagatgtttccattct

SEQ ID NO: 3734 - DNA, 737 bp, Oryza sativa
atcgccatatcgcattcgactaaagaaaagggaaaaaaaaatcctcctcgccttcgacagcagcagcaaccagcttagctaggctagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaaccttgtgatctgtgcttgtgtctgttcaagaagataaatttaagagatgttaaatttttcttca

SEQ ID NO: 3735 - DNA, 728 bp, Panicum virgatum
atctcgcattcctctctccaatctctcgagcctttcctcctcgtccgtcccgagacactcgaagcccagcggcggcatggacaacaccggcaccggagctggcggcaaggtgaagaagggagccggtgggcgcaagacaggcgggccaaggaagaagtcggtgacgaggtccgtgaaggctgggctccagttccccgtcggccgtatcgggcgctacctcaagaagggccgctacgcgcagcgcgtcggcagtggtgcccccgtctacctcgccgccgtcctcgagtatctcgccgctgaggttctggagctcgccggcaacgcggccagggacaacaagaagacgcgcatcatcccccgccacgtgctcctggcgatccgcaacgacgaggagctcgggaagctgctctccggcgtcaccatcgcccacggcggcgtcctccccaacatcaacccggtcctgctgcccaagaagacggcggagaaggcgtccagtggcggcagcaaggaggccaagtcgccgaagaaggcggccaagtcccccaagaaggcatagagggtggacttagatccaaatgtgtagcgccgtctcgtgtttcctgtgatgtttaggttgttgatgagggaaagttgtgggcggatatgagccagtggtgtcgtaacttgtgatctgtggttttcaatggaagaaatggttagttcaacttaactcggtgcgcctgattttg

SEQ ID NO: 3736 - DNA, 693 bp, Panicum virgatum
cgcattcctcaatctctcgagcctttcctcctcgtccgtcccgagacactcgaagcccagcggcggccatggacaccaccggcaccggagctggcggcaaggtgaagaagggagccggtgggcgcaagaccggcgggccaaggaagaagtcggtgacgaggtccgtgaaggccgggctccagttccccgtcggccgtatcgggcgctacctcaagaagggccgctacgcgcagcgcgtcggcagtggtgcccccgtctacctcgccgccgttctcgagtatctcgccgctgaggttctggagctcgccggcaacgcggccagggacaacaagaagacgcgcatcatcccccgccacgtgctcctggcgatccgcaacgacgaggagctcgggaagctgctctccggcgtcaccattgcccacggcggcgtcctccccaacatcaacccggtcctgctgccgaagaagacggcggagaaggcgtccagcggcggcagcaaggaggccaagtcgccgaagaaggcggccaagtcccccaagaaggcatagagggtggacttagatccaaatgtgtagcgccgtctcgtgtttcctgtgatgtttaggttgtaggtcagtggtgtcgtaacctgtgatctgtggttttcaatggaagaaatggttagttcaacttaactcggtgcgcctgattttg

SEQ ID NO: 3737 - DNA, 802 bp, Zea mays
  misc_feature (103)..(103): n is a, c, g, or t
gatcacaattcactccactcatcttttctcgtttagaacctctaaaatttcccccactcgccagtcgcagcagcacctgtagcagtcatggacgccagcggancggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaaaaaggcggcggaaaaagcggccagcggcggcaacaaggagcccaagtcccccaaaaagggcgccaagtccccccagaaaggcttaaaaagtagggtcttcatttgcgctgtgtgctgtagcatgttcgtgtctagatctgtggatggggatgtgtcatgctctaagaatccggccctgggggccctaattggaaggtttccgcccttcaaccgagaaaaaactcttcaccaagtccaaaaagctccggttggtggaaactaaagggttcccccccctgggttcccgggtttcctccgggttccggaaattccccgccaaaaattcct

SEQ ID NO: 3738 - DNA, 558 bp, Saccharum officinarum
aatctccagagccctttctcgccatggactccaccggcgccggagcgggagggaaggtgaagaagggagcgggcgggcgcaaggccggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgccgctgaggttctggagctcgccgggaacgcagccagggacaacaagaagacccgcatcatcccccgccacgtgctgcttgcgatccgcaacgacgaggagcttgggaagctgctggccggcgtgaccatcgcccacggtggcgtgctgcctccactcagttctgctgcccaagaagacggcagagaaggcgtccaaagtcgcccaagaaggctgccaagtcccccaagaaggcatagagtgtcgaggatgatttgatgttaagcgtcgtattcctgtgatgtgtaggttaatggatgtgcttggagattaaccggtc

SEQ ID NO: 3739 - DNA, 556 bp, Saccharum officinarum
aatctccagagcccttctcgccatggactccaccggcgccggagcgggagggaaggtgaagaagggagcgggcgggcgcaaggcaggcgggccgaggaagaagtcggtgtcgaggtccgtgaaggccgggctccagttccccgtcggccgcatcgggcgctacctgaagaagggccgctacgcgcagcgcgtcggcaccggggcccccgtctacctcgccgccgtcctcgagtacctcgccgctgaggttctggagctcgccgggaacgctgccagggacaacaagaagacgcgcatcatcccccgccacgtgctgcttgcgatccgcaacgacgaggagctcgggaagcttctggccggcgtgaccatcgcccacggcggcgtgctgcctccactcggttctgctgcccaagaagacggcggagaaggcgtccaaagtcgcccaagaaagccgccaagtcccccaagaaggcatagagtgtcgaggcagatctgatgtttagcgtcgtattcctgtgatgtgtaggctaatggatgtgcttgagattaaccggtc

SEQ ID NO: 3740 - DNA, 685 bp, Saccharum officinarum
cccgcggcgggacacagattgcctctcaatctcgaagcgcagcagcagcagcttttcaaccgccggcggccatggacgtgagcggagcggcagcctgctgaaaggcgaagaagggcgccgccgggcgcaaggccggcgggccgaggaagaagtcggtgtcgcggtccgtcaaggccgggctgcagttccccgtcggccgcatcgggcggtacctcaagaagggccggtacgcgcagcgcgtctgcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccccaacatccactctgtgctcctccccaagaaggtggccgagaaggcggccaaggagcccaagtcgtccaatatggccgtcaagtcctccaagaaagcctagagtgctctcgttttttagaggacaagggaagctcctcctttaaaccattaccattagtgctgtcctgttagattatatcatgtttagtgtacctttggaacgttcttgtccttgctgctatttggaatggtttatctaatacttgt

SEQ ID NO: 3741 - DNA, 868 bp, Sorghum bicolor
tttcccatcacctcgcaatctcgcactcctccaatctccagagccctttgtcctctgtcccgagaagcaactcgcagcacagccgcggccatggactccaccgcagccggagcgggagggaaggcgaagaagggagcggccggacgcaaggccggcgggccgaggaagaagtcagtgtcgaggtcggtgaaggccgggctccagttccccgtcggccgcatcgggcgctacctgaagaagggccgctacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccattgcccacggcggtgtgttgcccaacatcaacccggttctgctgcccaagaagacggcggagaaggcgtccaccggtgggagcaaggaggccaagtcgcccaagaaggccgctaagtcccccaagaaggcatagaagggtgtctatgcttatctgatgtttaccgtcgtattaccagtgatgtgttgtagatgggtgtggatggagattaaccggtcttgtagtatgttatctttaattcccagtacaagaaattcctagtttcttgaaagttgaaaacgtcttcttattttcatgtctgtattcctgttctgccgtgtgctctgcattgtatcttgctaaaaatcggggcaatgggcagtaacttagatgtggaaatttgaattatgtttttggctctaatggggatcgaagtgaaactgttgcacgggtc

SEQ ID NO: 3742 - DNA, 786 bp, Sorghum bicolor
ctcgcaatctcgcactcctccaatctccagagccctttgtcctctgtcccgagaagcaactcgcagcacagccgcggccatggactccaccgcagccggagcgggagggaaggcgaagaagggagcggccggacgcaaggccggcgggccgaggaagaagtcagtgtcgaggtcggtgaaggccgggctccagttccccgtcggccgcatcgggcgctacctgaagaagggccgctacgcgcagcgcgtcggcaccggcgctcccgtctacctcgccgccgtcctcgagtacctcgccgctgaggttctggagctcgccgggaacgccgccagggacaacaagaagacgcgcatcatcccccgccacgtgctgctcgcgatccgcaacgacgaggagctcgggaagctgctgtccggtgtcaccattgcccacggcggtgtgttgcccaacatcaacccggttctgctgcccaagaagacggcggagaaggcgtccaccggtgggagcaaggaggccaagtcgcccaagaaggccgctaagtcccccaagaaggcatagaagggtgtctatgcttatctgatgtttaccgtcgtattaccagtgatgtgttgtagatgggtgtggatggagattaaccggtcttgtagtatgttatctttaattcccagtacaagaaattcctagtttcttgaaagttgaaaacgtcttcttattttcatgtctgtattcctgttctgccgtgtgctctgcattgtatcttgctaaaaatcggggcaatgggcagt

SEQ ID NO: 3743 - DNA, 737 bp, Panicum virgatum
gaacgcgctcagcacggcatttgggcggaattctcgcgctcagattccccaattttccctcctccaaagctctcccgaagcgcggcagcggcgaccatggacgccagcggagccaccgggaaggtgaagaagggggcggccgggcgcaaggcgggtggccccaggaagaagtcggtgtcgcggtccgtgaaggccgggctccagttccccgtaggccgcatcgggcgctacctcaagaagggccggtacgcgcagcgcgtcggcaccggcgcccccatctacctcgcggccgtcctcgagtacctcgccgccgaggtgctggagctggccggcaacgcggcgagggacaacaagaagacgcgcatcatcccgcgccacgtgctccttgcgatccgtaacgacgaggagctcgggaagctgctggccggcgtcaccatcgcccacggcggcgtcctccccaacatcaacccggtgctgctgcccaagaaggccgcggagaaggcggccagcggcggcgccaaggaggccaagtcgcccaagaagggcgccaaatccccgaagaaggcttagacagtagagactccagtagcactgtggtgtaacatgttggtgtttagatttgtggatgggttgtgttctggtctaatttcgtcgtggcttgtgatctgtgtttatcagtgagagattttcagaaatctgggctcgttagttactatatatgacctggtttcttgtcc

SEQ ID NO: 3744 - DNA, 718 bp, Saccharum officinarum
  misc_feature (105)..(105): n is a, c, g, or t
  misc_feature (488)..(488): n is a, c, g, or t
  misc_feature (571)..(571): n is a, c, g, or t
  misc_feature (591)..(591): n is a, c, g, or t
  misc_feature (619)..(619): n is a, c, g, or t
  misc_feature (623)..(623): n is a, c, g, or t
  misc_feature (633)..(634): n is a, c, g, or t
  misc_feature (640)..(641): n is a, c, g, or t
  misc_feature (653)..(653): n is a, c, g, or t
  misc_feature (672)..(672): n is a, c, g, or t
ttcgcctgcacgtacttggaccgcagttcgcctgcacgaaccggcgccggacttccatgttctaccatctcccaagacctactatgacggcacaccctactcgtngcgcagccgcggccatggattccaccggcgccggagcgggagggaaggtgaagaaaggagcgggcgggcgcaaggccggcgggccgaggaagaagtcggtgtcgaggtctgtgaaggccggcctccagttccccgtcggccgcatcgggcgctacctgaagaagggccgctacgcgcagcgcgtcggcaccggcgcccccgtctacctcgccgccgtcctcgagtacctcgccgctgaggttctggagctcgccgggaacgctgccagggacaacaagaagacgcgcatcatcccgcgccacgtgctgctcgcgatccgcaacgacgaggagctcgggaagctgctggccggcgtgaccatcgcccacggcggcgtgctgccnaacatcaacccgttctgctgcccaagaagacggcggagaaggcgtccagcggcgggagcaaggagcccaagtcgcccaagaanggcgccaagtcccccaagangcatagactgtccagccagatccaatgnttancactaccttnntaccanngatgcgtaggtntaaatgggatgaatgtgcntggatggtgtccctgtcttggtgcaaagttggtttttctgtggatt

SEQ ID NO: 3745 - DNA, 539 bp, Saccharum officinarum
atctcccaagacctactctgaccgccatggattccaccggcgctggagcgggagggaaggtgaagaagggagcgggcgggcgcaaggccggcgggccgaggaagaagtcggtgtcgaggtccgtgaaggccgggctccagttccccgtcggccgcatcggtcgctacctcaagaagggccgctacgcccagcgcgtcggcaccggcgcccccgtctacctcgccgccgtcctcgagtacctcgccgctgaggttctagagctcgccgggaacgctgccagggacaacaagaagacgcgcatcatcccacgccacgtgctgctcgcgatccgcaacgacgaggagctcggtaagctgctggccggcgtgaccatcgcccacggcggtgtgctgcctcaacccggttctgctgcccaagaagacggcggagaaggcgtccaaagtcgcccaagaaggccgccaagtcccccaagaaagcatagactgtccagcctgatccaatgtttagcactaccttgtaccagtgatgcgtagggtgaa

SEQ ID NO: 3746 - DNA, 1368 bp, Zea mays
ctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacacgaccatcagcgtcgacggcaagcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctcaaggggaagctgaacggcatcgcgctgcgggtgccgaccccgaacgtgtccgtggtggacctggtgatcaacaccgtgaagactggcatcacggccgacgacgtgaacgcgagcgcacccggacccggcgggaaggcgaagaagggcgcgcccgggcgcaagcccggcgggccgaggaagaagtcggtgacgaggtccgtcaaggctgggctgcagtttcccttcggccgcatcgggcggtacctgaagaagggtcggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgccaagtcccccaagaaggcatagaggggcgggcgcctttaccgctgtgatgttgaatgctcgtgttcagtagatctttacgtctgtagtgtcgtcgttgttattggaactggttagtagatctgtgcattgtggttgaaacgtgattccctgatttcagaaaatactaatttagtcaatttgggtgca

SEQ ID NO: 3747 - DNA, 704 bp, Cenchrus ciliaris
ttcctcagatctcttgagcccttcctcctcgtcccgagaagccactcgaagcgcagccgctgccatggacgccaccggtaccggagcgggcggcaaggtgaagaagggagcggccgggcgcaaggctggtggcccgaggaagaagtcggtgtccaggtccgtgaaggccgggctccagttccccgtcggccgcatcgggcgctacctcaagaagggtcgctacgcgcagcgcgtcggcaccggcgcccccgtctacctcgccgccgtcctcgagtacctggccgctgaggttcttgagctcgccgggaacgctgccagggacaacaagaagagccgcatcatcccccgccacgtgctcctggcgatccgcaacgacgaggagctcgggaagctgctcgccggagtcaccatcgcccacggcggcgtcctccccaacatcaacccggtgctgctgcccaagaagacggcagagaaggcgtccagcggcgggagcaaggaggctaagtcgccgaagaaggccgccaagtcccccaagaaggcttagatggtggactcagatccgatgtctggcgccgtttcctgttacccgtggtgtttaggttgtagatgcgaggaagttggtgcatcgagatgaaccagtattgtaacttatgatctgtggttttcaatggaacaaatggctagtttaagttaaaaaaaaaaaa

SEQ ID NO: 3748 - DNA, 776 bp, Zea mays
ggcactcatacatttcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttagaacaatattaccattagcaatcgtgcagttagactagatcatgtttagtgtagatccgcaatgttcttgtccctgcagccatctggaacggtttatctagtacatccgtgcactttccttgctaattgcaaaaaaagcggtctaatcttttgtttcgtttcttgcgtacatttgcgatttatgctcgttaatacacttattaatatcacaagaaggggaagaaaaggaa

SEQ ID NO: 3749 - DNA, 724 bp, Zea mays
atcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgctgggcggcgtgaccatcgctcacggcggtgtgctccccaatatcaaccctgttctgctgcccaagaagacggcggagaaggcgtccagtgtggggagcaaggaggcaaagtcgcccaagaaggccgccaagtcccccaagaaggcatagactgactgtctggagtgatctgatgtttagcaggaccttgataccagtatgcggtgatgcgtaggctgtagatgggtcgaatgtgcttgtgtgtgtatgtgccctgctgcaagttgccctttgctaatttaaaatggaagaagaaatgcctttgtttctc

SEQ ID NO: 3750 - DNA, 745 bp, Zea mays
actttcccatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtgtggggagcaaggaggcaaagtcgcccaagaaggccgccaagtcccccaagaaggcatagactgactgtctggagtgatctgatgtttagcaggaccttgataccagtatgcggtgatgcgtaggctgtagatgggtcgaatgtgcttgtgtgtgtatgtgccctgctgcaagttgccctttgctatttaaaatggaagaagaaatgccttgtttctctgaggttgcaatgtc

SEQ ID NO: 3751 - DNA, 726 bp, Panicum virgatum
atctcgcattcctccgatctctcgagcctttcttcctcgtcccgagaagccccacgaagagcagcggcggcaatggactccaccggcaccggagctggcggcaaggtgaagaagggagcagctgggcgcaagaccggcgggccgaggaagaaggcggtgtcgaggtccgtgaaggccgggctccagttccccgtcggccgtatcgggcgctacctcaagaagggccgctacgcgcagcgcgtcggcactggcgcccccgtctacctcgccgccgtcctcgagtatctcgccgctgaggttctggagctcgccggcaacgcggccagggacaacaagaagacccgcatcatcccccgccacgtgctcctggcgatccgcaacgacgaggagctcgggaagctgctctccggcgtcaccatcgcccacggcggcgtcctccccaacatcaacccggtcctgctgcccaagaagacggcggagaaggcgtccagcggcggcagcaaggaggccaagtcgcccaagaaggccgccaagtcccccaagaaggcatagagggtgggcttagatccaatgtctagcgccgtttcgtgttttcatgtgatgtgatgtttaggttgtagatgtggaaaagttgtggtcggagatgaaccagtggtgtcgtgacttgtgatctgtggttttcaatgaagaaattactagttaaacttaacacgatgtgcctgattt

SEQ ID NO: 3752 - DNA, 674 bp, Saccharum officinarum
cgctttcctccctcgtatccactgcttctccaagcgcagcagtagcagcgcagcagtcatggacgtgagcggagcgggagccggcgggaaggctaataagggcgcgggcggtcggatggccgtcggctggccgaggaataagtctgtgacgcggtccgttaatgccgggctgtagttccccgtcggccgcatcgggcggtacctgaagaaggggcggtactcgcagcgcgtgggcacgggcgcccccgtgtacctggccgccgtcctcgagtacctggccgccgaggtgctggagctggccgggaacgcggccagggacaacaagaagacccgcatcatcccgcgccacgtgctcctggccattcgcaacgacgaggagctcggctagctgctggccggcgtcaccatcgcccactgtggcgttctccccaacatcaaccccgtgctcctgcccaagaaggtcgccgagaaggccgcggccaatgagcccaagtctgccaagaaggctcgcaagtcccccaagaaggcatagggaggccgccattagcgctgtcatgttgaatgctcatgttcagtagatctgtaggtccgtagattgcacggtctctgcgctctagtgtcgtcgtcgttttttggacttgttaatagatctgtgcatttttgtttggaggaga

SEQ ID NO: 3753 - DNA, 712 bp, Saccharum officinarum
gcattcctccaatctccagagccctttctcctcgagaagccactcgaagcgcagctgcggccatggactccaccggcgccggagcgggagggaaggtgaagaaaggagcgggcgggcgcaaggccggcgggccgaggaagaaagtcggtgtcgaggtccgtgaaagccggactcccagttcccctcggcccgcatcgggcgctactcttgaagaagggccggtacgcgcagcgcgtcggaaccggcgcccccgtctacctcgccgccgtcctcaagtacctcgccgttgaggttctggagctcgccgggaacgcagccagggacaacaagaagacccgcataatcccccgccacgtgctgcttgcaatccgcaacaacaaggagctggggaagctgttggccggcgtaaccatcgcccacggtggcgtgctgcccaacatccactcagttctgctgcccaagaagacggcagagaaggcgtccaacaaggagcccaagtcgcccaagaaggctgccaagtcccacaagaaggcatagagtgtcgaggatgatttgatgttaagcgtcgtattacctgtgatgtgtaggttgtaaatcgaatggatttgctttggagataaaccgtctttgtacaaagtatctttgatttcagaacaagaatgcctaatttcttgaaatttaaaacgcgtggttatttacatacctggattcc

SEQ ID NO: 3754 - DNA, 687 bp, Pennisetum glaucum
gcacgaggcttccttcctcctcgtcccgagaagcccactcgaagcgcagccgctgccatggacgccaccggtaccggagcggccggcaaggtgaagaagggagcggccgggcgcaaggccggcggccctaggaagaagtcggtgtctaggtccgtgaaggccgggctccagttccccgtcggtccgcatcgggcgctacctcaagaagggccgctacgcgcagcgcgtcggcaccggcgcccctgtctacctcgccgccgtcctcgagtacctggccgctgaggttcttgagctcgctgggaacgctgccagggacaacaagaagagtcgcatcatcccccgccacgtcctcctggcgatccgcaacgacgaggagctcgggaagctgctcgctggagtcaccatcgcccacggtggcgtcctccccaacatcaacccggtgctgctgcccaagaagacggcagagaaggcgtcaagcggcgggagcaaggaggccaagtccccgaagaaggccgccaagtcgcccaagaaggcatagacggtagactcagatctgatgtcgcgccatttcctgttacctgtggtgtttaggttgtagatgtgaggaaattggtgcttggtgatgaaccagtattgtaacttgtgatctgtggttttcaatgggagaaatggctagtttaagttacc

SEQ ID NO: 3755 - DNA, 843 bp, Zea mays
taactacccggaccaccagacaatcccctcatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttcttacgcctgcttttggttctgcattctactgaaaaagcgtacgataattaacacattcacctttgaagaatcacgattgaaaagtacattaaatatttgctaatggagattttgggagcgtttgctttaaggaatcattacg

SEQ ID NO: 3756 - DNA, 814 bp, Panicum virgatum
accactcgaattatcgcgcccagattccccatttttcgctcctccaaaactctcccgaagcgctgcagcagcgaccatggacgccagcggagccaccgggaaggtgaagaagggggcggccgggcgcaaggccggcggtcccaggaagaaggcggtgtcgcggtccgtgaaggccgggctccagttccccgtcagccgcatcgggcgctacctcaagaagggccggtacgcgcagcgcgtcggcaccggcgcccccatctacctcgccgccgtcctcgagtacctcgccgccgaggtgctggagctcgccgggaacgcggcgagggacaacaagaagacgcgcatcatcccgcgccacgtgctcctggcgatccggaacgacgaggagctcgggaagctgctggccggtgtcactatcgcccacggcggcgtcctccccaacatcaacccggtgctgctgcccaagaaggtggcggagaaggcgaccagcggcggcgccaaggagggcaagtcgcccaagaagggcgccaagtcccccaagaaagcctagacagtagagactccattagcaccgtgctgtaataacatgttcgtgtttagatttgtggttgggttgtgcccgttcgtcagttgttactatgttctgtttcttgttcacatttgcaatttgggtttgcggttcagttcagagtagtacggaatgagcagtgactacaactctgcgtcagaagagacttctgaagatgtaatcacagttgtatcctgaactcactgtcccggcatctggttcagcacagattcgtccaagttcaag

SEQ ID NO: 3757 - DNA, 696 bp, Avena sativa
gaccaacacacttcacaatccccaatcgtccccaatctgcaaactcttctcttctctgaatctcagcagccagcaatggatgtctcaagcacagcaaccggcgggaaggcgaagaagggagcggccggtcgcaaggccggaggccccaggaagaagtcggtgacgcggtcggtcaaggcggggcttcagttccccgtcggccgcgtcggtcgctacctaaagaagggcaggtatgcccagcgcgtcggcaccggcgcccccgtctacctcgcggcagtcctcgagtacctcgccgccgaggtactggagcttgccgggaacgccgccaaggacaacaagaagtcgcgcatcatcccaaggcacttgctgctcgctgtcaggaacgacgaggagctcggcaagctgctcgccggagtcaccattgctcacggcggcgttctgcccaagatcaacccggtgctgctccccaagaagacggccgagaaggcggccaaggagcccaagtcaccgaagaagacagccaagtccccgaagaaggcatagagattactagttgaattcctttgtttgtagtagctgggattgatgggtgtccttcagagtagaatgttgttgtttgaaagttctctggtggtgccgctgtaccttcagatctgtaatttcaatggaacaatgagatgcttagatattgtcctc

SEQ ID NO: 3758 - DNA, 856 bp, Saccharum officinarum
  misc_feature (111)..(112): n is a, c, g, or t
  misc_feature (191)..(191): n is a, c, g, or t
gccatggaagtaagcggaaccggagcgcggggaaggagaaaaagggctcggcggggcgcaaggccggcgggccgaggaaaagttcggtgtcgcggtccgtcaaggccgggnngcagttccccgtcggccgcatcgggcggtacctcaagaagggccggtacgcgcagcgcgtcggcacgggcgcccccgtntacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccccaacatccactctgtgctcctccccaagaaggtggccgagaaggcggccaaggagcccaagtcgcccaagaaggccgccaagtcccccaagaaggcctagagtgctctcgtctcttagaggacaagggaggctcctccattagtgctgtcctgctagattagatcatgtttagtgtacctctgtaacgttcttgttcttgccgctaattggaatggtttatctagtactagtacatctgtgcattttcgttggttgcaacaagatttcaggaaccagagtttgctacttgcaaaaggtgtgctcaacttctcatagaacctggatttggtaagtgggtcatgtagtcataactgaaccgatagaagaaactagatacagtggtatgcctgagaccagttgctcctaatggattgtatctctatggaaaaaaaatgtacatgcagcatgcacaaaagaagcagtttctagtctggttggttggatct

SEQ ID NO: 3759 - DNA, 627 bp, Saccharum officinarum
  misc_feature (91)..(91): n is a, c, g, or t
cgcgcccagagcccccaaaattttctcctctcaatcgcagcaggagcagcgagcagccatggacgccagcggagccggtggcaaggcgaanaagggtgcggccgggcgcaaggctggcggcccccggaagaagtcggtgtcgcggtccgtcaaggccgggctgcagttccccgtcggccgtatcgggcgctacctcaagaagggccggtacgcgcagcgcgtgggcacgggcgcccccgtctacctcgccgccgtcctggagtacctcgccgccgaggtgctggagctggccgggaacgcggcgagggacaacaagaagacgcgcatcatcccccgccacgtgctcctggccatccgcaacgacgaggagctcgggaagctgctggccggcgtcaccatcgcgcacggtggcgtcctccccaacatcaacccggtgctcctgcccaagaaagtggccgaaaaagcggccagcggcggcagcaagcaggccaagtccccaaaaaaggccgtcaagttccccccagaaagcttataaagtaggggcttccttaacactgtgttggaacttgttcgtgtttaaatctgtggatgaaatgtttttgtgtctaattcgtccctgtggcgtat

SEQ ID NO: 3760 - DNA, 666 bp, Gerbera hybrid cultivar
aaatccatcactcgcttctgtaaacatcgccggagaaagatggacggagccggaaaagcgaagaagggcgcaggaggaaggaagggcggcggtccaaggaagaaggcggttactcgttcagtcaaagctggtctacagttccccgtcggtagaattgggcggttcctcaagaaaggccgttatgctcagcgagtcggctccggtgctccggtttacctcgccgccgtcctcgaatacctcgccgccgaagtgctagagttagctggaaatgctgcgagggacaacaagaagaacaggattatcccaaggcatgttcttctcgccatcagaaacgacgaggagcttggaaaattgcttgctggagtcaccattgctcacggcggtgttcttccaaacatcaaccctgtgttgctgcccaagaaggctgctgctgccaaggaaccaaaatcgccatcaaaagcaaccaaatctccgaagaaagcttagtaagattgttgtgttttgtaatttgtaagtgtgggattctctttcttctccccaatttgtgttagtattttgggtgatttggaagaagagctaggtttaatttagttgatatgaggtgtttgtatgttggtgtttgatccattttaatcaatgaaacctcttgtttcttttaaaaaaaaa

SEQ ID NO: 3761 - DNA, 644 bp, Avena sativa
caatccccaaacaccaatctgcaaactcctctctgaagccaagcagctagccatggacgtcccaagcacagcaaccggcgggaaggcgaagaagggaggagcagggcgcaaggccggcggcccgaggaagaagtcggtgacgaggtcggtgaaggccgggctccagttcccagtcggccgcatcgggcggtacctcaagaagggccggtacgcccagcgcgtcggcaccggcgcccccgtctacctcgcggcggtcctggagtacctcgcagctgaggttctagagctcgccggaaacgccgccaaggacaacaagaagtcgcgcatcatcccgcgccacctgctgctcgccatcaggaacgatgaggagctcgggaagctgctggccggcgtcaccattgcgcatggtggtgtgctgcccaagatccactccgtgctgctccccaagaaggcggcggagaaggcggagaaggctgccaagtcgcagaagaaggccaccaagtcccccaagaaggcctagagaactcgttgtgttacataggttgtactagctgggattggtaggtgtgcttcagaatagattgttgttgtttgtccggtcgcgtccttctgatctgtaatttcaatggaacaacgggttactt

SEQ ID NO: 3762 - DNA, 621 bp, Saccharum officinarum
cacggcatctcgaagcgcagcagtagcagcagcagcagccatggacgtgagcggagcgggagccggcgggaaggcgaagaagggcgcgggcgggcggaaggccggcggcgggccgaggaagaagtcggtgacgcggtccgtcaaggccgggctgcagttccccgtcggccgcatcgggcggtacctgaagaaggggcggtacgcgcagcgcgtgggcacgggcgcccccgtgtacctcgccgccgtcctcgagtacctggccgccgaggtgctggagctggccgggaacgtggccagggacaacaagaagacctcgcatcatcccgctccacgtgcttctggccatccgcaatgacgaggagctcggcaagctgctgtccggcgttaccatcggccacggtggcgtactgctcaacatataccttgtgctcctgcctaagaaggtcgctgtgaatgccagggccaatgagcccaagtcgctctacaatgtcgtcaagtccccctagaaggcatatggaggcctccatttgcgctgtcttgttgaatgctcatgttcaagtaatcttgacgttcagtgattggacggtctcttggctctagtgtcgtcttttgtgtttgaac

SEQ ID NO: 3763 - DNA, 700 bp, Saccharum officinarum
tccacgccatctcgaagcgcagcagcagcagccatggacgtgagcggagcgggagccggcgggaaggcgaagaggggcgcgggcgggcggaaggccggcggcgggccgaggaagaagtcggtgacgcggtccgtcaaggccgggctgcagttccccgtcggccgcatcgggcggtacctgaagaagggccggtacgcgcagcgcgtgggcacgggcgcccccgtgtaccttgccgccgtcctcgagtacctggccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggcggtggtcttcccaacatcaaccccgtgctccttgccaagaaggtcgccgagaagggcgcggccaaggagcccaaatcgcccaagaaggccgcaagtcccccaagaagcctagaggggtcttcattgccggtgtgatggtgaatgctcattgtcagtaaatctgtagtaggtttgtagatggcacggtctctacgttgttggaactgttaatagatctgtctgtgccgtttgggtggaaggagatttcaggatcagagttttacatgcaaaatgtcttttgatttagaaatcagattgcaatttgggc

SEQ ID NO: 3764 - DNA, 579 bp, Beta vulgaris
  misc_feature (514)..(514): n is a, c, g, or t
aatttttccagaaatataaacttcatttaggagagagaaaaaaccacaatggatacagcaggtggtaaaggaaagaagggtgcagcaggaagaaagggtggaggtccaaagaagaaaccagtttcaaggtcagttaaagctggtttacaatttccagttggaagaattggtcgttatttgaagaaaggtcgttatgctcaacgtgttggtactggtgctcctgtttatttggctgctgttcttgagtaccttgctgctgaggtgttagaattggctggaaatgctgcaagagataacaagaagaacagaatcatcccaagacatgtgttacttgctgttcgaaacgatgacgagctcggaaagcttctagctggagttaccattgctcatggaggtgttcttccaaacataaatccagtgttgttgcctaagaaaactgcagagaaggcggcgaaagagcctaaatctcccaaggctgctaaatcccctaagaaagcttagagatgattaattntgtgtttattttagtttgtgtttttaatcaaatctttgtatgtaatgtcactagatgtttttaat

SEQ ID NO: 3765 - DNA, 564 bp, Festuca arundinacea
ggcacgaggctcaaaacaaatctgagcactcttctccgaagcatagcccaccagcttgccatggacgtctcaagcacagcagccggcggcaaggccaagaagggagcggccgggcgcaaggccggcggtcccaggaagaagtccgtgactaggtccgtcaaggccgggctccagttccccgtcggccgcgtcgggcgctacctcaagaagggccggtacgcgccgcgcgtcggcaccggcgcccccgtatacctcgccgccgtcctcgagtacctcgcggccgaggtgctggagctcgccgggaacgccgccaaggacaacaagaagtcgcgcatcatcccgcgccacctgctgctcgccgtgaggaacgacgaggagctcggcaagctgctcgccggcgtcaccatcgcgcacggcggcgtgctgcccaagatcaaccccgtgctgctccccaagaagacggccgacaaggcggccaaggagcccaagtcgccgaagaagacagccaagtcccccaagaaggcgtagagaccatttgcattgcataggttggagtagctggga

SEQ ID NO: 3766 - DNA, 578 bp, Saccharum officinarum
ttgccactcaactctcaatctctctcccgatctcgaagccgcagtagtattcagcagccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggataacaagaagacgcgcatcatcccgcgccacgtgctcctggctatccgcaacgacgaggagctcggcaagctgctggccggcgtcaccatcggccacggcggcggtcttcccaacatccactttgggcttcttcccaaaaaggtggcccaaaaggcggccaagaacccaattccccaagaaaggcgccaagtccccaagaaggcttagaatgctttcgttttttgggagaagggagggttttcaattagacaataacattag

SEQ ID NO: 3767 - DNA, 719 bp, Brachypodium distachyon
tcccaatcccccgcatcaccacaccaaatctctgaaatcgaaagcggttgctgcttcacctgccgagcaaatggacaccggagccgggaaggcgaagaagggcgctggcgggcgcaaggcaggcggcggcggcggccccaggaagaagtcggtgacgcggtccgtcaaggccgggctccagttccccgtcggccgcatcgggcgctacctcaagaagggccgctacgcgcagcgggtcggctccggtgcccccgtctacctcgccgccgtcctcgagtacctcgcagccgagctgctcgagcttgcaggcaacgccgccagggacaacaagaagacccgcatcattccgcggcacttgctgctcgccatcaggaacgacgacgagctcgggaagctgctggccggcgtcaccatcgcccacggcggcgtgatgcccaagatcaaccaggtgcttctccccaagaagacggcggccaaggagcccaaggaacccaagtcgcccaagaaggccgccaagtcccccaagaaggcttagaaagatgtgtcacattgcttaattaggttgtgtagtgtggttcatagtggaattctcctcgttcgctgtgccttgtggtctctgattgttagtaattgaagaatttcagaagtcgctgatttgatttgcagaaatatcgtgctgtctagtgtcttccaattttgcatcgctattgagattttgg

SEQ ID NO: 3768 - DNA, 649 bp, Brachypodium distachyon
tcccaatcccccgcatcaccacaccaaatctctgaaatcgaaagcggttgctgcttcacctgccgagcaaatggacaccggagccgggaaggcgaagaagggcgctggcgggcgcaaggcaggcggcggcggcggccccaggaagaagtcggtgacgcggtccgtcaaggccgggctccagttccccgtcggccgcatcgggcgctacctcaagaagggccgctacgcgcagcgggtcggctccggtgcccccgtctacctcgccgccgtcctcgagtacctcgcagccgagctgctcgagcttgcaggcaacgccgccagggacaacaagaagacccgcatcattccgcggcacttgctgctcgccatcaggaacgacgacgagctcgggaagctgctggccggcgtcaccatcgcccacggcggcgtgatgcccaagatcaaccaggtgcttctccccaagaagacggcggccaaggagcccaaggaacccaagtcgcccaagaaggccgccaagtcccccaagaaggcttagaaagatgtgtcacattgcttaattaggttgtgtagtgtggttcatagtggaattctcctcgttcgctgtgccttgtggtctctgattgttagtaattgaagaatttcagaagtc

SEQ ID NO: 3769 - DNA, 468 bp, Brachypodium distachyon
ctagcaatggacgtctcaggcaccggagccgggaaagcgaagaagggcgcggcggggcgcaaggccggcgggccgaggaagaaatcagtcactcggtccgtcagggccgggctccagttccccgtgggccgcatcgggcggtacctgaagaagggccgctacgcgcagcgcgtcggcaccggcgcccccgtctacatggccgccgtcctcgagtacctggccgccgaggttctcgagctcgcgggcaacgccgccagggacaacaagaagtcccgcatcatcccgcggcacgtgctgctcgccgtcaggaacgacgatgagctcgggaagctgctggccggagtcaccatcgcgcacggcggggtgttgcccaagatcaacccgattctcctccccaagaagaccgcggagaaggcacccaaggaacccaagtcgccgaagaaggctgctactcccaagaaggccgac

SEQ ID NO: 3770 - DNA, 615 bp, Saccharum officinarum
tctcaactctcgatctctctctcgatctggaagcgcaacaccagcagcaggggccgcccgcggccatggacgtgagcggagccggagccggcgggaaggcgaagaagggcgcggcggggcgcaaggccagcgggccgaggaagaagtctgtgtcgcggtccgtcaaggccgggctgcagttccccgtcggccgcatcgggcggtacctcaagaagggccggtactcgcatcgcgtcggcacgggcgcccccgtctacctcgccgtcgtcctcgagtacctcgccgccgaggtgctcgagctcgccggctacgcgggcagggacaacaagaagacgcgcatcatcccgcgccacgtgctcctggctatccgcaacgaccaggagctcggaaagctgctggccggcgtaaccatcgcccacggcggcgtgctaccgaacatccactatgtgctcctccccaagaaggtgggcgacaaggcagtctaggagcccaagtcgcccaagaaggccgtcaagtgccccaagaagcctaaagtgctgtcctctcttagaggacaagggaggctccttcattagtgctgtcctggtacattagatcatgtttagtgtacctctg

SEQ ID NO: 3771 - DNA, 795 bp, Panicum virgatum
cccacgtccgcccacgcgtccgaattatcgaatcccgcctccctcgtttcgccccaacccaaaaccgagtttccctccaattccacccgcctcccctccgagatggacgccggcgcaccgaaggtgaagaaggcggcggcgggccgcaagcttggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgcggccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcagagaaggcggccaagtcgcccaagaaggccgccgcgaagtcccccaagaagtaggctgctcatgatgatgcgcgcgcggatctcacctcatctcaccttgcttttgtgtgtatgtagtgccgcatctcaatgtatcgtgtcctccgagcttcggatcctatgtcgtaggtctaggctttagctgtagtggttggtgatggggatatgtatgtttccaaaatttaatgagaagtgggagcggtagatgtagattcagattggtgaatcctaatgatttcagtgaaattcctt

SEQ ID NO: 3772 - DNA, 811 bp, Panicum virgatum
aaacattgtcgaatcccgtttccctcgcttccccccaaacccaaaaccgaattccctccaaatccacccacaccctccgaaatggacgccggcgccccgaaggtgaagaaggcggcggcgggccgcaagctcggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcggagaaggcggccaagtcgcccaagaaggccgccgccaaatcccccaagaagtaggctgctcctggtcatgcgcgcgctgatctctcatcggatccgatcctagcagtcttgcttcccctgtgttgcttgcttttgtgtgtatgtagtgccgcatctctatgtaccgtgccctccgtgcttcggatcctaagtcgtaggtctaggtctagctgtagttgttggtgatggggttatctatgttcccaaaatttaatgagatgagggatcggtagatgtagattcagattggtgaatcctaatgatttcagtgaaattccttagaaacttg

SEQ ID NO: 3773 - DNA, 1035 bp, Panicum virgatum
cccgtttccctcgcttcccccccaacccaaaaccgaattccctccaaatccacccacaccctccgaaatggacgccggcgccccgaaggtgaagaaggcggcggcgggccgcaagctcggcgggccgaagaagaagccggtgtcgcgctccgtcaaggccgggctccagttccccgtcggccgcatcgggcgctacctcaagaagggccggtatgcgcagcgcgtgggcacgggcgcccccgtctacctcgccgccgtcctcgagtacctcgccgccgaggtcctggagctggcgggcaacgcggcgcgcgacaacaagaagaaccgcatcatcccgcgccacgttctcctcgccatccgcaacgacgaggagctgggcaagctgctggccggggtcaccatcgcgcacggcggcgtcctccccaacatccactcggtgctcctccccaagaaggccgccgagaaggcggagaaggcggccaagtcgcccaagaaggccgccgccaaatcccccaagaagtaggctgctcctggtcatgcgcgcgctgatctctcatcggatccgatcctcgcagtcttgtttcccctgtgttgcttgcttttgtgtgtatgtagtgccgcatgtctatgtaccgtgccctccgtgcttcggatcctaagtcgtaggtctaggtctagctgtagttgttggtgatggggttatctatgttaccaaaatttaatgagaagagggatcggtttactttgtgaattctggatctggtttttgcgcttgcttcctcccggtgcggaagtgggttgtaggatggtacattgcaaaatggggacgaatttcagatgattctgtacattttcattttagcggatcgagatgtagattcagattggtgaatcctaatgatttcagtgaaattcctgtcccgtttgggagggcttctagagcggcttcacgagtggttctaggtgaagctctctcaaacgtcctgaagccatcggtggtttacacatcaatttaacaagtgaagctgttttgcc

SEQ ID NO: 3774 - DNA, 790 bp, Panicum virgatum
tcgaatcccgtttccctcgcttccccccaaacccaaaaccgaattccctccaaatccacccaccccctccgaaatggacgccggcgccccgaaggtgaagaaggcggcggcgggccgcaagctcggcgggccgaagaagaagccggtgtcgcgctccgtcaaggccgggctccagttccccgtcggccgcatcgggcgctacctcaagaagggccggtacgcgcagcgcgtgggcacgggcgcccccgtctacctcgctgccgtcctcgagtacctcgccgccgaggttctggagctggcgggcaacgcggcgcgcgacaacaagaagaaccgcatcatcccgcgccacgtcctcctcgccatccgcaacgacgaggagctgggcaagctgctggccggggtcaccatcgcgcacggcggcgtcctccccaacatccactcggtgctcctccccaagaaggccgccgagaaggcggagaaggcagccaagtcgcccaagaaggccgccgccaaatcccccaagaagtaggctgctcctggtcatgcgcgcgctgatctctcatcggatccgatcctagcagtcttgcttcctctgtgttgcttgcttttgtgtgtatgtagtgccgcatctctatgtaccgtgccctccgtgcttcggatcctaagtcgtaggtctagctgtagttgttggtgatggggttatctatgtcaccaaaatttaatgagatgagggatcggtagctgtagattcagattggtgaatcctaatgatttcagtgaaattccttag

SEQ ID NO: 3775 - DNA, 838 bp, Sorghum bicolor
ccccgcttcctcccaaacccaaattaccactccctccaaatcctcatttccctccacgagcaccctcgactcgactccatggacggcggcggcgcgaaggcgaagaaggcggcggcggggcggaagctgggcggcggagggccgaagaagaagccggtgtcgcggtccgtcaaggccgggctgcagttcccggtgggccgcatcgggcggtacctgaagaagggtcggtacgcgcagcgcgtgggcacgggcgcgcccgtctacctcgccgccgtcctcgagtacctcgccgccgaggtccttgagctggcgggcaacgcggcgcgcgacaacaagaagaaccgcatcatcccgcgccacgtcctcctcgccatccgcaacgacgaggagctcggcaagctgctggcgggcgtcaccatcgcccacggcggcgtgctccccaacatcaactccgtcctcctccccaagaaggccgccgagaaggctgagaaggccgcctccgctaccaagtcgcccaagaaggccgccgccgccaagtcgcccaagaagtagtggtgcccgtctcgtctcgtctcgtctcgtctcgtcggattctcatctcagcttggctgagtgggtggtcgtggatgccttttgctgttcttgcgtgtttgtgtgtatgtagtgatgcgtcgcctcatgtgtcgtgtgcctcgatcgatctaagtctaggtggtttgttatgggatctcagtgttatctaagatttaatgagaacaagaggaagtgccttgctttctttgatggtttgcattcatctgtctctggattgcatccattaatttgtgaatctattttt

SEQ ID NO: 3776 - DNA, 787 bp, Sorghum bicolor
gcttcctcccaaacccaaattaccactccctccaaatcctcatttccctccacgagcaccctcgactcgactccatggacggcggcggcgcgaaggcgaagaaggcggcggcggggcggaagctgggcggcggagggccgaagaagaagccggtgtcgcggtccgtcaaggccgggctgcagttcccggtgggccgcatcgggcggtacctgaagaagggtcggtacgcgcagcgcgtgggcacgggcgcgcccgtctacctcgccgccgtcctcgagtacctcgccgccgaggtccttgagctggcgggcaacgcggcgcgcgacaacaagaagaaccgcatcatcccgcgccacgtcctcctcgccatccgcaacgacgaggagctcggcaagctgctggcgggcgtcaccatcgcccacggcggcgtgctccccaacatcaactccgtcctcctccccaagaaggccgccgagaaggctgagaaggccgcctccgctaccaagtcgcccaagaaggccgccgccgccaagtcgcccaagaagtagtggtgcccgtctcgtctcgtctcttctcgtctcgtcggattctcatctcagcttggctgagtgggtggtcgtggatgccttttgctgttcttgcgtgtttgtgtgtatgtagtgatgcgtcgcctcatgtgtcgtgtgcctcgatcgatctaagtctaggtggtttgttatgggatctcagtgttatctaagatttaatgagaacaagaggaagtgccttgctttctttgatggtttgc

SEQ ID NO: 3777 - DNA, 1124 bp, Saccharum officinarum
cccgcttcctccaaaccccaatcatcacttccctccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctgcccaacatccactccgtcctcctccccaagaaggccgccgagagggctgagaaggccgccaccgctaccaagtcgcccaagaaggccgccgccaagtcgcccaagaagtagtagtgccccgtctcgtcttatctgattctgatctcagcttggctgagtggtcgtggatgccttttgctgttcttgcgtgtctgtgtgtatgtagtgatgcgtcgcctcatgtgtcgtgtgtcttgatcgatctagttctggttcaatctctagctgtagtggtggttggtcatgggatctccatgttacctaagatttaatgaaaacaagaggaagtgccttgctttcttttggttggcaaaaaaaaaaaaataaaaggccggccggtttaaaggatcaagctttcgtacccgtgttggcaaggtataacttttctatagggaccctaaattaattactggccgcggtttacaacgttggattgggaacacctggggtgtcccaattaatgccttgaagacatccctttgccagttggtaatacgaaggagccccacatcggcttccaacatttcgcacctaatgggaaggagcgcctctgtgcggcatttatcccggggtgtggtgttctcccagggaccatccattggcaaggcctagaccgttctttttttttctcttttttcacaggtggagtttc

SEQ ID NO: 3778 - DNA, 817 bp, Saccharum officinarum
  misc_feature (5)..(5): n is a, c, g, or t
accgnaccggttcggttgccggcccgacccacgcgttcgcccgcttcctccaaaccccaatcatcacttccctccaaatcccatttccctctcaacacccgcgactcgcgagatggacggcggcggcgcgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctgcccaacatccactccgtcctcctccccaagaaggccgccgagagggctgagaaggccgccaccgctaccaagtcgcccaagaaggccgccgccaagtcgcccaagaagtagtagtgccccgtatcgtctcatctgattctggtctcagcttggctgagtggtcatggatgccttttgctgttcttgcgtgtctgtgtatgtattgatgcgtcgcttcatgtgtcgtgtctcgatcgatctagttctggttcaatctctagctgtagtggtggttggtgatgggatctccatgttacctaagatttaatgaaaacaagaggaagtgccttgctttcttttggtttg

SEQ ID NO: 3779 - DNA, 782 bp, Saccharum officinarum
  misc_feature (433)..(433): n is a, c, g, or t
  misc_feature (547)..(547): n is a, c, g, or t
  misc_feature (581)..(581): n is a, c, g, or t
  misc_feature (606)..(606): n is a, c, g, or t
  misc_feature (615)..(615): n is a, c, g, or t
  misc_feature (649)..(649): n is a, c, g, or t
cccgcttcctccaaaccccaatcatcacttccctccaaatcccatttccctctcagcacccgcgactcgcgagatggacggcggcggcgcgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctncccaacatccactccgtcctcctccccaagaaggccgccgagagggctgagaaggccgccaccgctaccaagtcgcccaagaaggccgccgccaagtcgcccaagaagtagtantgccccgtctcgtcacatctgattctgatctcancttggctgagtggtcgtggatgccntttgctgtncttgcgtgtctgtgtgtatgtagtgatgcgtccnctcatgtgtcgtgtgtctcgatggatctagttctggttcaatctctaactgtagtggtggttggtgatgggatctccatgtaacctaagatttatgagaaacagaggaagtaccttgctttcctttggtttgc

SEQ ID NO: 3780 - DNA, 793 bp, Zea mays
gtcatcacaattcacagcgctcaagttctcgcgcccacagccaaatttttctccactcaatcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaagggccggtacgcgcagcgcgtgggcaccggcgcccccgtctatctcgccgccgtgcttgagtacctcgccgccgaggtgctggagctggccggcaacgcggcgaaggacaacaagaagacgcgcatcgtcccgcgccacgtgctcctggcgatccgcaacgacgttgagctcggcaagctgctggctggcgtcaccatcgcgcacggcggtgtcctccccaacatcaacccggttctcctgcccaagaaggtggcggagaaggcgtctagcggcggcagcaaggagagcaagtcccctaagaaggccgccaagtccccaaagaaggcagccaagtccccgaagaaggcttagaaattagtcactccactagcgctctgctgtagcatgttcgtgtttagatctgtggatgttatgtgttccggcctaatttcctctttgccttgtggcttctgatatgttcatcggcatgtttgccgtgttgtgtttccttgttctgattttgcaattcatcatcttgttgaatgaacttactatcgggaaatgaagcataataacgatgcaaaatgattgttctgaag

SEQ ID NO: 3781 - DNA, 660 bp, Avena sativa
gcgctaccacttctcatctcctccgccgcccgagtaaccagcagcagcaccaagtcatggacgtctcaagcacagcagctggagccaaggggaagaagggtgcggccgggcggaaggccggcggccccaggaagaagtctgtcactagatccgtcaaggccggcctccagttcccggtcggtcgcgtcggccggtacctgaaaaagggccgctacgcccagcgcgtcggcaccggcgcccccgtctacctcgccgcagtcctcgagtacctcggcgcggaggtgctagagctcgccggaaacgccgccaaggacaacaagaagagccgcatcatcccacgtcacctgctgctcgccgtcaggaacgacgaggagctcgggaagctgctcgccggcgtcaccaccgcccacggcggtgtgcttcccaagatcaacccggtgctgctgcccaagaagacggcggagaaggccgccaaggagcccaagtcgccgaagaagactgccaagtccccgaagaaggcctagatgaactcgtttcattgcctaggttgggtatctgggaacgatatgtgtgcctcagggtagaatgttaatgtctgtcctgtcctgtgttgttgtactaccttctgatctgtaatttaacggagtaatgaagttgctg

SEQ ID NO: 3782 - DNA, 725 bp, Hordeum vulgare
gctcgcaatcccaatcccaatcccaatctcccagtcccaaacctcttctctccggcgacccgacgagcgtcagcggctagccatggacgtctcggccaccggagcaggcgcgaaggcgaagaagggagccgcagggcgcaaggccggcggcccgaggaagaagtctgtgtcgaggtccgtcaaggccggcctccagttccccgtgggccgcatcgggcggtacctcaagaagggccgctacgcgcagcgcgtcggcacgggcgcccccgtgtacctcgcggccgtcctcgagtaccttgccgccgagctgttggagctcgccggcaacgccgccaaggacaacaagaagagccgcatcatcccgaggcacctgctgctcgcagtcaggaacgacgaggagctcgggaagctgctggccggcgtcaccatcgcgcacggcggcgtcgtgcccaagatcaacccggtgctgctccccaagcggacggcggagaaggcgcccaaggagggcaagtcgcccaagaaggccgccaagtcccccaagaaggcttagggaggcgcgccgatttgtgttagtatgttgtaataagctgttcgcctagcggcgtcgatgtagtatttgctgttaatggaaaaatcgttagaaatctctctgactttgttatattttgtactctgtcatctgttcatggtgctactatggaggatatttacatttgtgcggtagg

SEQ ID NO: 3783 - DNA, 736 bp, Hordeum vulgare
cggacgcgtgggctcgcaatcccaatcccaatcccaatctcccagtcccaaacctcttctctccggcgacccgacgagcgtcagcggctagccatggacgtctcggccaccggagcaggcgcgaaggcgaagaagggagccgcagggcgcaaggccggcggcccgaggaagaagtctgtgtcgaggtccgtcaaggccggcctccagttccccgtgggccgcatcgggcggtacctcaagaagggccgctacgcgcagcgcgtcggcacgggcgcccccgtgtacctcgcggccgtcctcgagtaccttgccgccgagctgttggagctcgccggcaacgccgccaaggacaacaagaagagccgcatcatcccgaggcacctgctgctcgcagtcaggaacgacgaggagctcgggaagctgctggccggcgtcaccatcgcgcacggcggcgtcgtgcccaagatcaacccggtgctgctccccaagcggacggcggagaaggcgcccaaggagggcaagtcgcccaagaaggccgccaagtcccccaagaaggcttagggaggcgcgccgatttgtgttagtatgttgtaataagctgttcgcctagcggcgtcgatgtagtatttgctgttaatggaaaaatcgttagaaatctctctgactttgttatattttgtactctgtcatctgttcatggtgctactatggaggatatttacatttgtgcggtagg

SEQ ID NO: 3784 - DNA, 758 bp, Manihot esculenta
ctataaaatcgttcgacaacacagcagcagtctattgattatttgctgtctttctcactgaagctagatcggcggtttcctctatcggtgttcataaacgggtcggatctttttggcagatggagtctggagggaaagtgaagaagggagccggaggaaggaaaggtgggggtccgaagaagaagcccgtttctaggtcggtcaaagccggcttgcagtttccggttgggagaatcgggcggtacttgaagaaaggaagatattcgcagcgtgttggaactggtgctccagtttacttggccgctgttctcgagtacctagctgctgaggtgctggaattggctggaaatgcagcaagagacaacaagaagaacagaataataccgcggcatgttttgcttgctgtgagaaatgatgaagagcttgggaaattgcttgcaggtgtgaccattgctcatggaggagtccttccaaatatcaaccctgttctgttgcccaaaaagagtgaaaaagctgcaaaggaaccaaagtctccctctaaggccaccaagtcccccaagaaggcttaagtgctttcttcctagctgaaagccaatttgggtgcctcaactcttctgctttggttgtatgtaattttgggttattttgttgtaggggaagtttgaaacattgtgtagtccctttgatcactgtaatactattttaggattgacatttttagattaatgcaatgaaacttcttgtttctgtttcttgga

SEQ ID NO: 3785 - DNA, 766 bp, Manihot esculenta
  misc_feature (5)..(7): n is a, c, g, or t
  misc_feature (10)..(11): n is a, c, g, or t
cagannnctnnctataaaatcgttcgacaacacagcagcagtctattgattatttgctgtctttctcactgaagctagatcggcggtttcctctatcggtgttcataaacgggtcggatctttttggcagatggagtctggagggaaagtgaagaagggagccggaggaaggaaaggtgggggtccgaagaagaagcccgtttctaggtcggtcaaagccggcctgcagtttccggttgggagaatcgggcggtacttgaagaaaggaagatattcgcagcgtgttggaactggtgctccagtttacttggccgctgttctcgagtacctagctgctgaggtgctggaattggctggaaatgcagcaagagacaacaagaagaacagaataataccgcggcatgttttgcttgctgtgagaaatgatgaagagcttgggaaattgcttgcaggtgtgaccattgctcatggaggagtccttccaaatatcaaccctgttctgttgcccaaaaagagtgaaaaagctgcaaaggaaccaaagtctccctctaaggccaccaagtcccccaagaaggcttaagtgctttcttcctagctgaaagccaatttgggtgcctcaactcttctgctttggttgtatgtaattttgggttattttgttgtaggggaagtttgaaacattgtgtagtccctttgatcactgtaatactattttaggattgacatttttagattaatgcaatgaaacttcttgtttctgtttctt

SEQ ID NO: 3786 - DNA, 606 bp, Liriodendron tulipifera
tatcggcgagattgagctcgagaaatcacgagaaagagatggagtcgaccggaaaggtgaagaaaggcgctggtggaaggaaaggaggcggtccgaagaagaagccggtctccagatcggtcaaggccggtctgcagttcccggtcggtaggatcggtcggtatttgaaaaagggccgatattctcagcgtgtcggaaccggtgcgccggtttatctcgcagctgttctggaatatctcgcagctgaggttcttgaattggctggaaatgccgcccgtgacaacaaaaagaacagaatcatcccaaggcatgtactgttagcagtgaggaatgatgaagagcttggaaagcttttgcatggtgtgacgattgctcatggaggagttcttcccaacatcaaccctgttcttcttccaaagaaaactgcagagaaggctgccaaagagccgaagtcccctaccaaggctgccaaatctccaaagaaggcttgatttgaatcccgtctcttcaagcctcttctgtctctctgcccttcttcctcttcttcttcttcttgtatgttactactgctgtgggtcccagtccagatggtttgatgtggggagg

SEQ ID NO: 3787 - DNA, 723 bp, Zea mays
actcatacatttcgactctcaactcccaaggtcccttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagactcgcatcatcccgcgccacgtgctcctcgccatccgcaacgacgaggagctcggcaagctgctggccggcgtcaccatcgcccacgggggcgtcctccccaacatccacactgtgctcctccccaagaaggggcccgagaaagcggccaaagagccccaaaaggccgctaagttcccccagaaagcgtaaagtgatctcctgtcttaaaaaatattacccttaacaatcctgcagtaagactagatcatgtttagggaagaacggcaaaggtttctggtccctgcagcccatctggaaacgggtaatttcaggaaattcgggggaccttttccttgctaaattggcaaaaaaagcgggccctaatcctttttggttaaaaaaaaaaaa

SEQ ID NO: 3788 - DNA, 808 bp, Prunus persica
  misc_feature (734)..(734): n is a, c, g, or t
gactgtccaaaaattttcaattctctctttgccatttctgattgggtttttttagccaaaagggtgtcagtggctttagtgggtctagggtttgagaattttcagagctgagagatggagactggtggtaaggtgaagaaaggtgctggtggaaggaaaggtgggggtccgaagaagaagccggtgacccggtccgtcaaggccggtctgcagtttccggtcggtcgtattggacggtacttgaagaagggaaggtatgctcagagagttgggtctggagctccggtttacttggccgcggttcttgagtacctcgcagctgaagtgcttgaattagctggaaatgcagctcgggacaacaagaagaacagaattatcccaaggcatctgttattggctgttaggaacgatgaagagcttgggaaattgctcgccggtgtgaccattgctcatggtggtgtgcttccaaacatcaacccagtcctcttgcccaagaaatcagagaaggctgccgccaaagagcctaaatctccatccaaggccaccaagtctcccaagaaagcttaagcttctctcaatgaatcccccaccacatgtttagttttaagaacccccacatgtttagttttaggttgggctcctctccatttgtatgtaatctgtgttcagatctttgtttttgttggttggtagtctaaaatgcttaatgaatttgaaagcatttgtaacctctncaatctatgtgatcatgaccaagttttaggaactttgtttttcttgggattcattaatgaaacctcttgtttct

SEQ ID NO: 3789 - DNA, 736 bp, Lotus japonicus
ccgtcaccgctcacaaattttcttatcctcctccgctacaatctagggttccggcaatggacaccaccacaggaaaggcaaagaaaggcgccggagggagaaagatcggcggcccaaagaagaagccagtttccagatccatcaaagccggtctccaattccccgtcggaagaatcggccgctacttgaagaaaggccgatacgctcagcgcgtgggaaccggcgctccggtgtacctcgccgctgttctggagtatctcgcggctgaggtgcttgaattggctggaaacgcggcgcgtgacaacaagaagaacaggattatcccgaggcatgtgctgcttgctgtgaggaacgatgaggagcttgggaagttgcttgctggtgtgactattgctcatggcggtgttcttccgaatattaaccctgtgcttctgccgaagaagactgctgagaaggttgccaaggagcctaagtctccggctaagaagggtgtgaaatcgcctaagaaagcttagatttggttttggttaatgtttttagttaattaattaaggtttcatttgtgtgtgtgtgtgtgtgtgtgtgtgtgtgtgtgtgtgtgtgtgtgtgtgtgtgtgtgtgtgtgtgtatattgctgtttaggtctttcttgtgtgatggaaagattaaatgggtttgggataatgtaattctgatctacctctaattgtatcacctgtagggagttttatgcatc

SEQ ID NO: 3790 - DNA, 595 bp, Lotus japonicus
caccgctcacaaattttcttatcctcctccgctacaatctagggttccggcaatggacaccaccacaggaaaggcaaagaaaggcgccggagggagaaagatcggcggcccaaagaagaagccagtttccagatccatcaaagccggtctccaattccccgtcggaagaatcggccgctacttgaagaaaggccgatacgctcagcgcgtgggaaccggcgctccggtgtacctcgccgctgttctggagtatctcgcggctgaggtgcttgaattggctggaaacgcggcgcgtgacaacaagaagaacaggattatcccgaggcatgtgctgcttgctgtgaggaacgatgaggagcttgggaagttgcttgctggtgtgactattgctcatggcggtgttcttccgaatattaaccctgtgcttctgccgaagaagactgctgagaaggttgccaaggagcctaagtctccggctaagaagggtgtgaaatcgcctaagaaagcttagatttggttttggttaatgtttttagttaattaattaaggtttcatttgtgtgtgtgtgtgtgtgtgtgtgtgtgtgtgtgtgtg

SEQ ID NO: 3791 - DNA, 681 bp, Elaeis guineensis
  misc_feature (680)..(680): n is a, c, g, or t
gatcggcgcgaaccgaatcgtttgaggcttcgaccaccgcgttagtgcgcaaaaccagaaaaagatcggaggatacgcgatggagagcgggggaggcaagatcaagaaaggagctggcggtcggaagggcggtggcccgaagaagaagcctgtctcccggtccgtcaaggccggtctccagttcccagtcggtcgcatcggccgctacctcaagaagggccgttacgcccagcgcgtcggaaccggcgctcccgtttatctcgccgctgttctcgagtaccttgctgctgaggttttggaattggctgggaacgccgcacgtgacaacaagaagaacaggatcatacctaggcacgtgcttctggccataaggaacgacgaggaactggggaagcttctggccggggtgaccattgcccatggaggggttcttccgaacattaacccggtgctcctgccgaagaagacggataaggccgggaaagaaaccaagtcgccagccaagtcgccgtccaaggccggcaagtctccaaagaaatcttagaagctttgttcgtcatgtaatttgtgggcctctttttctaaactctagaaacgagggatcgcaaaatggagaaaaaaaaaatctgtttccaatttcctctctgttatcttaatctgaaatgtttatgtttcttctna

SEQ ID NO: 3792 - DNA, 580 bp, Gerbera hybrid cultivar
ttcacttaatcacttgtctatacgtcgccggagacatggacggagccggaaaagcgaagaagggcgccggaggaaggaaaggaggcggtccaaggaagaaggcggttacacgttccgtcagagccggtctacagttccccgtcggtaggatcgggcgtttccttaagaaaggacgatatgctcagcgtgttggaaccggtgctccggtttacctggccgccgtcctcgaatacctagccgctgaagtgctagaattggccggaaatgcggctagggataacaagaagaacagaataatccctaggcatgttctattggccattaggaatgatgaagaacttggaaaattacttgccggtgttacaattgctcatggtggtgttcttccaaacattaatccaattttattaccgaagaaaacagctgctaaggagcctaaatccccgtctaaatccaccaagtctccaaagaaagcttgatcagatatctttcttagaattgtgttcttattgtggtagattgtagggccatatgcttgtatgttggggttgctttaattaatgaaaccgcttgtttctta

SEQ ID NO: 3793 - DNA, 812 bp, Citrus sinensis
ttctcacctagccccgtataagttttaccaccaacgcctcacattgcggtcacacagtcacactacatttcttttagtttccgtttgtttctcgagaaaattttgtttttgccatttttttctcccccctaacttcttcttgactttgctggtgtgatggagagtggaggaaaggtgaagagaggagcaggaggaaggaaagggggtggtccaaagaagaaaccggtctcccggtcggtgaaagccggtctgcagttcccggtcggtcggatcggtcgctatctgaagaagggacgctactctcagcgtgtgggaaccggcgctccggtctatcttgctgctgtacttgagtacctcgcagctgaggttcttgagttggctggtaatgcagcgagggacaacaagaagaataggatcatcccaaggcatgttctgttggctgtaagaaacgatgaggagcttgggaagcttcttgctggtgtgacaattgctcacggtggagtcttgccaaacatcaacccagttcttctgccgaaaaaatctgagaaggcagcaacgaaagagccgaagtctccagccaaggccactaagtccccaaagaaggcttagtttttagtcttctcatctttaactgtgtgtatgttacttctttgatgtattcggcttgtaggaaagcttcatgctcgtaggatttagggaccattctactgtttttaattgtccgtcactgtgtagaacttcttttgcttcgactgtagaatgaatgaaatcatggtacttgttccgatatttcatttgttgcagaaggtaat

SEQ ID NO: 3794 - DNA, 718 bp, Vigna unguiculata
ggataacaccgtgtcaacgcatcttcttcacaacacactcttaatctttctcgttcctctctccccacttatttttcaagcgcagctaatttctagggttccgacatggacaccggtggaaagattaagaagggtgccggcggaagaaagggtggcgggccaaagaagaagccagtcactagatccgtcagggctggtctccaattccctgtcggaagaattggccgttacttgaaaaagggaagatacgctcagcgtgtgggaaccggtgctcctgtttatctggctgctgttcttgaatacctagctgctgaggtgcttgaattggctggaaatgctgctcgtgacaacaagaagaataggattattcctagacatgtgcttctggccgtgaggaacgatgaggaattggggaaattgcttgctggagtcacaattgctcacggtggtgtgctacctaacattaaccctgttttgttgcctaagaagaccgagaaggcttccaaggaacccaaatctccatccaaggccaccaagtctcccaagaaggcttagactacattttaatttagttttgtatatcagtctttagggtactctggttgtatcaagaaaggattttttcctttgaaacactaaagtgtggtttagttgtgtacttgttgaagtttgttcattaattgaaaaccatcttgttttcgcccaagtttctcccatg

SEQ ID NO: 3795 - DNA, 782 bp, Vigna unguiculata
ctctctcatatcttgctccctctttcaatttttaagcgcatctaatttctagggttccgacatggacgccggtggaaagatcaagaagggtgccggtggaagaaagggtggtgggccaaagaagaagccggtcaccaggtccgtgagggcgggtctccaattccctgtcggaagaattggtcgttacttgaaaaagggaagatacgctcagcgtgtgggaactggtgctcctgtttatcttgctgctgttcttgaatacctagctgctgaggtgcttgaattggctggaaatgctgcccgtgacaacaagaagaacaggattattcccagacatgtgcttcttgccgtgaggaacgacgaggaattggggaaattgctcgccggagtcacaattgctcacggtggtgtgttgcccaacattaaccctgttttgttgcctaagaagactgagaaagcttctaaggaacccaagtctccttccaaagctaccaagtctcccaaaaaggcttagaccatgttttaatttagttatgtatatcggtgtttagggttctttggttgtgacaagaagggaatttgatgttttagctataagtttcgtcttattgtgtttgtgaattttgttcattaatgtgaaaaccctcttgttttcgcccaattatgttctatgtccactcctttttcaatctttgtgtgctttatcgatttgttacacagaaatgaattccaagtttaatatgttggtaaataagtaaattttgtaaatgctaatttcgtggcgc

SEQ ID NO: 3796 - DNA, 751 bp, Medicago truncatula
atccaacgctcagaatctccttcaatctagtatataatcattccaacgatttttcatctattctcacttcatcgcaattcaaaatcttccatttcccactttcacaccaaattcacagcaacaaatctagggttcgaaaatggacgcaagcacaaaggcaacgaagaaaggagcaggaggaagaaaaggcggaggaccaaggaagaagtcggtaacaagatcaatcagagccggacttcaattcccagtgggaagaatcggccgttacttgaagaaaggtcgatatgctcaacgtgtcggcaccggtgctcctgtttacttagccgctgttcttgaatatcttgctgctgaagttcttgaattggctggtaatgctgctcgtgataacaagaagaataggattattccaaggcatgtgttgttggctgtgaggaatgatgaagagcttgggaaattgcttgctggtgttaccattgctcatggtggtgttcttcctaatattaaccctgttcttttacctaagaaaagtgaaaaacctgttaaggagcctaaatctccttctaaggctaaaaagtctcctaagaaggcttagattaggtttctgtgatctagggaatcagatttaatgatttgaatgaatgtgataattgatgactaaacgatttgattttaaaaccgaatgatccttttaaccacggtagacggttcaaagagagcagttgacaacgtctgctccaattttggtttagtt

SEQ ID NO: 3797 - DNA, 717 bp, Glycine max
tcatccaactctctaaacaacacattaacctttctcattccccatctcctcaccttattcagccactgctaatttctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgcacatggtggtgtgcttccaaacattaaccctgttttgttgcctaagaagacggagagggctgccaaggagcctaagtctccatccaaggctactaaatctcctaagaaggcctagattatcctttttttttttttttttttaaatctagtgttgtatatcggtgcttagatgcttttggtgtaacaggaaatttgatgtgtttcttaaacattgtaattcttgtcccattgtgttgcttgtaggagtgagtttgctttattaatgaaaagtggaaacctcttgttttcaatcta

SEQ ID NO: 3798 - DNA, 682 bp, Artemisia annua
tcaacgcagtactccgacgggacacacactcatttcaccttcaaaaacgcacacacataacaaaaatcaaatcaaaaaatggacgcttcaaaaaccaagaagggagccggtggacgtaagggaggcggtccaaggaagaagtcggtcacccggtctgtgaaagccggtcttcagtttccggtcgggagaattggaaggtatttgaagaatggaaggtatgctaagagggttgggactggtgctccggtttatcttgctgctgtccttgagtaccttgctgctgaagttttggaattggctggaaacgccgcaagggacaacaagaaaacccgaatcatcccaaggcacgttctattggcaatcaggaacgatgacgagcttggaaagttgttatctggagtgacaattgcacacggaggagtgcttcccaacattaacccagtcttgttgccaaagaagaccgcagcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgtttgtttaggttgttatggtttatgtgttgttgatcgttggttattaatgaagaaacttcttgtttcagta

SEQ ID NO: 3799 - DNA, 714 bp, Artemisia annua
gcagtggtatcaatgcagtactccgacgggaacagggtcaacgcagtactccgacggggacacacaatcatttcaccttaaaaaacacacacataacaaaaatcaaatcaaaaagatggacgcttcaaaaaccaagaagggagccggtggacgtaagggaggcggtccaaggaagaagtcggtcacccggtccgtgaaagccggtcttcagtttccggtcgggagaattggaaggtatttgaagaatgggaggtatgctaagagggttggtactggtgctccggtttatcttgctgctgtccttgagtaccttgccgctgaagttttggaattggcaggaaacgcagcaagggacaacaagaagacccgaatcatcccaaggcacgttctattggcaatcaggaacgatgatgagcttggaaagttgttatctggagtgacaattgcacacggaggagtgcttcccaacattaacccagtcttgttgccaaagaagactgccgcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgtttgtttaggttgttatggttatgtgttgttgatcgttggttattaatgaagaaacttcttgtttc

SEQ ID NO: 3800 - DNA, 672 bp, Artemisia annua
aacgcagtactccgagggggacacacactcatttcaccttcaaaaacacacacataacaaaaatcaaatcaaaaaaatggacgcttcaaaaaccaagaagggagccggtggacgtaagggaggcggtccaaggaagaagtcggtgacccggtctgtgaaagccggtctccagtttccggtcgggagaattggaaggtatttgaagaatggaaggtatgctaagagggttgggactggtgctccggtttatcttgctgctgtccttgaataccttgctgctgaagttttggaattggctggaaacgcagcaagggacaacaagaagacccgaatcatcccaaggcacgttctattggccatcaggaacgatgacgagcttggaaagttgttatctggagtgacaattgcacacggaggagtgcttcccaacattaacccagtcttgttgccaaagaagaccgccgctaaggagcctaagtcaccaagtaaaggaaagtctccaaagaaggctgctgccactgctgctgagtagattgggtagtgtttgggttgtgggtgttgctgggttgtttgtaatttgtagttaatgaatgattatgtggtcagttgtttgtttaggttgttatggttatgtgttgttgatcgttggttattaatgaagaaacctcttgt

SEQ ID NO: 3801 - DNA, 678 bp, Artemisia annua
caacgcagtactccgacggggacacacactcatttcaccttcaaaaacacacacataacaaaaatcaaatcaaaaaaatggacgcttcaaaaaccaagaagggagccggtggacgtaagggaggcggtccaaggaagaagtcggtgacccggtctgtgaaagccgggcttcagtttccggtcgggagaattggaaggtatttgaagaatggaaggtatgctaagagggttgggactggtgctccggtttatcttgctgctgtccttgagtaccttgctgctgaagttttggaattggctggaaacgcagcaagggacaacaagaagaccaggatcatcccaaggcacgttctattggcaatcaggaacgatgatgagcttggaaagttgttatctggagtgacaattgcacacggaggagtgcttcccaacattaacccagtcttgttgccaaagaagactgcagcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgttttgtttaggttgttatggttatgtgttgttgatcgttggttattaatgaagaaacttcttgtttca

SEQ ID NO: 3802 - DNA, 653 bp, Artemisia annua
aaaacacacacataacaaaaatcaaatctaaaaaatggacgcttcaaaaaccaagaagggagccggtggacgtaagggaggcggtccaaggaagaagtcggtgacccggtctgtgaaagccgggcttcagtttccggtcgggagaattggtaggtatttgaagaatgggaggtatgctaagagggttgggactggtgctccggtttatcttgctgctgtccttgagtaccttgctgctgaagttttggaattggcaggaaacgcagcaagggacaacaagaagacccgaatcatcccacgacacgttctgttggccatcaggaacgatgacgagcttggaaagttgctatctggagtgacaattgcacacggaggagtgcttcccaacattaacccagtcttgttgccaaagaagaccgccgcaaaggagcctaagtcaccaagtaaaggaaagtctcctaagaaagctgctgccactgctgctgagtagattgggtagtgtttgggttgtgggtgttgctgggttgtttgtaatttgtagttaatgaatgattatgtggtcagttgtttgtttaggttgttatggtttatgtgttgttgatcgttggttattaatgaagaaacttcttgtttcagtaaaaaaaaaaaaaaaa

SEQ ID NO: 3803 - DNA, 834 bp, Artemisia annua
aacagtggtatcaacgcagtactccgacggggacacacactcatttcaccttcaaaaacacacacataacaaaaatcaaatcaaaaaatggacgcttcaaaaactaagaagggagccggtggacgtaagggaggcggtccaaggaagaagtcggtgacccggtctgtgaaagccgggcttcagtttccggtcgggagaattgggaggtatttgaagaatggaaggtatgctaagagggttgggactggtgctccggtttatcttgctgctgtccttgagtaccttgctgctgaagttttggaattggctggaaacgcagcaagggacaacaagaagaccaggatcatcccaaggcacgttctattggcaatcaggaatgatgatgagcttggaaagttgttatctggagtgacaattgcacacggaggagtgcttcccaacattaacccagtcttgttgccaaagaagaccgctgcaaaggagcccaagtcaccaagtaaaggaaagtctcctaagaaggctgctgccactgctgctgagtagattgggtagtgtttgggttgtgggtgttctgggtttgtaatttgtagttaatgaatgattatgtggtcagttgtttgtttaggttgttatggttatgtgttgttgatcgttggttattaatgaagaaacttcttgtttcagtatcttcttttgttattcaattcatttgaagtttgcttatttgatctatttctgatttctaaaccattgtgcttgtgtgaggtggttttgatacatctgtaaagtgaataaattttatccagtgtttattttaattcaaatgtcgagcgt

SEQ ID NO: 3804 - DNA, 706 bp, Artemisia annua
acacacactcatttcaccttcaaaaacacacacataacaaaaatcaaatcaaaaaaaatggacgcttcaaaaaccaagaagggagccggaggtcgtaagggaggcggtccaaggaagaagtcggtcacccggtccgtgaaagccgggcttcagtttccggtcgggagaattggaaggtatttgaagaatgggaggtatgctaagagggttggtactggtgctccggtttatcttgctgctgtccttgagtatcttgctgctgaagttttggaattggctggaaacgcagcaagggacaacaagaagacccgaatcatcccaaggcacgttctattggcaatcaggaacgatgacgagcttggaaagttgctatctggagtgacaattgcacacggaggagtgcttcccaacattaacccagtcttgttgccaaagaagaccgctgcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgtttgtttaggttgttatggtttatgtgttgttgatcgttggttattaatgaagaaacttcttgtttcagtatcttcttttgttattcaatttacgtgaactatgcttatttgatct

SEQ ID NO: 3805 - DNA, 740 bp, Artemisia annua
acgagtgcgtgtggtatcaacgcagtactccgacggggacacacactcatttcaccttcaaaaacacacacataacaaaaatcaaatcaaaaaatggacgcttcaaaaaccaagaagggagccggaggtcgtaagggaggcggtccaaggaagaagtcggtgacccggtctgtgaaagccgggcttcagtttccggtcgggagaattggaaggtatttgaagaatggaaggtatgctaagagggttgggactggtgctccggtttatcttgctgctgtccttgagtaccttgctgctgaagttttggaattagccggaaacgcagcaagggacaacaagaagaccaggatcatcccaaggcacgttctattggcaatcaggaacgatgacgagcttggaaagttgttatctggagtgacaattgcacacggaggagtgcttcccaacattaacccagtcttgttgccaaagaagaccgccgcaaaggagcccaagtcaccaagtaaaggaaagtctccaaagaaggctgctgccactgctgctgagtagattgggtagtgtttgggttgtgggtgttgctgggttgtttgtaatttgtagttaatgaatgattatgtggtcagttgtttgtttaggttgttatggttatgtgttgttgatcgttggttattaatgaagaaacttcttgtttcagtaaaaaaaaaaaaaaaaaacatgtcggatctagaatacgcactcgt

SEQ ID NO: 3806 - DNA, 661 bp, Artemisia annua
cacacacactcatttcaccttcaaaaacacacacataacaaaaatcaaatcaaaaaatggacgcttcaaaaaccaagaagggagccggtggacgtaagggcggcggtccaaggaagaagtcggtcacccggtctgtgaaagccgggctccagtttccggtcgggagaattggaaggtatttgaagaatggaaggtatgctaagagggttgggactggtgctccggtttatcttgctgctgtccttgagtaccttgctgctgaagttttggaattagccggaaatgcagcaagggacaacaagaagacccgaatcatcccaaggcacgttctattggcaatcaggaacgatgacgagcttggaaagttgttatctggagtgacaattgcacacggaggagtgcttcccaacattaacccagtcttgttgccaaagaagactgccgcaaaggagcctaagtcaccaagtaaaggaaagtctccaaagaaggccgccgccaccgctgctgagtagattgggtagtgtttgggttgtgggtgttgctgggttgtttgtaatttgtagttaatgaatgattatgtggtcagttgtttgtttaggttgttttatggtaatgtgttgttgatcgttggttattaatgaagaaacttcttgtttcagta

SEQ ID NO: 3807 - DNA, 738 bp, Lotus japonicus
accaaacacattttcattttccctctcttcattccttcgccctcttcaatcgtcccgcgcaagcttctctgagaatctagggtttcggcaatggactccaccgccacaggaaaggtcaagaagggcgccgccggaaggaaagccggaggccccaagaagaagtcagtttccagatcggtgaaggccggtctccaattccccgtcggaagaatcggacgctacctgaagaagggaaggtacgctcagcgtgttggatctggtgctcctgtgtaccttgctgctgttcttgagtatctcgctgctgaggtgcttgagttggctggaaatgctgctcgtgacaacaagaagaacaggattatcccgaggcacgttcttcttgctgtgaggaacgatgaggagcttgggaaattgcttgctggtgtgaccattgctcatggtggtgttcttcccaacatcaaccctgtgcttctgcctaagaagactgctgagaaagctcctaaggaacctaagtctccagcgaagaaggctgcaaaatctcccaagaaagctgctgcttaggttgaattagggtagataatattgggttaaatttcagttttagcttattaccccttttgtttcttctgtatatcgatggttagaagaaaaaaaaatgatcgatgcttttggtttattgtatcacagtgttgctttaaccagtttcactcatcaatgaaaccatcttgttttttggttata

SEQ ID NO: 3808 - DNA, 715 bp, Lotus japonicus
tccctctcttcattccttcgccctcttcaatcgtcccgcgcaagcttctctgagaatctagggtttcggcaatggactccaccgccacaggaaaggtcaagaagggcgccgccggaaggaaagccggaggccccaagaagaagtcagtttccagatcggtgaaggccggtctccaattccccgtcggaagaatcggacgctacctgaagaagggaaggtacgctcagcgtgttggatctggtgctcctgtgtaccttgctgctgttcttgagtatctcgctgctgaggtgcttgagttggctggaaatgctgctcgtgacaacaagaagaacaggattatcccgaggcacgttcttcttgctgtgaggaacgatgaggagcttgggaaattgcttgctggtgtgaccattgctcatggtggtgttcttcccaacatcaaccctgtgcttctgcctaagaagactgctgagaaagctcctaaggaacctaagtctccagcgaagaaggctgcaaaatctcccaagaaagctgctgcttaggttgaattagggtagataatattgggttaaatttcagttttagcttattaccccttttgtttcttctgtatatcgatggttagaagaaaaaaaaatgatcgatgcttttggtttattgtatcacagtgttgctttaaccagtttcactcatcatgaaaccatcttgttttttggtt

SEQ ID NO: 3809 - DNA, 744 bp, Zea mays
tccctccaaatcccattccctccgcccagaccagctcgcgaaatggacggcggcggcgcgaaggcgaagaaggcggctgctgggcgaaagctaggcggcggcgggccgaagaagaagccggtgtcgcggtcagttaaggccgggctccagttccccgtgggccgcatcggacggtacctgaagaaagggcggtacgcgcagcgcgtgggcacgggcgctcccgtgttcctggccgccgtcctcgagtacctcgccgctgaggtcctggagctggctggcaacgcggcgcgcgacaacaagaagacccgcatcatcccgcgccacctcctcctcgccatccgcaacgacgaggagctcggcaagctgctgggtggggtcaccatcgcgcacggcggtgtgctgcccaacattaaccccgtcctcctccccaagaaggccgccgagagggccgagaaggccgctgccgctggccccaagtcccccaagaaggccgccgccaagtcgcctaagaagtagtgactcgtcttgctctcactcatcccgttctgagatcagcttgtgtttgtggtcgtggacgccttttaccattttgcaagtgtgtgtagcgatgcgtcgtctgaactataatgtgctacgattgacctaagttctagtttaattcctagctctagtggtgcttggtgatgggtccccatggaagtttaatgggaacaagaggaagtgtcttgctttctttgatgctta

SEQ ID NO: 3810 - DNA, 746 bp, Saccharum officinarum
ccgcttcctccaaaccccaatcatcacttccctccaaatcccatttccctctcagcacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacttggccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctccccaacatccactccgtcctcctccccaagaaggccgccgagagggctgagaaggccgccaccgctaccaagtcgcccaagaaggccgccgccgccaagtcggccaagaagtagtgtgcctgcctcgtctcatctgatcctgatctcagcttggctgagtggtcgtggatgccttttgctgttcttgcgtgtctgtgtgtatgtagtgatgcgtcgcctcatgtgtcgtgtgtctcgatcgatctagttctggttcaatctctagctgtagtggtggttggtcatgggatctccatgttacctaagatttaatg

SEQ ID NO: 3811 - DNA, 778 bp, Saccharum officinarum
ccgcttcctccaaaccccaatcatcacttccttccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctggccgccgtcctcgagtacctcgccgccgaggtcctggagctggcgggaaacgcggcgcgcgacaacaagaagaaccgcatcatcccgcgtcacgtcctcctcgccatccgcaacgacgaggagctcggcaagctgctggcgggcgtcaccatcgcgcacggcggcgtgctccccaacatccactccgtcctcctccccaagaaggccgccgagagggctgagaaggccgccaccgctaccaagtcgcccaagaaggccgccgccgccaagtcggccaagaagtagcgtgcctgcctcgtctcatctgatcctgatctcagcttggctgagtggtcgtggatgccttttgctgttcttgcgtgtctgtgtgtatgtagtgatgcgtcgcctcatgtgtcgtgtgtctcgatcgatctagttctggttcaatctctaactgtagtggtggttggtcattggatcttcatgttacttaaaattaatgaaacaagaagaagtgccttgctttcttttggtt

SEQ ID NO: 3812 - DNA, 767 bp, Euphorbia esula
  misc_feature (16)..(16): n is a, c, g, or t
  misc_feature (22)..(23): n is a, c, g, or t
cacttatcctatttcntaatcnnttgtttgtttcccgagaaaaagtgagaaaaattcactcttcctaatttttcatcatcttaacgcgttgagatatggataccggagctaagttgaagaaaggagccggagaaagaaagggaggcggtcctaagaagaagccagtctcaaggtccgtcaaagccggtcttcagtttccggtaggtcggatcggtcgattcctgaagaaaggccggtatgctcagcgtgttggaagcggagctccggtgtacttggccgccgtgctcgagtatcttgccgctgaggtattggagctagctggaaatgcagcaagagataacaagaagaacagaatcataccaaggcatgtgctattggctgtaaggaacgatgaagaactaggaaagctattagctggagtgaccatagctcatggtggagttttaccaaacataaacccagttcttttgcctaagaaagctgaaaaggcagcagcagcagcagagcaaccaaggagcccaaatcaccagccaaggctactaaatcacctaagaaggcttagatctatcatttttaggcatcttgatatcagtccatcgctgtatctaaattgtttttttttttaaaatgtaatttggattgtaggacaaagtaatgtgcctttgagcatagtagaatcgtttgtgctctctcttaactcaaatgtagaagattttcttctttgtttctgattaagtaaagtaattgttatgctgcaaatttttttg

SEQ ID NO: 3813 - DNA, 668 bp, Ricinus communis
aaacgggtcggatcttattggagaaatggagtcaggagggaaagtgaaaaagggagcgggaggaaggaaaggtgggggtccgaagaagaaaccggtaactcggtcagtgagagccggtcttcagtttccagttggaagaattgggaggtacttgaagaagggaagatatgcacagcgggttggtactggtgctcctgtttacatggctgctgttcttgagtacttagctgctgaagtattggagttggcagggaatgcagcaagagacaacaagaagaacaggataataccaagacatgtattgcttgctgtgagaaacgatgaggaacttggaaaattgctagccggtgttaccattgctcatggaggagtcttgcctaatattaatcctgttctcttgcctaaaaagactgagaaagctaccaaagaacccaccaagtctccctccaaggctaccaagtcaccaaagaaggcttaaaaagtttgtctcaccatagaaagctcaagaagcttctcctgttgtatgtaattttgggtttcatggttgatcttattttgttgatgatgtgtaggcgaactttaattttttttttttttaaagtatgtagtactactgctagaatgtggcatctcagattaatagatgaaactacatgtttctgcttttc

SEQ ID NO: 3814 - DNA, 855 bp, Ricinus communis
attataaaaccagttcataacccgattcctacaccgctatgcgctatcaagaattattattttttataatttgtgattttctattttgtgtattttaaacgggtcggatcttattggagaaatggagtcaggagggaaagtgaaaaagggagcgggaggaaggaaaggtgggggtccgaagaagaaaccggtaactcggtcagtgagagccggtcttcagtttccagttggaagaattgggaggtacttgaagaagggaagatatgcacagcgggttggtactggtgctcctgtttacatggctgctgttcttgagtacttagctgctgaagtattggagttggcagggaatgcagcaagagacaacaagaagaacaggataataccaagacatgtattgcttgctgtgagaaacgatgaggaacttggaaaattgctagccggtgttaccattgctcatggaggagtcttgcctaatattaatcctgttctcttgcctaaaaagactgagaaagctaccaaagaacccaccaagtctccctccaaggctaccaagtcaccaaagaaggcttaaaaagtttgtctcaccatagaaagctcaagaagcttctcctgttgtatgtaattttgggtttcatggttgatcttattttgttgatgatgtgtaggcgaactttaattttttttttttttaaagtatgtagtactactgctagaatgtggcatctcagattaatagatgaaactacatgtttctgcttttcattttttcttttgcaactccttcaatcatcattttactgttttggcgattggtggttgcatgatgctagttaattgttaattcatgaaatg

SEQ ID NO: 3815 - DNA, 682 bp, Cynara scolymus
cggggacatcattctctcaacaatccatcactcatttctgtagagcttttgagaaattcagagagatggagggaaccggaaaagtgaagaagggcgccggaggaaggaaaggcggtggtccgaggaagaagtcggtgacgcgttcagtaaaagctggtttacagttccccgtcggtaggattggccgttacctgaagaaaggacgttatgctcagcgagttggaaccggtgctccggtttatcttgccgccgttctcgaataccttgccgcagaagtgctggaattagctggaaatgctgctagagacaacaagaagaatagaatcatcccaagacacgtactgttagccataaggaacgatgaggagcttggaaaattgttggcaggagtaacaattgcacatggtggtgttcttccaaacattaaccctattctattgcccaagaaaactgctaccaaggaacctaaatctccatccaaagccgctaaatctccaaagaaaactgcctagatgaatctgattagactattctccttttgtatctgtaattttaagcatctgtttcttacaacccttcatgtttgttgattgggtagtttgagataagagttgcagaatagtttatatcatcagagaatattgaatttgaatgaatgaaaccacttgtttctttttttttg

SEQ ID NO: 3816 - DNA, 752 bp, Zea mays
tcatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggcggtgtcctccccaacatcaacccggttctcctgcccaagaaggtggcggagaaggcgtccagcggcggcagcaaggagagcaagtcccctaagaaggccgccaagtccccaaagaaggcagccaagtccccgaagaaggcttagaaattagtcacttcactagcgctctgctgtagcatgttcgtgtttagatctgtggaacttatgtgttccagcctaatttcctctttgccttgtggctcctgatatgttcactggcatgtttgccgtgttgtgttccttgttctgattttgcaattcatcatcttgttgaatta

SEQ ID NO: 3817 - DNA, 681 bp, Allium cepa
  misc_feature (10)..(10): n is a, c, g, or t
  misc_feature (26)..(26): n is a, c, g, or t
  misc_feature (31)..(31): n is a, c, g, or t
  misc_feature (44)..(44): n is a, c, g, or t
  misc_feature (59)..(59): n is a, c, g, or t
  misc_feature (66)..(66): n is a, c, g, or t
  misc_feature (138)..(138): n is a, c, g, or t
aagaaagaanccctagttttaatttnagatnccaatttcgaagngatggataccggcancaaagcnaagaagggagctggaggcagaaaggggccaagtggacccaggaagaagtccgtcacgagatcagttaaagcnggtcttcaattccccgtcggtcgtatcggccgatacttgaaaaagggacgatacgctcagcgtgtcggtaccggagctccagtttatcttgccgccgttcttgaatatctcgcagcagaggtattagagctggctggaaatgcagcgaaagacaacaagaagaatcgaatcattccaagacatgttcttcttgcaataaggaatgacgaggagttgggaaaattgcttggtggggtgactatagctcatggtggagtattgccgaacatcaaccctgtgcttttgcctaagaaaactgctgccaaggaatccgagactccaaaatcacccaaaaaaactgctgcaaaatcccctaagaaggttgctgcaaaaacaccaaaaaaggttgctgcttaagagattttgttggcatatgcagtacgttgtttttctaatgggtgttggtagtttaaagttttcctggaatttaaatgttaattgggaccccttacgtggtttagttggggtttcctcgaattttaatttcaacctagttttattgtc

SEQ ID NO: 3818 - DNA, 658 bp, Saccharum officinarum
gcattcctccaatctgcagagcccttctcctcgaagaagccactcgaagcgcagctgcggccatggactccaccggcgccggagcgggagggaaggtgaagaagggagcgggcgggcgcaaggcaggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgccgctgaggttctggagctcgccgggaacgcagccagggacaacaagaagacgcgcatcatcccccgccacgtgctgcttgcgatccgcaacgacgaggagcttgggaagctgctggccggcgtgaccattcgccacggtggcgtgctggccaacattcactcagttcttgtgcccaagaagaccgcagaaaaggcgttcaacaatgagcccaagtctgcccaaaaggcttccaagttccccaagaaggcatttagtgttgaaggattattttgatgtttaaccgttgtactaccttgtgattgttaaggttgtagattcgaatgggatgtgcttgggagattaaaccggtccttgttaacaagtttatgttttgattt

SEQ ID NO: 3819 - DNA, 701 bp, Cichorium intybus
gcggggacatcactttgttactagcaaaaattcaattgtatacatacccataaagagaaatggataccaccggaaaagcgaagaagggtgccggaggaaggaagggtggtggcccaggaagaagtcggtgactcgatccgtcaaagctggtctgcagtttcccgttggtaggattgggcgttaccttaaggccggacgatatgctaaacgtgttggaaccggtgcaccggtctacctcgccgctgttctcgaataccttgctgctgaagttttggagttagctggaaatgctgctagggacaacaagaagagcagaattatcccaagacatgttctattggcaattaggaatgacgatgaactaggaaaattgttgggtggtgttacaattgcacacggtggtgttcttcctaacatcaaccctgttctattgccaaagaagtcggcaacaacagagcccaaatcaccatcaaaagctgctaaatcaccaaagaaagctgccaaatctccaaagaagacttaatagactactgtagtttggatgttgttggtctgtgtgtgtatttgtcgttaaattgcatatggagttagttttctaacaatttcgttcgtttagatgatctatcatatgttctcacctctgttcatcaatggaagaaaccacttgtttctattttattttttgaaagctaactccaaat

SEQ ID NO: 3820 - DNA, 544 bp, Gerbera hybrid cultivar
tatttattcacctgtgcaaatcgccgaaaaaagatggacggagccggaaaagtgaagaagggcgccggaggaaggaaaggcggtccaaggaagaaggcggttactcgctcagtcagggccggtctacagtttccggtcggtaggatcgggcgtttccttaagaaaggacgttatgctcaacgtgttggaaccggtgctccggtttacctagccgccgttctcgaataccttgccgccgaagtgcttgaattagctggaaacgctgctagggacaacaagaagaacaggataatccctagacatgtcttgttagccattaggaacgatgaagaacttggaaaattactagctggagtaacgattgctcatggtggtgttcttccaaacattaaccctattctcttgcccaagaagacagctgctaaagaaccaaaatcgccttcaaaatctgccaaatctcctaagaaagcttgattagggtatcttgttatattgcattgtttttgggttagtttatatggtgatttgttagcttgtttatggt

SEQ ID NO: 3821 - DNA, 904 bp, Malus domestica
caattctttctctccatttccgatttggataattgagtcaaaagggtctcagattctcagtgatttagggttgagatatggagactggtggtaagttgaagaaaggtgccgggggaaggaagggcggtggtccgaagaagaaggcggtgacccggtccgtcagagccggcctccagttcccagtcggaagaatcggtcgctacttgaagaaggggaggtatgctcagagagtcgggtctggagctccggtttacttagccgctgtgctcgagtacctcgcagctgaagtgctggaattggctggaaatgcagctcgggacaacaagaagaacaggattatcccaaggcatctgctactggctgtgaggaacgatgaggagcttggaaaattgcttgctggtgtgaccattgctcacggcggcgtgcttccaaacattaacccagtcctcctgcccaagaaatcagaaaaggccgccggaaaagagccaaaatcgccatcgaaggctaccaagtctcccaagaaggcttaggtttctccatcaaatcaacccaccaaatgtttagctttttatgaatcaaacctccatgtttagatttagttcgtgaccctccccatttgtatgtaatctgtatgcaggtctatgtctttgttggttgtagggaaaagagataccaagacttgaaattccaataatcttatgtgatgatgatgttcaagttttaggtttattgatcttgttggaatccatttatgaaaccccttgtttctggcattacttccgtttggtatgtgtgtatgatgagatgtgagattctcttattccctttgatttgaggtgctatttgttgatgggttgctttatcgaatgcttttgaagaaaggaacctcctttttccttttctc

SEQ ID NO: 3822 - DNA, 872 bp, Malus domestica
ctataaagcacatcctctaactgattcccaaatccactgtctgaacattggcaattctttctctccgtttccgatttgggtttttgagtcagaagggtgtctcaggttctcagtgaattttagtgcggttagggtttgagatatggagaccggtggtaagttgaagaaaggtgccggaggaaggaagggcggcggtccgaagaagaaggcggtgacccggtccgtcagggccggcctccagttcccagtcggaagaatcggccgctacttgaagaagggacggtatgcgcaaagagtcgggtctggagctccggtttacttagccgctgtgctcgagtacctcgcagctgaagtcctggagttggctggaaatgcagctcgggacaacaagaagaacaggattatcccaaggcatctgctactggctgtgaggaacgatgaggagcttggaaaattgcttgctggtgtgaccattgctcacggcggtgtgcttccaaacatcaacccggtcctcctgcccaagaaatcagagaaagccgccggaaaggagccaaaatctccaaccaaggcaaccaagtctccaaagaaggcttaggttctctcagtgaatcaatcccagcaaatgtttagtcaaatccccacatgtttagatttagtttgtgacccctcctcatttgtatgtagtctgtatgcagcaggtctttgtctttcgttggttgtaggaaaaaagagaaatcgagacttgaacttccattgaatttgaaagcagttgtaatccttcaaaatcttgtgtgatcttgtcatgttttaggagctttgattttcttggaattccatttatgaaattgaaaccccttgtttcaaaaaaaaaa

SEQ ID NO: 3823 - DNA, 1213 bp, Beta vulgaris
aaaaactccattgttgttttagagagagaaagcttgaaaataatggattcaactgctggaggaaaggcaaagaaaggagcaggaggaaggaaaggtggaggtccaaagaagaagccagtttctcgttcagttaaagctggattacaatttccagttggaagaattggaagatacttgaagaaaggtcgttatgctcaacgtgttggtactggtgctcctgtttatttggctgctgttcttgagtaccttgctgctgaggtattagagttggctggaaatgctgcaagagacaacaagaagaacagaatcatcccaagacatgttctccttgctgtgaggaacgacgacgagctcggaaagcttctttcaggagtgacaattgcacatggaggtgttcttccgaacataaacccggtgttgttgccgaagaaggctggaggagataaggctactaaggagccaaaatctccttcaaaggctactaaatctccaaagaaggcttagaaagttattgatttggtttcgaggtaggaagaattgggagttgttcttgagttattgcgttgtgtatgtaatgtcaagtagtttaattagggttttcgaaaagaatagggatttagtatattgtaatggaggttgtagttggaaggttttatggaaattgagtcaatagctgattgattcagtttctgttatgatataaatgaaaatcatttatttttcctccaaaaaaaaaaaaaaaactcagggggggcccggataccaattcccccatgggaatcgattaaaattcctgggcgcgtttcacacttcagaatgggaaaacctggcgttcccactttaacgcattgcccattcccccttccccagtggggaatataaaaggccgacaatccccttcaaattggcccccttaggcaaaggaaattaacctaaatttgaaaatcccgaaattttttaaacctcttttaacaaagcaatcggaatcttttataaaaattccaaaggtgaagttttccttgaaaccccttaaacggatcccctaggcaaacttaaggggagccaggacccccaaatttggggggccaacaaagcccaggccattcttggaacttattgaaaaaaaaaggccggggatatccaaaccccttgctggggggtttaggccttttttatccacaaataaaaaaaatttttgttccccaaaaggcgc

SEQ ID NO: 3824 - DNA, 751 bp, Manihot esculenta
ggtgattctttaatcattgttcttaaacgggtcagatctttatcggcagatggagactggaggaaaagtgaagaagggagccggagggaggaaaggcggaggtccgaagaagaagcccgtttctaggtcggtcaaagcaggtctgcagtttcccgttgggagaatcggccggtacttgaagaaagggagatattcacagcgtgtaggaactggtgctccggtttacttggccgctgttctcgagtacctagcagctgaggtgctggaattggctggaaatgcagcaagagacaacaagaagaacagaataataccaaggcatgttttgcttgctgtgagaaatgatgaagagcttggaaagttgcttgctggtgtgaccattgctcatggaggtgtccttccaaatatcaaccctgttctgttgcccaaaaagagtgataaagctgcaaaggaaccaaagtctccctctaaggccaccaagtcccccaagaaggcttaagcctttatacctcactcaaagccaatctgggtgcctcaactcttctgctcttgctgtatgtaattttgttgtaggggaaacttgtctgaaacattgtgtagttcctttgatcattgtaataccatgttaggattgacattttagattaatggaatgaaacaactaaattatgttctttatttatttgtgtttcatttcggatgcatatgttgtggttgacatgagatgttgctttatgaaatcttattgccc

SEQ ID NO: 3825 - DNA, 706 bp, Manihot esculenta
tcctttaatcattgttcttaaacgggtcagatctttatcggcagatggagactggaggaaaagtgaagaagggagccggagggaggaaaggcggaggtccgaagaagaagcccgtttctaggtcggtcaaagcaggtctgcagtttcccgttgggagaatcggccggtacttgaagaaagggagatattcacagcgtgtaggaactggtgctccggtttacttggccgctgttctcgagtacctagcagctgaggtgctggaattggctggaaatgcagcaagagacaacaagaagaacagaataataccaaggcatgttttgcttgctgtgagaaatgatgaagagcttggaaagttgcttgctggtgtgaccattgctcatggaggtgtccttccaaatatcaaccctgttctgttgcccaaaaagagtgataaagctgcaaaggaaccaaagtctccctctaaggccaccaagtctcccaagaaggcttaagcctttatacctcactcaaagccaatctgggtgcctcaactcttctgctcttgctgtatgtaattttgttgtaggggaaacttgtctgaaacattgtgtagttcctttgatcattgtaataccatgttaggattgacattttagattaatggaatgaaacaactaaattatgttcttttggtaaaggtttcatttcggagccattttaagaa

SEQ ID NO: 3826 - DNA, 726 bp, Castanea mollissima
tttcccacttccagtccaaccactactctttccctcactcccttgtttgtttctcgagaaaattttttcgtgtgtgattttttcatggataccggtggaaaagtgaagagaggagctggaggaagaaaaggcggcggtccaaagaagaaacccgtctcccggtccgtcaaagccggtctacaattcccagtcggtcggatcggccggtacttgaagaaaggccgatacgctcagcgtgtcggtaccggtgctccggtttacctcgccgccgtgctcgagtacttagctgctgaggttttggaattggctggaaatgctgcaagagacaacaagaaaaacaggattatcccgaggcatgtgttgctagcggtgaggaacgacgaagagcttggaaagcttcttgcaggtgtgaccattgcacatggaggtgtacttcccaacatcaaccctgtccttcttccgaagaagactgagaaggcggccacaaaggagcctaagtctccagccagggccactaaatcgcccaagaaagcttaatatgttaaaacaaattcagtcttttgtgtcactgtatgtaatttccttatctgtatgtggcttgtagggaagctttttcatgttgttaggagttaggaccatttgtactctttgtttccatgtcattgtagtgttaaaacatcctttgttttaagtcattgaaatgaaattgcagcccagtttggaaaa

SEQ ID NO: 3827 - DNA, 701 bp, Gossypium hirsutum
tctcctgtaccaatcaatatcctctaattctaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccctgttggtaggatcggccgttatttgaagaaaggaaggtattcgcagcgggtcggaaccggagccccggtttacttggctgctgttcttgagtacttggccgctgaggttctggaattggctgggaacgctgcacgtgacaacaagaaaaacaggatcatcccaaggcacgttctactcgccgtgaggaacgacgaagaattagggaagcttctcgccggcgtaaccatcgctcacggtggtgtgttgccgaacatcaacccagttcttttgccgaagaagactgaaaaggccgccggcaaagaacccaaatctccatcaaaggccaccaagtctcctaagaaagcttaatttgttttaacaaaactagattcacagggctttatttttcttagttgtatgtccttttgggtgattgttttcacagtgtaggggaagactgccttaagcaatatggaagcattgttagaatctcattatgatgtatgttactttaatggaaatgaaacatctagtttct

SEQ ID NO: 3828 - DNA, 703 bp, Gossypium hirsutum
tctcctgtaccaatcaatatcctctaattctaaagctaagagttttaagttaacgaagcatttgggtcgtttcgaagtaatggaaacttcaggaaaagtaaagaagggagccggaggaaggaaaggtggtggcccgaagaagaagcccgtttcaaggtctgtcaaagctggtctccagttccccgttggtaggatcggccgttacttgaagaaaggaaggtattcacagcgtgttggaaccggagccccggtttacttggctgctgttcttgagtacttggctgctgaggtcctggaattggctgggaacgctgcacgtgacaacaagaaaaacaggatcatcccaaggcacgttctacttgccgtgaggaacgacgaagaattagggaagcttctcgccggcgtaacaatcgctcacggtggtgtgttgccgaacatcaacccagttcttttgccgaagaagactgaaaaggccgccggcaaagaacccaaatctccatcaaaggccaccaagtctcctaagaaagcttaatttgttttaaaaaagactagatccacagggctttatttttcttagttgtatgtccttttggggggattgttttcatagtgtaggggaagaatgctgtaagcaaattggaggaattgttagaatgttatcatgatgtatgttactttaatggaaatgaaacatctagtttct

SEQ ID NO: 3829 - DNA, 701 bp, Gossypium hirsutum
tctcctgtaccaatcaataccctctaattttaaagctaagagatttaagttaacgaagcatttggtcggttcgaagtaatggaaactaccggaaaagtaaagaagggagccggaggaaggaaaggtggtggcccgaagaagaagcccgtttcaaggtctgtcaaagccggtctccagttcccagttggtaggatcggccgttacttgaagaaaggaaggtattcacagcgggtcgggaccggagccccggtttacttggctgcagttcttgagtacttggccgctgaggttctggaattggctgggaacgctgcacgtgacaacaagaaaaacaggatcatcccaaggcacgtgctacttgccgtgaggaacgacgaagaattagggaagcttctcgccggcgtaaccatcgctcacggtggtgtgttgccgaacattaacccagttcttttgccgaagaagactgaaaaggccgccggcaaagaacccaaatctccatcaaaggccaccaagtctcctaagaaagcttaaattgatttaacaaaactagatccacagggctttatttttcttagttgtatgtccttttggggggattgttttcacagtgcagggggagactgctttaagcaaaatggaagcattgttagaatctcattatgatgtatgttactttaatggaaatgaaacatctagtttct

SEQ ID NO: 3830 - DNA, 934 bp, Gossypium hirsutum
cctgtaccaatcggtatcctctaattttaaacctaagagttttaagttaacgaagcatttgggtcgtttcgaagtaatggaaacttcaggaaaagtaaagaagggagccggaggaaggaaaggcggtggcccgaagaagaagcccgtttcaaggtccgtcaaagccggtctccagttccccgttggtaggatcggccgttatttgaagaaaggaaggtattcacagcgggtcggaaccggagccccagtttacttggctgcagttcttgagtacttggcggctgaggttttggaattggctgggaacgctgcacgtgacaacaagaaaaacaggatcatcccaaggcacgtgctactcgccgtgaggaacgacgaagaattagggaagcttctcgccggcgtaaccatcgctcatggtggtgtgttgccgaacatcaacccagttcttttgccgaagaagactgaaaaggccgccggcaaagaacccaaatctccatcaaaggctaccaagtctcctaagaaagcttaatttgattgttaagaaagttagtttaatagggctttatttttcttagttgtatttcctttgggatgttttaagcaaactggaagaagtgttagaatcccattatcatgtacgttactttaatggaaatgaaacatctagtttctattcttgataatttatcatgtggtttgtacaaccaatactcacatgatagcttctaagggttcttttgattagttgttgaagttattgttggcgttaaattttagttgggggaatgaaataggattgtaatagaataaaaatgaaattagtaatgcagttgtttaattaaatagaatgaaatatatctgtaataatattcttgtgtttgattgaaaggaaaatgaagtggaaataataataggaaaagggtttaattggtcc

SEQ ID NO: 3831 - DNA, 919 bp, Quercus alba
cgagaggattaatcttgctgtgcgtgacaccattagcagcgacccttacgttgttttcaccacacgagtcttcaatttctttcccacttccagtccaaccactctttccctaactccctgtttgtttctcgagaaaattctttttgtgtgattttttcatggataccggtggaaaagtgaagagaggagctggaggaagaaaaggcggcggtccaaagaagaaacccgtctcccggtccgtcaaagccggtctacagttcccagtcggtcggatcggccggtacttgaagaaaggccgatacgctcagcgtgtcggtaccggtgctccggtttacctcgccgccgtgctcgagtacttagctgctgaggttttggaattggctggaaatgctgcaagagacaacaagaaaaacaggattatcccgaggcatgtgttgctagccgtgaggaatgacgaagagcttggaaagcttcttgcaggtgtgaccattgcacatggaggtgtacttcccaacatcaaccctgtccttcttccgaagaagaccgagaaggcggccacaaaggagcccaagtctccagccagggccactaaatcgcccaagaaagcttaatgtgttaaaacaaattcagtcttttgtgtcactgtatgtaatttcctatctgtatgtggcttgtagggaagctttttaatgttgttaggagttaggaccatttgtactctttgtttccatgtcattgtagtgttaaaacatcctttgttttaagtcattgaaatgaaattgcagcccagtttggtattctcatttgttactttggttgaagttgttgtaatgtaattaggcttaatttgggttgtttgtggttttgaccatttggtttgttgtgttaagtgtatagaagaaaaatcctagcttacacc

SEQ ID NO: 3832 - DNA, 745 bp, Papaver somniferum
atcggatctcatctccaaattgtttctctcagctagactttcttttagggcaaaaggtaaattgaagtcatggagacaccaggaggaaaagcaaagaaaggatttgcaggaagaagaggtggtggtcctaaaaagaaagcagtcacaagatcagtcaaagctggtttgcaattcccagttggtagaatcggaagatatcttaagaaaggtcgatatgctcaacgtgttggtagtggtgcccctgtttatctcgccgcagttcttgaatacctcgcagctgaggtgttggaattggctggaaatgcagctagggataacaagaagacaagaattataccaaggcatgtgttattagctgtaagaaatgatgaagaacttgggaagcttttatcaggtgttaccattgctcatggaggagttctaccaaatattaacccaattttattgccaaagaaaactgctgaaaaagcatctactgctaaagagccaaagtctccaaaagctggaaaatcacctaaaaaggcataattgtagaaaccctagttaatgtttatgttgcccttttttgtattaatttctgtgtttccttttttattttcttgggtctgttgttaggtcttgttgtttaatctgtaagtggtacatgttaagtaaatcgttggatgttttagtactctttttaatcatattgttgaaatgaatgtttatcttccgataaatgttgaaatgaatgtttatttcaatg

SEQ ID NO: 3833 - DNA, 681 bp, Glycine max
gcatctcaccatcactctcgctcttgcaattattcctcttctcgcaatccgcactaaaattctagggttccgacatggacaccggtggaaagattaagaagggtgccggcggaagaaagggtggcgggccaaagaagaagccagtcactagatccgtcagggctggtctccaattccctgtcggaagaattggccgttacttgaaaaagggaagatacgctcagcgtgtgggaaccggtgctcctgtttatctggctgctgttcttgaatacctagctgctgaggtgcttgagttggctgggaatgccgcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagaccgagagggcttccaaggaacctaaatctccatccaaggctaccaaatctcctaagaaagcttaagtgtttttattttattttatttgaatatgtaaatcagtctttagatgctttttatgtgaaagaaaaaattatctattgcaaacactgtaattcctatcgtctcgcatgtaggagtttgctacattaatgaaatcttctttatttttttttgggggtc

SEQ ID NO: 3834 - DNA, 712 bp, Glycine max
tcatccatttctcgcaacaacgcttaatctctctcattccccatttcctcacctccttcaaccgctgctaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaagagttggggaaattgcttgctggagtgacaattgcacatggtggcgtgcttccaaacatcaaccctgttttgttgcctaagaagactgagagggcttccaaggaacctaaatctccatccaaggctaccaaatctcctaagaaagcttagattacttttttattttccatatttaatttagtgttgtatatcggtgtttaggtgcttttggtgtaacaggatattttatgtgtttcgaaaacactgtaattcttgtcccaatttgttgcttgtaggagtgagtttgcttcgttaatgaaaagtggaaacccccttgttttcaatc

SEQ ID NO: 3835 - DNA, 700 bp, Euphorbia esula
  misc_feature (540)..(540): n is a, c, g, or t
aaaatcaaaccttcatttcttgcttttatttgaatctacaaattcgtcggatatatttagcgagatggatagcactacagtgaagaaaggtgccggaggaaggaaaggtggaggccccaagaagaagcctgttaccagatctgtccgagctggtcttcaatttcccgttggtagaatcggaaggtatttgaagaaggggagatatgcccaacgagttggaaccggagctccggtctacttagctgcagtccttgagtacctagctgctgaggtgctggaattggctggaaatgcagcaagagataacaagaagaacaggattatacctagacatgtattgcttgcagtgagaaatgatgaagagcttggaaagttactggctggtgttacaattgctcatggaggtgttcttccaaacataaaccctattcttttgcccaaaaagacagagagatctgccgctgcagccaaggagccaaaatctcccgctaaagctgctaagtctcccaagaaggcataagtagtgtttgattagtcagnttaggtgttctgcttgtttatgtaatttgaatgtattttgggaagtaggcataaatcagatgaagtcagagccatgtttagctgtttatttagcctgtgtaatactctgttaaaatttaacatttgaagtcaatgaatgaaagtcccagtttcttgtttc

SEQ ID NO: 3836 - DNA, 1018 bp, Triticum aestivum
  misc_feature (22)..(22): n is a, c, g, or t
  misc_feature (52)..(52): n is a, c, g, or t
  misc_feature (126)..(126): n is a, c, g, or t
  misc_feature (144)..(144): n is a, c, g, or t
  misc_feature (153)..(153): n is a, c, g, or t
  misc_feature (165)..(165): n is a, c, g, or t
  misc_feature (204)..(204): n is a, c, g, or t
  misc_feature (237)..(237): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (264)..(264): n is a, c, g, or t
  misc_feature (277)..(277): n is a, c, g, or t
  misc_feature (307)..(307): n is a, c, g, or t
  misc_feature (384)..(384): n is a, c, g, or t
  misc_feature (611)..(611): n is a, c, g, or t
  misc_feature (613)..(614): n is a, c, g, or t
  misc_feature (617)..(617): n is a, c, g, or t
  misc_feature (620)..(621): n is a, c, g, or t
  misc_feature (626)..(626): n is a, c, g, or t
  misc_feature (629)..(629): n is a, c, g, or t
  misc_feature (638)..(638): n is a, c, g, or t
  misc_feature (649)..(650): n is a, c, g, or t
actagtccagagctcgggatcncaatctctcagcaccaaacatcttctcttncgcgcctcgacgagcatcagcggctagccatggacgtctcagccaccggagcaggcgcgaaggccaagaagggngccgcagggcgcaaggcnggcggcccnaggaagaagtcngtgtcgaggtccgtcaaggccgggctccagttcccggtnggccgcatcgggcggtacctcaagaagggccgntacgcgcagcgcgtcggnacnggngcncccgtctacctcncggccgtcctcgagtacctcgccgccgagntgctggagctcgccggcaacgccgccaaggacaacaagaagagccgcatcatcccgaggcacctgctgctcgccgtnaggaacgacgaggagctcgggaagctgctggccggcgtcaccatcgcgcacggcggcgtcgtgcccaagatcaacccggtgctgctccccaagcggacggcggagaaggtgcccaaggagggcaagtcgcccaagaaggccgccaagtcccccaagaaggcttagggaggcccgctgatttgcgtcagtatgtaataagctgttcgcctagcggcatcgatgtaatntnngtngtnnatggnaanatgtcaganatctctctgannttgtggtcgggtaaacaaccccttcagtccatgtcaaggggccgggggggccggtctagagtatcccgcgagggggcccagccttaggcgttccgcggctttcatggacaaggggggcccctaaaggggggtcgtaatataagccaaggaacgggccgcccatttacaaaaagtggtgactgggaaaaaaagggaactcggggaacttggtgaaaggaaccataacttggggggggggacaatactgggggaactctaccttcggaggatttaaagccccggagggaaaaataaaagattttaggggggttaacggggtaaaaccaccgcgaatattccggccccgctgggaagattggggttccggg

SEQ ID NO: 3837 - DNA, 763 bp, Fragaria vesca
gaaaattttccaattctctctctctctcccatttctgaaatctctctcaaaagggtctcagattcagtgctcagattttgaaatggagactggcggtggaaagatcaagaagggcgccgcaggaaggaagggcggtggcccaaggaagaagtcggtgactcgctccatcaaagccggcctgcaattcccggtcggtagaatcggccgctacttgaagaagggaaggtatgctcagcgtgtcggctctggagctccggtctacttggccgccgtgcttgagtacctcgcagctgaagtgctggagttggctggaaatgcagccagggacaacaagaagaccaggattatcccaaggcatctgctactggctattaggaacgatgaggagcttggaaagcttctctctggggttactattgctcatggaggtgtcttacccaacatcaacccaattctgctacccaagaaggctgagaaggccggaggaggagtcaccaaggagcccaagtccccatcgaaggccggcaagtcacccaagaaggcggctgcctagattctgtgaatggttgcttgtgtagggtttagtttgaattgctccatttgtacgtaatcgatctcggtatccaggatgttggttttgttattgtagggaaagttcctaggagatctaaagcttttgttatccttacatcttcaatgtttattatcaagttgtttgggaattaattaatgaaacgccctgtttctgtgatgttttgtgttg

SEQ ID NO: 3838 - DNA, 811 bp, Cenchrus ciliaris
  misc_feature (20)..(20): n is a, c, g, or t
  misc_feature (267)..(267): n is a, c, g, or t
  misc_feature (680)..(680): n is a, c, g, or t
  misc_feature (711)..(711): n is a, c, g, or t
  misc_feature (715)..(715): n is a, c, g, or t
cagattccctcgcttcctcncaagcccaaaaccgaattccctccaaatccacccacccccaccccctcggagatggacgccggcgccacgaaggtgaagaaggcagcggccggccgcaagctcggcggcccgaagaagaagccggtgtcgcgctccgtcaaggccgggctccagttccccgtcggccgcatcgggcgctacctcaagaagggccggtacgcgcagcgcgtgggcacgggcgcccccgtctacctcgccgccgtcctngagtacctcgccgccgaggtcctcgagctcgccggcaacgcggcgcgcgacaacaagaagaaccgcatcatcccgcgccacgtcctcctcgcgatccgcaacgacgaggagctcggcaagctgctggccggcgtcaccatcgcgcacggcggcgtcctccccaacatcaacccggtgctcctccccaagaaggccgccgagagggccgagaaggccgagaaggcgtccaagtcgcccaagaaggccgccgccaccaagtcccccaagaagtaggcggatcctgtcatcggcaccgatctgatctgtgttttgagcctgtagtgcttccctgtgttcgttccttttgtgtgtatgtagtggtgcttccttatctagcagtggtcatcgatcggtgaatcaagagtttaggtgtntagtttctagctgtaatggttggtgcagtgntttntatgttatccatatttatgagaagaaagggaatgaatttgcaatcctttgtgatttctggatctggatgtctgggcttctgtccctctgattcgta

SEQ ID NO: 3839 - DNA, 1149 bp, Zea mays
tagggtaacagggatttagaatttgatgaaaatatataatgcagaccgtggaaggaaacgttgctttaactcggttggctacccatacatcgttctagaataagttcaaatgctctatattcgttaggacaacagctttgaggatctggcataaccaagtctacaactcgggatgcagaacacaagcacacggcccatagccagtcatcagacataaacaccacttgcaagaagcacgaacagagacccaaagcccaagaaaacagaagcaacaactgctgttgcgatctcctttgacaggctacggctcctccgggatgaagttgcttcataaatgaagaaggaggcggtgaacatgaggcctacggataccatgacgacggccagcgtcgggtaccactccaccggcacggggctcgagattgccttcgccgccattccgtgagatctgctgccgctgtagtcgccgcccgctccgcctgcctcgtcgcccccttgtcgccgccgcgatagctccgctaagctcactcgaattcgagtgagcttagcggagctgatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggggggttgcccaacatcaaccccgtcctgctgcccaagaaaaaggcggaaaagggcttccacggcgggagcaaggaggccattctcccaaaaaggcccccaagtccccaagaagggataggggttggagggggatcccattttttcatgtgttgggtggaaaccggg

SEQ ID NO: 3840 - DNA, 540 bp, Artemisia annua
ggagggaaccggtaaaatcaagaagggagcagcaggaaggaaagccggtggaccgcgaaagaagtccgtcactcgatctgtgaaagccgggcttcagtttccagttggaagaattggaaggtatttgaagaaaggtcgttatgctaagcgtgtcggtactggtgctcctgtttatcttgctgcggtcctcgaatatctcgcagctgaagtgttggaattggcgggaaatgcagctagggacaacaagaagactaggattattccgagacatgtgttgttggcgattaggaacgatgaagagcttggaaagttgttgtctggtgttacgattgctcatggtggtgttttgcccaatattaacccggtcttgttgcctaagaaaactgctgctaaagaaccaacaccaaagtctccatccaaagctgcaaaatcgccaaagaaagcatagattagtttgtttgatgtaattgtcgtgttttgttagtaaattcagatgtactcatttctatcaaatggaaatctcttctttctgcttctaaa

SEQ ID NO: 3841 - DNA, 751 bp, Camellia sinensis
acatcagattagaggattagattgttctcattgtagtcttcgggtgcaaaatagtcattttaagtcgtgaaaattttatcagagatggacggtgccggaaaagtgaagaagggtgctggagggaggaaaggcggcggtccgaagaagaaaccggtgtcccggtccgtcaaggccggtctacagttcccggtcgggaggattggccggtacttgaagaagggtcgctatgctcagcgagtcggaaccggagctccggtttacatggctgctgtgcttgaatacctagctgctgaagtgttagagttggctggaaatgctgctcgtgacaacaagaagaacagaatcattccgaggcatgtgctattagcggtgaggaacgacgaagagttgggaaaattgctagctggagtgacgattgcacatggtggagtgttacccaacatcaacccagttctgttgccaaagaagactggcagtgctgcaaccaaagaacccaaatctccatcaaaggccacaaaatctcccaagaaagctgcttagggaaaccatttggttgtttcctcttttccctctgtatgtaattttgggtttagaacctgcttgttttgttgcttgctgcttagggaaatttgtgagaagaagaaaaatagcagttgtaatcgtttttagtgttttttatattagtggctttgtcgattggatcaatggattgaatctcgtgttgattattgaaaaatttcgtctagtttga

SEQ ID NO: 3842 - DNA, 453 bp, Ricinus communis
atggagacgggagggaaagtgaaaaagggtgcgggaggaaggaaaggtggaggtccgaaaaagaaaccggtaactcggtcagtgagagcgggtcttcagtttccagttggaagaattgggcggtacttgaagaagggaaggtatgcacagcgggttggtactggtgctcctgtttacatggctgctgttcttgagtatttagctgctgaagtattggaattggcagggaatgctgcaagagacaacaagaagaacaggataataccaagacatgtattgcttgctgtgagaaacgacgaggagcttggaaaattgctagccggtgttaccattgctcatggaggagtcttgcctaatattaatcctgttctcttgcctaaaaagactgagaaagctaccaaagaacccaccaagtctccctccaaggctaccaagtcaccaaagaaggcttaa

SEQ ID NO: 3843 - DNA, 721 bp, Ricinus communis
gccgctgtgcgctgtcaaggattaatatatatcagaatttctttttgtgcattgtaaacgggtcgggtcttattggagaaatggagacgggagggaaagtgaaaaagggtgcgggaggaaggaaaggtggaggtccgaaaaagaaaccggtaactcggtcagtgagagcgggtcttcagtttccagttggaagaattgggcggtacttgaagaagggaaggtatgcacagcgggttggtactggtgctcctgtttacatggctgctgttcttgagtatttagctgctgaagtattggaattggcagggaatgctgcaagagacaacaagaagaacaggataataccaagacatgtattgcttgctgtgagaaacgacgaggagcttggaaaattgctagccggtgttaccattgctcatggaggagtcttgcctaatattaatcctgttctcttgcctaaaaagactgagaaagctaccaaagaacccaccaagtctccctccaaggctaccaagtcaccaaagaaggcttaaagagtttgtctcaccaaagaaagatcaagaagcttctcttgttgtatgtaattttgggttgatgttattttgttgatgatgtgtaggggaatttaaactgtttttttttttaaaatagtatgtagtactacttgttagaatgtggcattttagattaatagatgaaactactcgtttcttgcttttca

SEQ ID NO: 3844 - DNA, 616 bp, Zingiber officinale
  misc_feature (17)..(17): n is a, c, g, or t
cgccgccttctcttcgnattctctcgcgcacgactcgagatctcgcctgaaggggatggacgccagtggagcaaccgccgggaaggcgaagaagggagcagctgggcgccgagccggagggcccaagaagaaggcagtctctaggtccaccaaggccggcctccagttccccgttggtcgcattggccgtttcctcaagaaagggcggtacgcccagcgcgtgggctcgggtgcccccgtctacctcgccgccgtcctggagtacctggcggcggaggtgctggaactggccgggaatgcggcgcgcgacaacaagaagaaccggatcatcccgcgccacgtgcttctggcgatacggaacgacgaggagttagggaagctgctcgccggcgtgacgattgcccacggcggcgtgctgcctaacatcaatccggtgctgctaccgaagaagacggctgccaaggagcccaaatcgccttccaaggcgaccaaatcccccaagaaggctgcctgattagtagtgtatacctttcgcatctttgtaatctcgtttagttgtgtgccagtgtcagggtgtaggaaatgttaaatcttgaacgcgatgcatttctggtgc

SEQ ID NO: 3845 - DNA, 578 bp, Medicago truncatula
gcccaaaggcaacgaagaaaggagcaggaggaagaaaaggcggaggaccaaggaagaagtcggtaacaagatcaatcagagccggacttcaattcccagtgggaagaatcggccgttacttgaagaaaggtcgatatgctcaacgtgtcggcaccggtgctcctgtttacttagccgctgttcttgaatatcttgctgctgaagttcttgaattggctggtaatgctgctcgtgataacaagaagaataggattattccaaggcatgtgttgttggctgtgaggaatgatgaagagcttgggaaattgcttgctggtgttaccattgctcatggtggtgttcttcctaatattaaccctgttcttttacctaagaaaagtgaaaaacctgttaaggagcctaaatctccttctaaggctaaaaagtctcctaagaaggcttagattaggtttctgtgatctagggaatcagatttaatgatttgaatgaatgtgataattgatgactaaacgatttgattttaaaaccgaatgatccttttaaccacggtagacggttcaaagagagcagttgacaac

SEQ ID NO: 3846 - DNA, 633 bp, Saccharum officinarum
  misc_feature (415)..(415): n is a, c, g, or t
  misc_feature (442)..(443): n is a, c, g, or t
  misc_feature (495)..(495): n is a, c, g, or t
  misc_feature (503)..(503): n is a, c, g, or t
  misc_feature (509)..(509): n is a, c, g, or t
  misc_feature (522)..(522): n is a, c, g, or t
  misc_feature (536)..(536): n is a, c, g, or t
  misc_feature (538)..(538): n is a, c, g, or t
  misc_feature (543)..(543): n is a, c, g, or t
  misc_feature (567)..(567): n is a, c, g, or t
  misc_feature (582)..(582): n is a, c, g, or t
  misc_feature (586)..(586): n is a, c, g, or t
  misc_feature (610)..(610): n is a, c, g, or t
cgcgcccagagcccccaaaattttctcctctcaatcgcagcaggagcagcgagcagccatggacgccagcggagccggtggcaaggcgaagaagggtgcggccgggcgcaaggctggcggcccccggaagaagtcggtgtcgcggtccgtcaaggccgggctgcagttccccgtcggccgtatcgggcgctacctcaagaagggccggtacgcgcagcgcgtgggcacgggcgcccccgtctacctcgccgccgtcctggagtacctcgccgccgaggtgctggagctggccgggaacgcggcgagggacaacaagaagacgcgcatcatcccgcgccacgtgctcctggccatccgcaacgacgaggagctcgggaagctgctggccggcgtcaccatcgcgcacggtggcgtnctccccaacatcaacccggtgctcctnnccaagaaggtggccgagaaggcggccagcggcagcagcaagcaggccaagtncccaaagnaggccngcaagtccccaanaaggcttagaaagnangggcntcattagcactgtgttgaacttgntcgggttaaatctgnggangggatgggtctgggctactttcgnccttgtggcttatgggatggtca

SEQ ID NO: 3847 - DNA, 1365 bp, Camellia sinensis
ggactaaaacttgtagcagtataacacaaaagtgttcacattggaaactcaaagatcagagcatatatacccacatataattcctaacttaaaaatgtaacggtaactttaacaacacacacgaagcttacaaagagagagaaaagaaatctaagaatcgacagagtaagatctcacacgtagagtcaagtcacagtttcagccactttggcttaacaggctttttgccagtaggttttctctctgggacagcagaggaggaattggcaattacaggttctgggaccgcttcaactggctcctcctccttttcagggatgagttccaaacctttcaaagacaatatatcctcttgaaggaatggacctgaaacagcaggacaatcatctccctgtggtagttggtcataaaaaaaatacacaattgcaccaggaacaaatccagcagaataaaaatccagggacatgtctttcacttgcttcttcggaggagtagtatatatataaaatggtagttctggttgggcaatcactttcttaagaagatcaattaagctctggattgtctctgatggatgaaaagtgccctctaatcggccattacggccggggacatcagattagaggattagattgttctcattgtagtcttcgggtgcaaaatagtcattttaagtcgtgaaaattttatcagagatggacggtgccggaaaagtgaagaagggtgctggagggaggaaaggcggcggtccgaagaagaaaccggtgtcccggtccgtcaaggccggtctacagttcccggtcgggaggattggccggtacttgaagaagggtcgctatgctcagcgagtcggaaccggagctccggtttacatggctgctgtgcttgaatacctagctgctgaagtgttagagttggctggaaatgctgctcgtgacaacaagaagaacagaatcattccgaggcatgtgctattagcggtgaggaacgacgaagagttgggaaaattgctagctggagtgacgattgcacatggtggagtgttacccaacatcaacccagttctgttgccaaagaagactggcagtgctgcaaccaaagaacccaaatctccatcaaaggccacaaaatctcccaagaaagctgcttagggaaaccatttggttgtttcctcttttccctctgtatgtaattttgggtttagaacctgcttgttttgttgcttgctgcttagggaaatttgtgagaagaagaaaaatagcagttgtaatcgtttttagtgttttttatattagtggctttgtcgattggatcaatggattgaatctcgtgttgattattgaaaaatttcgtctagtttgagcg

SEQ ID NO: 3848 - DNA, 790 bp, Phaseolus coccineus
ggatcatcttcttaccgatactctcacaccacactgttatcttctcctaaaatatagggtttggccatggataccaccggggaaaatcaagaagggcgccggaggaaggaagggcggcggaccaaaaaagaaggcagtgtcaaggtctgttaaggccggtcttcaattccctgtcggaagaatcggacggtttttgaaaaagggaaggtacgctcagcgtgtgggtgccggcgctcccgtttatttggctgcagttcttgaatacctagctgctgaggttcttgagctggctggaaatgctgcccgtgacaacaagaagaacaggattattcctagacatgttcttctggctgtgaggaacgatgaggaattggggaaattgctttctggtgtgaccattgcccatggtggtgtgcttcccaacatcaaccctgttctgttgcccaagaagtccgagaaggctgccaaggaacccaaatcttcatctaaagctaccaaatctcccaaaaaggcttagaatagaaatttaatttagttatgtatatcgctgttaggatgtcattggtgtaatagatatcagatttgacggttgaaacttgtattcttgctttactgtactgcgtgtagaagtttgcttcattaatggaaacatatcgttttcatccatttgttctctctacgacaactgtttgttcaacttatatttgaagagacttctttaaggtttgtattggtcaaataaaagtgactgactctggatgtgttattctgatgcttatttaaggtattt

SEQ ID NO: 3849 - DNA, 774 bp, Mesembryanthemum crystallinum
cccccctcgagactagcctcaatccatttcctcatttttcagtcaaccaaacaagctccccatttctagagagagaacctagagagagaaagccatggacagcactggaggaaggcaaagaagggagctgctgaaaggaaggtcggcggtccaaagaagaagtccgtttcccggtccgtcaaggccggtctgcaatttccggttggtcgtatcggccggtacttgaagaagggccgatatgctcagcgtgttggtagtggagctccggtttacatggctgctgttctcgagtaccttgctgctgaggttttggagttggctggaaatgcagcaagggacaacaagaagaacagaataatcccaaggcatgtgctgttggccataaggaacgatgaggagctcggaaagcttctttctggagttacaatcgctcatggtggtgttctaccaaacatcaacccagtgttgttgccaaagaagactgctgagaagtcaccaaaggagccaaagtcaccctcaaaggccacaaagtcacccaagaaagcttaaaaagtcagtgatgttgttgatttggttgtgtaggcagtatggaaaggagttggagtttaatcttgtttatgtatgtaatgtttgagaaatggttaggttttcatcaggttagggttttatgatatataatgtaatgggaggttgtaatgggatcaataatttattgattcactcatcttcttcatcttctctgtagtgttttgccattaatgagtaatgacaatg

SEQ ID NO: 3850 - DNA, 661 bp, Triticum aestivum
tctctccatcccaatcccgacctaccgcccgctcccgttaagccatggcacgccacggtcaccggcgccaaggggaagaagggcgccgccgggcgcaaagccggcgggcccaggaagaagtcggtgacccggtccgtgaaggccgggctccagttccccgtcggtcgcatcgggcggtacctcaagaagggccgctacgcccagcgcgtcggcaccggcgcccccgtctacctcgccgccgtcctcgagtacctcgccgccgagctgctggagctcgccggcaacgccgccaaggacaacaagaagagccgcatcatcccgcgccacctgctgctcgccgtccggaacgacgaggagctcggcaagctgctggccggcgtcaccatcgcgcacggcggcgtcatccccaagatcaaccccgtgctgctccccaagaagacggcggagaaggagggccaggcgcccaagtcccccaagaaggccgccaagtcgcccaagaaggccgccaccccgaagaaagcttaagagagatgcgctctctgtcgtttaggatgtgtgctgtgtagtgttcgtctgattagtgatgtgaaggtgttccgtctagttgttgatgtaccctgtgttgtgtcatgttcatggaagaaattcagtaaaaaaaaaa

SEQ ID NO: 3851 - DNA, 735 bp, Linum usitatissimum
ggcagttcacaactcacctctcatatttctctctcttccggcgttctctaaattccatttcaactctccgactccctcaagtaatctttctttcaaaaaatggacgccggatcaaccaaagttaagaagggagccgccggcaggaaaatcggtggcccgaagaagaagccagtctccaggtccgtcaaagccggacttcaattcctcgtcggaagaatcggacggtacctgaagaaaggaaggtacgctaagcgagttggcaccggagctcctgtctacttggctgccgtcctcgaatatctcgccgctgaagttcttgagctggcgggaaacgcagctcgtgataacaagaagaacaggatcatcccgcgccatgttcttcttgcgatcaggaacgacgaggagctaggaaagctgctggccggagtgacgattgcgcacggcggtgttcttcctaacatcaacccggtgctgttgccgaagaagtctgccgccaaggagcccgcggagaagaaatctcccgccaaggctaccaagtcccccaagaaagcttgatttaggtcatagaaattgggtataggcttgttgttgttgttcttgtagctgtgtaactaatttctccagattagcttttgttgttgtttgcaaatgtatcgttgtttggctcatggtttgacagtgttagggaatctctgtattgatttgcaatggaaatgaagatgaaacatttcgttc

SEQ ID NO: 3852 - DNA, 801 bp, Orobanche aegyptiaca
ctttcatagcgcattcttttccacatttattttgtcccaattccttctctatcagacaaaaatggaagccggtggtaaagttaagaagggagccgctgggaggaagatcggcggcggtccgaggaagaagtcggttacccggtccgtgagagccggtctgcagtttcctgttggcaggatcggccgttatctgaagaagggccgctatgctcagcgggttggtaccggtgcaccggtgtacgtggctgctgtgctcgagtaccttgctgcagaggttttggaattggctggaaatgcagcgagagacaacaagaagaacaggataattccaagacatctgttgctggctgtgaggaatgatgaagagcttggaaagcttcttgctggagttactatcgcacatggtggagttataccaaacattaatcctgtacttttgcccaagaagaatgaaaagaccgctgagaagacacccaaatccccagcgaaggctgccaagtcgccgaagaaggcttaaattagcgtttattacatagtgttattgtagaggtggttatttctgtaacaaattttatcgcatgagatgtggtaatatatttttgtaacttaattgaatttttctatcagcatttgtcacatttaagtgtattttaaaataaattgcatgtagtatacattaaatttatattaccaattaaattagggaaaacagcttaggttgcaaaggagtgtatataataaggcttgagaagattgcaaagaagcagatggcgattctattcttcataggtaattacgtat

SEQ ID NO: 3853 - DNA, 661 bp, Vigna unguiculata
tttttcattcctcattccgtctctcaaattttaagctcagctcatttctagggtccgacatggacgccggtggaaagattaagaagggcgctggaggaagaaagggtggtgggccaaagaagaaaccggtggcaaggtccgtgagggctggtctccaattccccgttggaagaattgggcgttatttgaaaaaaggaaggtactcgcagcgtgttggaaccggtgctccagtatatttggctgctgtacttgaatacctagctgctgaggtgcttgaattggctggaaatgctgctcgcgacaacaagaagaacagaattattcccagacatgtgcttctggccgtgaggaacgatgaggagttggggaaattgcttgcgggagtcacaattgctcacggtggtgtgcttcccaacattaaccctgttttgttgcctaagaagactgagaaagcttccaaggaacccaaatctccatccaaggccacgaagtcccctaagaaggcttagattatattctaatttagttatgtatactagtctttagggttcttttttgttgtaacaggaatatttgatgtttgaaacactgtaagtttcgtctaattgcgttgtgaaaaggagtttatgaattaatggaaaaaccatcttgttttcggcca

SEQ ID NO: 3854 - DNA, 697 bp, Glycyrrhiza uralensis
gaagttaccaacaccactcactcacacacacacacgatcgcgattcctcacagcgcaccgaagtcactgctagaatctagggttgggatattgcaagatggacgctagcggaaaggtgaagaaaggagcaggagggaggaaaggaggaggaccaaagaagaaggcagttacaaggtcggtgagagccggtcttcaattcccagttggtagaattgggcgttacttgaagaaaggaagatacgctcagcgcgtgggtgccggtgctcccgtttacctggccgcggttctagaataccttgctgctgaggtgcttgagttggctggaaatgcagctcgtgataacaagaagaacaggattatcccgagacacgttttgctggcagtgaggaacgatgaggagcttgggaaattacttgctggtgttaccattgcccatggtggtgttctacccaacatcaacccagtgcttttgcctaagaaggccgacagggctgcaaaggagcccaagtctccttctaaggccaccaagtctcccaagaaggcttagatcagtttctaattttagtttatttgtgttcattttgtgtgtatatgatgatgcatttaggtccttcttatgtaacagaatgatttgttgcgtttgaaacaatgtaattctgatctcactgtgtctccttttagtatccatagccaatcc

SEQ ID NO: 3855 - DNA, 745 bp, Lotus japonicus
ggacgttcgcaatcatctgagtctcacacctgcaatttctcacatcgcgtcaaagtcacgcgcaaccaggaatctagggttcgaacctcgccaatcgccatggacaccggaggaaaatcgaagaaaggtgccggaggaagaaaagctggtggcccaaagaagaagccagtttcgagatcggtgaaggctggtctccaattccccgtcggaagaatcggacggtacttgaagaaaggaaggtatgctcagcgtgtcggaaccggtgctccggtgtaccttgctgctgttctggagtatctcgctgctgaggtgcttgagttggctggaaatgctgctcgtgacaacaagaagaacaggattatcccgaggcatgttctgcttgctgtgaggaacgatgaggagcttgggaaattgcttgctggagtcaccattgctcatggtggtgttcttcccaacatcaaccctgtgcttctgcctaagaagactgctgagaaagctcctaaggagtcaaagtctcctcctaagaaggctggaaagtctcccaagaaagcttagattatcaagttaggctgatttctgattctagattgttcatgttgtgtttggtttgtaaatttgcaattaggtggttcttctgtgataaaaagtattcaatgtgtttgaaagaatgtaattctgatttcactgttgttcttagtatttataataagcaatttctgggattatcaagcttttctgtctcgat

SEQ ID NO: 3856 - DNA, 734 bp, Lotus japonicus
ccattctgagtctcacacctgcaatttctcacatcgcgtcaaagtcacgcgcaaccaggaatctagggttcgaacctcgccaatcgccatggacaccggaggaaaatcgaagaaaggtgccggaggaagaaaagctggtggcccaaagaagaagccagtttcgagatcggtgaaggctggtctccaattccccgtcggaagaatcggacggtacttgaagaaaggaaggtatgctcagcgtgtcggaaccggtgctccggtgtaccttgctgctgttctggagtatctcgctgctgaggtgcttgagttggctggaaatgctgctcgtgacaacaagaagaacaggattatcccgaggcatgttctgcttgctgtgaggaacgatgaggagcttgggaaattgcttgctggagtcaccattgctcatggtggtgttcttcccaacatcaaccctgtgcttctgcctaagaagactgctgagaaagctcctaaggagtcaaagtctcctcctaagaaggctggaaagtctcccaagaaagcttagattatcaagttaggctgatttctgattctagattgttcatgttgtgtttggtttgtaaatttgcaattaggtggttcttctgtgataaaaagtattcaatgtgtttgaaagaatgtaattctgatttcactgttgttcttagtatttataataagcaatttctgggattatcaagcttttctgtctcgat

SEQ ID NO: 3857 - DNA, 653 bp, Pseudoroegneria spicata
ctggctctctccatcccaatcccgacctaccgcccgctcccgcaagccatggacgcctcaggcaccgtcgcgaagggcaagaagggcgcggccgggcgcaaggccggcgggcccaggaagaagtcggtgacgcggtccgtgaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccgggaacgccgccaaggacaacaagaagagccgcatcatcccccgccacctgctgctcgccgtccggaacgacgaggagctcggcaagctgctggccggcgtcaccatcgcgcacggcggcgtgatccccaagatcaacccggtgctgctccccaagaggacggcggagaaggagggcaaggcgcccaagtcccccaagaaggccgccaagtcgccgaagaaggcataagagagtgcgttctgtatcgtttaggcttgtgctgtgtagtgttcgtctgaataggggtgtgaaggtgttccgtctagttgtcgatgtaccttgtgttgtgttcatgttcatggaagaaattcagaaatctctctgagttccca

SEQ ID NO: 3858 - DNA, 648 bp, Glycine max
atcactctcacgcttctgattattcctcttcccattctagggttcccaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctgttggctgtaaggaacgatgaggagttggggaaattgcttgctggtgtcaccattgctcatggtggtgttcttccaaacattaaccctgttttgctacctaagaagactcaggttgctaaggaaccaaaatctccatccaaggctaccaagtctccaaagaaagcttagatgtttttattttattttaatatatgtatatcagtgtttagatgctttttatgtaaaagaaaatagtatctgttggaaacactgtaattcttatcgtcttgcatgtaggagtttgctaaataatgaaaatatcttattattttgggtcaaaa

SEQ ID NO: 3859 - DNA, 852 bp, Glycine max
accatcactctcgctcttgcaattagtcctcttccaacaatccgcagctaatttctagggttccgacatggacactggtggaaagatcaagaagggcgccggaggaagaaagggcggcggcccaaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgctcatggtggtgttcttccgaacattaaccctgttttgttgcctaagaagactgagagggcttccaaggagcctaagtctccatccaaggctactaaatctcctaaaaagtcttaactgacttagtttattgtttctctatttagtgtgcacaaaatgtaaatctgtgtttaggttccttcttgtatcaccattatttgtagttctcaagtcgctgtttctttttcacattttcattcaatctgttgagacagcaagctctcagtaatggattgatttaattttcttatattcgtataattgtatcccgccttctctctatcgaaagattgcgcaatttgatttagacgatttgaatttccatcataattattgtttggataggtgtatgtgtgatccaagaaagaaatggacgttgatagtatgttacttagcactattgtaggcagtga

SEQ ID NO: 3860 - DNA, 801 bp, Oryza sativa
atcctaaatccaaatcggcgccggaaatcccttcaaatcccccccgaattccgctccatttcaccctcacgtttcccggagatggacgtcggcgtcggcggcaaggcggcgaagaaggcggtggggcggaagctgggcgggccgaagaagaagccggtgtcgcgctccgtcaaggccgggctccagttccccgtcggccgcatcggccgctacctcaagaagggccgctacgcccagcgcgtcggcaccggcgcccccgtctacctcgccgccgtcctcgagtacctcgccgcagaggtgctggagctcgccgggaacgcggcgcgggacaacaagaagaaccggatcatcccgaggcacgtgctgctggcgatccgcaacgacgaggagctcgggaagctgctcgccggggtcaccatcgcgcacggcggcgtgctgccgaacatcaacccggtgctgctcccgaagaagaccgcggagaaggccgacaagccggccaaggcgtccaaggacaaagccgccaagtcccccaagaagcaggcgcgctcctagcttcatgtccttccattcattggtcactgtatatgcagtacttagtttgttcgattcgagattagttcgtatcactaggcatttaactggatgttttcgattttagcttgcaagacactagggtagttctaatgagaagatgaagtgtctcgctttgtcttctggatcccatgtgcttcaatatgtggtttctcaattgaaatttgtttgtgttcagtaagtttaatagcctgattgtgaatctgatct

SEQ ID NO: 3861 - DNA, 736 bp, Saccharum officinarum
cgcttcctccaaaccccaatcatcacttccctccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctgcctccactccgtcctcctccccaagaaggccgccgagagggctgagaaagtcgcccaagaaggccgccgccaagtcgcccaagaagtagtagtgccccgtctcgtctcatctgattctgatctcagcttggctgagtggtcgtggatccttttgctgttcttgcgtgtctgtgtatgtagtgatgcgtcgcctcatgtgtcgtgtgtctcgatcgatctagttctggttcaatctctagctgtagtggtggttggtgatgggatctccatgttacctaagatttaatgaaaacaagaggaagtgc

SEQ ID NO: 3862 - DNA, 655 bp, Eschscholzia californica
actactaccaagaaaaccgaaacttcagatccaccattttcccggctaattattccggcaaactagttaagaaagatatggataccggaaaagtgaagaaaggtgccggaggaagaaagggaggtggaccaaagaagaaatcagtttctcgttcagttaaagctggtttacagtttcctgtgggtagaatcggtaggtatttgaagaaaggacgttactctcagcgtgtcggaagtggtgctcctgtttatcttgctgctgttcttgagtatctcgcagctgaggtattggagttggcaggaaatgcagcaagagacaacaagaagaacagaataataccaagacatgtattattagcagtaagaaatgatgaagaacttggaaaacttctagctggtgtaaccattgctcatggaggtgttcttccaaatataaaccctattctcttacccaagaaatcagagaaagcagcagaaaaagcagctactaaaacccccaaatctccttccaaggcaactaaatctcctaagaaagcttaattctctttcctcttcttacccacaagaaaaagaaaatcccatcttgttttttgtatgtaaaatttgaagtgggtttatctctctccccaaactgttctctcttcttttcattgttt

SEQ ID NO: 3863 - DNA, 713 bp, Centaurea maculosa
  misc_feature (204)..(204): n is a, c, g, or t
  misc_feature (261)..(261): n is a, c, g, or t
  misc_feature (609)..(610): n is a, c, g, or t
aacaaatccattagccatttctgcaaatagcctttcagaaattatcagagagagatggacaccaccggaaaagtgaagaaaggagctgccggaaggaaggccggaggtccgaggaagaagtcggtcactcgttcggtcaaagccggtcttcagtttccggtcggtagaatcggccgttacctgaagaaaggacgttatgctcancgtgttggaaccggtgctccggtgtacctcgccgccgttctcgagtaccttgccgcngaagtgttggaattggctggaaatgcagcaagagacaacaagaagaacagaatcatcccaaggcatgtgttgttggccatcaggaatgatgaggagcttggaaaattgttggctggtgtaacaattgctcatggaggtgttcttccaaacatcaacccaattctgttgccaaagaagactgccaccaaggagcctaaatctccatccaaagctgcaaaatcaccaaagaaagctgctgcctagatgaatgaatgtctgattagattatagtgctttggtatctgtaattgttttgggtaatttgaaatagagtagttggttataaacttaatcctaatgttgataagnngttgttttgtcagttagctgttttagcctaaaacaggactcagttgtgtttcttttgcgcaattgttttggagatgatatttttaagcaatacgttttatatt

SEQ ID NO: 3864 - DNA, 686 bp, Lactuca sativa
tggcggggatatcacttgttttcatacccataaatcacttgtcttctaagccaaaaagagaaatggaaaccaccggaaaagctaagaagggtgccggaggaaggaagggcggtggcccaaggaagaagtctgttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagttggcaggaaacgccgcgagggacaacaagaagaccagaatcatcccaagacatgttcttttggccatcaggaacgatgatgaacttggaaaacttttgggtggagtgactattgctcatggtggtgttcttccaaacatccacgctgttctattgcccaagaagtctgctacaacagagcctaaatcaccatcgaaggctgcaaagtcaccaaagaaagcagctaaaactccaaagaaagctgaataggctatggtagtttggttgttgttcatctgtgtgtgtatttgtcgttaaattacatatggagtttagtattctaaccattccgtttgtttagactatcgatcgtatgttaccacctctctgtttatcaatggaagaaaccacttgtttctattctca

SEQ ID NO: 3865 - DNA, 742 bp, Lactuca sativa
acgcagagtggccattacggccgggaagcagtggtatcaacgcagagtgcccattacggccggggatatccttgttttcatacccataaatcacttgtcttctaagccaaaaagagaaatggaaaccaccggaaaagctaagaagggtgccggaggaaggaagggcggtggcccaaggaagaagtctgttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagttggcaggaaacgccgcgagggacaacaagaagaccagaatcatcccaagacatgttcttttggccatcaggaacgatgatgaacttggaaaacttttgggtggagtgactattgctcatggtggtgttcttccaaacatccacgctgttctattgcccaagaagtctgctacaacagagcctaaatcaccatcgaaggctgcaaagtcaccaaagaaagcagctaaaactccaaagaaagctgaataggctatggtagtttggttgttgttcatctgtgtgtgtatttgtcgttaaattacatatggagtttagtattctaaccattccgtttgtttagactatcgatcgtatgttaccacctctctgtttatcaatggaagaaaccacttgtttctattctca

SEQ ID NO: 3866 - DNA, 671 bp, Lactuca sativa
cacttgttttctacccataaatcacttgtcttctaagccaaaaagagaaatggaaaccaccggaaaagcgaagaagggtgccggaggaaggaagggcggtggcccaaggaagaagtcggttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagttggctggaaatgctgcaagggacaacaagaagaccagaataatccctagacacgtccttttggccatcaggaacgacgatgaacttggaaagctgttgggcggagttaccattgctcatggtggtgttcttcccaacatccacgccgtgttattgcccaagaagtctgctacaacagagcctaaatccccatcgaaggctgcaaagtcaccaaagaaagcagcaaaaactccaaagaaagctgaataggctaccgtagtttggttgttgttctgctgcgtgtgtatttgtcgttaaattacatatggagtttagtgttctaaccattgtgttcgtttagactatcgatcgtatgttactacctctctgtttatcaatggaagaaaccgcttgtttctatttc

SEQ ID NO: 3867 - DNA, 679 bp, Lactuca sativa
ggatatccttgttttcatacccataaatcacttgtcttctaagccaaaaagagaaatggaaaccaccggaaaagcgaagaagggtgccggaggaaggaagggcggtggcccaaggaagaagtcggttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagttggctggaaatgctgcaagggacaacaagaagaccagaataatccctagacacgtccttttggccatcaggaacgacgatgaacttggaaagctgttgggcggagttaccattgctcatggtggtgttcttcccaacatccacgccgtgttattgcccaagaagtctgctacaacagagcctaaatccccatcgaaggctgcaaagtcaccaaagaaagcagcaaaaactccaaagaaagctgaataggctaccgtagtttggttgttgttctgctgcgtgtgtatttgtcgttaaattacatatggagtttagtgttctaaccattgtgttcgtttagactatcgatcgtatgttactacctctctgtttatcaatggaagaaaccgcttgtttctattttca

SEQ ID NO: 3868 - DNA, 676 bp, Lactuca sativa
cgcggggatattccttgttttctacccataaatcacttgtcttctaagccaaaaagagaaatggaaaccaccggaaaagcgaagaagggtgccggaggaaggaagggcggtggcccaaggaagaagtcggttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagctggctggaaatgctgcaagggacaacaagaagaccagaatcatcccaaggcacgtccttctggccatcaggaacgacgatgaacttggaaaactgttgggcggagttaccattgctcatggtggcgttcttcccaacatccacgctgttctattgcccaagaagtctgctacaacagagcctaaatctccatcgaaggctgcaaagtcaccaaagaaagcagccaaaactccaaagaaagctgaataggctaccgtagtttggttgttgttcatctgtgtgtatttgtcgttaaattacatatggagtttagtgttctaaccattgcgtttgtttagactatcgatcgtatgttaccacctctctgtttatcaatggaagaaaccacttgtttcta

SEQ ID NO: 3869 - DNA, 675 bp, Lactuca sativa
cggggatattccttgttttcatacccataaatcacttgtcttctaagccaaaaagagaaatggaaaccaccggaaaagcgaagaagggtgccggaggaaggaagggcggtggcccaaggaagaagtcggttactcgatccgtcaaagctggtctccagtttcccgttggtagaattgggcgttaccttaaggtcggacgctatgctaaacgtgttggaaccggtgctccggtctacctcgccgctgttcttgaataccttgccgctgaagtgttggagctggctggaaatgctgcaagggacaacaagaagaccagaatcatcccaaggcacgtccttctggccatcaggaacgacgatgaacttggaaaactgttgggcggagttaccattgctcatggtggcgttcttcccaacatccacgctgttctattgcccaagaagtctgctacaacagagcctaaatctccatcgaaggctgcaaagtcaccaaagaaagcagccaaaactccaaagaaagctgaataggctaccgtagtttggttgttgttcatctgtgtgtatttgtcgttaaattacatatggagtttagtgttctaaccattgcgtttgtttagactatcgatcgtatgttaccacctctctgtttatcaatggaagaaaccacttgtttcta

SEQ ID NO: 3870 - DNA, 851 bp, Coffea canephora
cggccggggggggggaaatacagaaaagagaaaaagatctcgactgtgcttttaagtacctattgatgtgagactagtctcatatttcccggccggtctactactcgcagtctaatttcggggggccattgtgagttgagagttgagattagggagaaaatggagagcgcaggtggaaaagtgaagaaaggagctggtggaaggaaagggggcggtccaaagaagaagccagtgtcccggtccgtgaaggccggtttgcaattccctgtcggcaggatcgggcgttacttgaagaagggtcgctactctgagcgtgtgggaaccggcgctcctgtctacatggctgccgtcctcgagtaccttgccgccgaggttctggagttggctggaaatgctgcaagagacaacaagaagaacaggatcataccgcggcatgtgttattggctgtgaggaatgatgaagagcttgggaaacttctagctggtgtgactattgctcatgggggagtgcttcccaacatcaatccagttctccttccaaagaagaatgaaaaggcagcaaaggagcctgttaagtctccagctaaggccacaaagtcacccaagaaggcctaatctgtcattcgtgaataagaggacttgtcgtcctgtgaatttctttgtatgtagttcctgtatctgttggtcgtatgtagaagagggtcagagatttttagaatttaggattgactgttgcttctgatggtcccaaattcttggattatgatgaatgaaacgaatttttagcttattaaaacacattcagtttcctgtgcgcgtattaatgtgaaagatctttacatttgacttcc

SEQ ID NO: 3871 - DNA, 654 bp, Solanum melongena
atcgtctctccgacaatcaattttctcttacaatcaatcaattgttgaaatggagtctaccggaaaagtgaagaagggtgccggcggcagaaagggaggtggcccaaagaagaagcctgttacccgttctgtcaaggccggtcttcagttccccgtcggtcgaattggacggtacttgaagaaaggtcgatacgctcaacgtgttggttctggtgctccggtttacttggccgccgttcttgaatatttggctgctgaagtattggaattggctggaaatgctgctcgtgataacaagaagaacagaatcattccaaggcacttgcttttggctgtgaggaatgatgaagaattagggaaacttcttgctggtgtgacaattgcacatggtggtgttcttccaaacatcaacccagttttgttgccaaagaagactggagctgagaaggcacctaaatctccatctaaagctacaaagtctcccaagaaggcttagatttgataactgtttctctttgtatgtaattctgttgttagaatgtgcttgttgattgtctttgtccttcagggatattacagaaggatttaattgggattactgttagatctttttagatttttctctgttatcaatcaatgaaacctcttgtttcc

SEQ ID NO: 3872 - DNA, 670 bp, Panax ginseng
ttttctctttctctctccagattccggctgtctgtataatttcttctctttcttccatatctcaacgactcattgagatacaatggagactggtggaaaattgaagaaaggtgccgccggcaggaaaggaggcggtcccaagaagaagccggtgtcccgctccgtcaaggccggcctacagtttcccgttggaagaatcggccgatacctcaagaagggccgatacgctcagcgagtcggtaccggagctccggtctacctagccgccgttcttgagtaccttgctgctgaggttcttgagttggctggaaatgcagcaagagacaataagaagaacaggataataccgaggcatctgctattggctgtgaggaatgatgaggaacttggaaagctccttgctggtattacaattgctcatggaggtgtgcttccaaacattaacccggttctgttaccaaagaagtctgagaaggcagccaaggaacctactaagtctccctcaaaggcaactaaatcccctaagaaagcttaggttttagctatgaattaatatatctggtcatctgcctggatgtggtggggggtttctaggtgctctcttggtatgtaatttcggttgcccgttggtttaaagaatagggtgaattgggagctttccccttttgta

SEQ ID NO: 3873 - DNA, 743 bp, Persea americana
attttcccaactcgagacttgagcgataatttggcgagaaatcggagagatggagggaggcgggaaggtgaagaagggagtggcagggagaaaaggtggcggcccgaagaagaagccggtatccagatcagtcaaagccggtctgcagttcccggttggaagaatcggccgatatctgaagaagggacgatattctcagcgagttggaaccggggctcctgtgtatctagcggctgtgcttgaatatctcgcagctgaggtactggaattagctgggaacgctgcacgcgataacaagaagaacaggattatccctaggcacgtgctcctggccgtaaggaacgacgaggaactcgggaagcttctagcaggagtgaccatagcccatggtggggttattcccaacatcaacccagtcctcctccccaagaaaactgctgaaaaagccgccaaagagcccaagtcacctgcaaaagcccctaaatcccctaagaaagctgcttgacatcattttaagtcatcttctttactgttctctctcatcaagcccttgtgtaattgtgggttactttactttgttgtgtagatttgaattaggggatgggagattcaagaaattgaaagtagctttttttcattcttctatgtttctgtttctttagaacctaatgacagtggttttaacttgttaatttcttggagatctttgtgtgtgatttgagccttttagctattttgattga

SEQ ID NO: 3874 - DNA, 696 bp, Persea americana
  misc_feature (15)..(15): n is a, c, g, or t
ttttcccaactcganacttgagcgataatttggcgagaaatcggagagatggagggaggcgggaaggtgaagaagggagtggcagggagaaaaggtggcggcccgaagaagaagccggtatccagatcagtcaaagccggtctgcagttcccggttggaagaatcggccgatatctgaagaagggacgatattctcagcgagttggaaccggggctcctgtgtatctagcggctgtgcttgaatatctcgcagctgaggtactggaattagctgggaacgctgcacgcgataacaagaagaacaggattatccctaggcacgtgctcctggccgtaaggaacgacgaggaactcgggaagcttctagcaggagtgaccatagcccatggtggggttattcccaacatcaacccagtcctcctccccaagaaaactgctgaaaaagccgccaaagagcccaagtcacctgcaaaagcccctaaatcccctaagaaagctgcttgacatcattttaagtcatcttctttactgttctctctcatcaagcccttgtgtaattgtgggttactttactttgttgtgtagatttgaattaggggatgggagattcaagaaattgaaagtagctttttttcattcttctttgtttctgtttctttagaacctaatgacagtggttttaacttgttaatttct

SEQ ID NO: 3875 - DNA, 462 bp, Brachypodium distachyon
cggagccggcggcaaggcgaagaagggagccgtcgggaagaagctcggcgggccgaggaagaagtccgtgacgcggtccgtcaaggccgggctccagttccccgtcggccgcatcggccggttcctcaagaagggccgctacgcccagcgcgtcggctccggcgcccccgtctacctcgccgccgtcctcgagtacctcgccgccgaggtgctcgagcttgccgggaacgcggcgagggacaacaagaagacgaggatcatcccgcgccacgtgctgctggcgatccgcaacgacgaggagctcgggaggctactgggcggtgtcaccatcgcgcacggcggcgtgctgcccaacatcaacccgctgctgctgcccaagaaggcggccgagaaggccggcaccgagaaggtggccgccaagtcccccaagaagcccgccggcaagtcgcccaagaaggccgc

SEQ ID NO: 3876 - DNA, 711 bp, Brachypodium distachyon
atcacccccacatctccaaatccccaatctagcatctctcaccaaatcaatcttccccgccgcaaagagcgtttgttggaagccatggaagtctcaagcaccccagccgggaagggtaagaagggagcggccgggaggaaggtcggcggccccaggaagaaggccgtgacgcgatccgtcaaggccgggctccagttccccgtcggccgcgtcgggcgactcctcaagaagggccggtacgcccagcgcgtcggctcaggcgcccccgtctacctcgccgccgtcctcgagtacctcgccgctgaggtgctggagcttgccgggaacgccgcgagggacaacaagaagagccgcatcatcccccgccacgtgttgctcgccatcaggaacgacgaggagctcggaaagctgctcgccggcgtcaccattgcccacggtggcgtgctgcccaacattcacaccgtgcttctccctaagaagaccgcggagaaagcccccaaggaggctaaggagcccaagtccccgaagaaagccgccacccctaagaaggcagccaagtcccctaagaaggcttagatagattccatggcttggcttaagctctagttgttcatagtgagatgttggtgttcctctagctatgtgggggtaaagcccgtgatatgtgtaactgtgttaatgaagaacatcagacatcgttctgatctgcct

SEQ ID NO: 3877 - DNA, 628 bp, Brachypodium distachyon
tccaaatccccaatctagcatctctcaccaaatcaatcttccccgccgcaaagagcgtttgttggaagccatggaagtctcaagcaccccagccgggaagggtaagaagggagcggccgggaggaaggtcggcggccccaggaagaaggccgtgacgcgatccgtcaaggccgggctccagttccccgtcggccgcgtcgggcgactcctcaagaagggccggtacgcccagcgcgtcggctcaggcgcccccgtctacctcgccgccgtcctcgagtacctcgccgctgaggtgctggagcttgccgggaacgccgcgagggacaacaagaagagccgcatcatcccccgccacgtgttgctcgccatcaggaacgacgaggagctcggaaagctgctcgccggcgtcaccattgcccacggtggcgtgctgcccaacattcacaccgtgcttctccctaagaagaccgcggagaaagcccccaaggaggctaaggagcccaagtccccgaagaaagccgccacccctaagaaggcagccaagtcccctaagaaggcttagatagattccatggcttggcttaagctctagttgttcatagtgagatgttggtgttcctctagctat

SEQ ID NO: 3878 - DNA, 672 bp, Gossypium hirsutum
gaaaatttcactgcgagattcatatcgggtttcaactcttttcctccaatttgcacttgaagtgatggataccggatcaaaggtgaagaaaggagccggaggaaggaaaggcggcggtccaaagaagaaaccggtttctcgttcagtgaaagccggattacagtttcccgtcggtcgaattggccggtacttgaagaaagggcgatactctcaacgtgtgggaacgggtgctccagtttaccttgctgctgttcttgaatacctagctgctgaggttcttgagttagctggcaatgctgcaagagacaacaagaagaataggatcattccaaggcatgttctattggcagtgaggaacgatgaagaacttgggaagcttttagctggtgtgaccattgctcatggtggtgttttgcccaatattaacccagttcttttaccaaagaaaaacgaaaaggtggcgaccaaggagcctaaatcgccatccaaggctaccaagaagtctcctaagaaggcttagtttcatttatttgattatgtatttagtttcctctgtgtaggaaaatgttaatgttggtaatgtaggaatttagggccattgtatttctgaaatctaatttcccagtgttgtttcgaataggtttgtttgaaatgaatgaatggaattcagat

SEQ ID NO: 3879 - DNA, 770 bp, Gossypium hirsutum
agtctccaaatccgtaagccaaatgtctcccatttttctcacttcgcatataaattgaactaatttccaacacgaaatcacaaacattttctcgagaaaatttcactgcgagatttcatatcggattttcaagtcttttcctccaatttgcacttgaagtgatggataccggatcaaaggtgaagaaaggagccggaggaaggaaaggcggcggtccaaagaagaaaccagtttctcgttcagtgaaagccggattacagtttcccgtcggtcgaattggccggtacttgaagaaagggcgatactctcaacgtgtgggaacgggtgctccggtttaccttgctgcagttcttgaatacctagctgctgaggttcttgagttagctggtaatgctgcaagagacaacaagaagaataggatcattccaaggcatgttctattggcagtgaggaacgatgaagaacttgggaagcttttagctggtgtgaccattgctcatggtggtgttttacccaatattaacccagttcttttaccaaagaaaaacgaaaaggtggcgaccaaggagcctaaatcgccatccaaggctaccaagaagtctcctaagaaggcttagtttcatttatttaattatgtatgtaatttcctttgtgtaggaaaatgttaatgttggtaatgtaggattttagggccattgtatttctaaagtctaatttcccagtgttatttcgaataggttttgtttgaaatgaatgaatgaaattcagat

SEQ ID NO: 3880 - DNA, 908 bp, Actinidia deliciosa
  misc_feature (413)..(413): n is a, c, g, or t
cgagtttgtatctcttgattctcatctatacttttacgcgagggtagaatcgacatttcgagatggagactggcggaaaaccgaagaagggggccgccgggaggcggggaggcggtccgaagaagaagcctgtgtcccggtccgtgaaggcaggtctgcagttcccggtcggcaggatcggccggtacttgaagaagggtcgatacgctcagagggtcgggactggagctccggtctatatggctgccgtgctcgaatacctagcagctgaagtactggagttggctggaaacgcagcccgagacaacaagaagaacagaatcataccaaggcacgttctgttggccataaggaacgacgaagagcttgggaagctgttggctggagtgaccatcgcacacggtggagtgctncccaacataaacccagttctgttgcccaagaagaccgaaaaggcctccaccaaggaacccaaatctccctccaaggccaccaagtctcccaagaaagctgtttagttttttgctcaacccagtctcaggttttgcgtgtaatttgggctttgggacttttgtttcgttgctgggtaggccgaattgctggaaaaagtataaattattgcaatcctaatttaggagttttcagtttgatcaatggatgaaagtgaaactacccatttcactttctattttgcgctcagttttcttattgggtcttcgctttttcgtgcgtgtgttataagccattcatagggtcgttcagcttggtgggtattttagttgcatacttgttccaaggagaatttcaaatcacgggtaatttgaaagagtaatattgtgacgggggacccaaaatcaaaatatcactctcatggaatctaaactgtccgtggaataaaatgcctctct

SEQ ID NO: 3881 - DNA, 755 bp, Actinidia deliciosa
tctgtatccgttatattcttttgagcggggggtagaatcatcatttcgagatggatgctggcggaaaagcgaagaagggggccgccggtaggcgcggaggcggtccgaagaagaagccggtgtcccggtccgtcaaggcgggtctgcagttcccggtcggcaggatcggccggtacttgaagaagggtcgatacgcccagagggtcggtaccggagctccggtctacatggccgccgtgctcgaatacctagcagctgaagtactggagttggctggaaacgcagcccgtgacaacaagaagaacagaataataccaaggcacgttctattggccataaggaacgacgaagagcttgggaggctgttggctggagtgaccatcgcacatggcggagtactgcccaacataaacccagtgctgttgccgaagaagaccgataaggctgccaccaaggaacccaaatcaccctccaaggccaccaagtctcccaagaaagctgcttagttttgctcaatccagtctcagttactgtatgtaatttgtgcttttaggacttttcttttgttgttgtgtaggcctaattgctggaagaaaacaaagaggtgaaaatatcattgtaatcctaatttaggtgttttcagattgatcaatggatggaagtgaaaccatccgtttcacttcctattttgcgctaactcttctcttctttacgcgcatgcacacatatataataaaatataacccccattaatt

SEQ ID NO: 3882 - DNA, 783 bp, Medicago truncatula
acaacaattagaattatcaccacttaaaagcttccatttcacaccgaattcgtagcaaaaaagttagggttccaaattccaatctcagaaatggacgcaagcaccaagacgaagaaaggagctggtggaaggaaaggtggaggaccaaggaagaagtctgtgaccagatccatcagagctggtcttcaatttccagttggaagaatcggtcggtacttgaagaaaggaagatacgctcagcgtgttggtactggtgctcctgtttacctcgccgctgttcttgaatatcttgctgctgaggttcttgaattggctggaaatgcggcacgtgataacaagaagaataggataattccaaggcacgtgttgttggcagtgaggaatgatgaagagctaggaaaattattagctggagttacaattgcacatggtggtgttcttccaaacatcaaccctgtgcttttgcctaagaagactgaaaggtctaacactgttagcaaggaaccgaagtctcccaagcctaaggctggaaaatctccaaagaaggcttagatttaggtttcttatggttgatgtttattttgtgtgtataattccgctttaggttggtgttttgtaactggaaggtgtaatgcgtttgaagtgatgtaatttggaagcctctggcttcttttttagtattaatgtgaactttcagtagaaataatatttggcttaaattgtctatggagtttgattacaatgtgtatgacgtttgtgtagttttctttacttttgttctca

SEQ ID NO: 3883 - DNA, 732 bp, Medicago truncatula
attatggccggggacaacaattagaattatcaccacttaaaagcttccatttcacaccgaattcgtagcaaaaaagttagggttccaaattccaatctcagaaatggacgcaagcaccaagacgaagaaaggagctggtggaaggaaaggtggaggaccaaggaagaagtctgtgaccagatccatcagagctggtcttcaatttccagttggaagaatcggtcggtacttgaagaaaggaagatacgctcagcgtgttggtactggtgctcctgtttacctcgccgctgttcttgaatatcttgctgctgaggttcttgaattggctggaaatgcggcacgtgataacaagaagaataggataattccaaggcacgtgttgttggcagtgaggaatgatgaagagctaggaaaattattagctggagttacaattgcacatggtggtgttcttccaaacatcaaccctgtgcttttgcctaagaagactgaaaggtctaacactgttagcaaggaaccgaagtctcccaagcctaaggctggaaaatctccaaagaaggcttagatttaggtttcttatggttgatgtttattttgtgtgtataattccgctttaggttggtgttttgtaactggaaggtgtaatgcgtttgaagtgatgtaatttggaagcctctggcttcttttttagtattaatgtgaactttcagtagaaataatatttggcttaaa

SEQ ID NO: 3884 - DNA, 757 bp, Helianthus annuus
gcccttagcgtggtcccggccccaggtacgcggggaccgccatcaaatcaaaacccaaaacaaaacaaactcacaaccaaaccaaatccttttagagatggagtcaaccggaaaggtgaagaagggagccgcaggaaggaaagccggcggtccaaggaagaaggcggtcacccgttcagtcaaagccggtcttcagttcccagtcggtagaatcggccggtttttgaagaaaggacgttatgctcaacgtgttggatccggtgcaccggtttaccttgctgctgtccttgagtatctagcagcagaagtgttggagttggctggaaatgcggcaagggacaacaagaagaacagaataatcccgagacatgtgttgttggccattaggaatgatgaggagcttggaaagcttttggctggagttaccatcgctcacggtggtgttttgcctaacattaacccgattcttttgcccaagaagactgccgctaaagagcctaagtctccatcgaaggctgctaaatcccccaagaaagcaaagtagtttaatgtagactttgttgtaattgtttgtttgtttgtttgttttgtggtggttttagaatagtttgtgtttacatgtattgtattcaacctagagaatgaaatcgcttgtttctgttttgggtagattattgtgttaatctcttttatgtttagtgagtttgattataatttttgtgatgatagacatgaatataatcagattttgaccaaa

SEQ ID NO: 3885 - DNA, 681 bp, Camellia sinensis
gatttctcggctgtttgttttctcgggaaactagtttcctgactggaaatcctgagaaaatggagaaggtcaagaaaggtgcaggtggaagaaagggcggcggtccgaagaagaaacccgtttcccggtccgtcaaagccggcctccagttcccggtcggccggatcggccgatacttgaagaaaggccgctactctcagcgcgtcggaaccggcgctccggtctacctcgccgccgtgctcgagtacctcgctgctgaggttttggaattggctggcaatgctgcaagagacaacaagaagaacaggatcataccaaggcacgtgcttttggctgtgaggaacgatgaggaacttggaaagttacttgcagtcgtgactattgctcatggaggggtgcttcccaacatcaaccccgttcttcttccaaagaaaagtgagaaggctgcaaaggagccaaagtctccgaccaaggcagccaagtcacctaagaggaaagcttaacttctcagagtgttgaagaaagccttatctgctcttagttatttctctgtatatgtatttcgttttctgttgtgttatgtaggaaatcttcttgttgtaaggaactattgcagtctttgtttcaaatcgttattatgacatctttgtttgaaatcaaagaaattaaattcctagttgc

SEQ ID NO: 3886 - DNA, 701 bp, Camellia sinensis
tatcggccattacggccggggatttctcggctgtttgttttctcgggaaactagtttcctgactggaaatcctgagaaaatggagaaggtcaagaaaggtgcaggtggaagaaagggcggcggtccgaagaagaaacccgtttcccggtccgtcaaagccggcctccagttcccggtcggccggatcggccgatacttgaagaaaggccgctactctcagcgcgtcggaaccggcgctccggtctacctcgccgccgtgctcgagtacctcgctgctgaggttttggaattggctggcaatgctgcaagagacaacaagaagaacaggatcataccaaggcacgtgcttttggctgtgaggaacgatgaggaacttggaaagttacttgcagtcgtgactattgctcatggaggggtgcttcccaacatcaaccccgttcttcttccaaagaaaagtgagaaggctgcaaaggagccaaagtctccgaccaaggcagccaagtcacctaagaggaaagcttaacttctcagagtgttgaagaaagccttatctgctcttagttatttctctgtatatgtatttcgttttctgttgtgttatgtaggaaatcttcttgttgtaaggaactattgcagtctttgtttcaaatcgttattatgacatctttgtttgaaatcaaagaaattaaattcctagttgc

SEQ ID NO: 3887 - DNA, 503 bp, Artemisia annua
aatcacacactcactaaaacacacacacattcttcatcattttaaaaaaaaaaaaaatggagggaaccggtaaaatcaagaagggagcagcaggaaggaaagccggtggaccgcgaaagaagtccgtcactcgatctgtgaaagccgggcttcagtttcccgttggtagaattggaaggtatttgaagaaaggtcgttatgctaagcgtgttggtactggtgctcctgtttatcttgctgcggtcctcgaatatctcgcagctgaagttttggaattggcgggaaatgcagctagggacaacaagaagactaggattattccaagacatgtgttgttggcgattaggaacgatgaagagcttggaaagttgttgtctggtgttacgattgcgcatggtggtgttttgcccaatattaacccggtcttgttgcctaagaaaactgctgctaaagaaccaacaccaaagtctccatcgaaagctggaaaatcgccaaagaaagca

SEQ ID NO: 3888 - DNA, 695 bp, Jatropha curcas
ggctgtacgataaacatcatatttttctctctctctctcttaaacgggtcggactttctgcggacatggacgccggagctaaagtcaaaaagggtgccggtggtaggaagggtggaggcccgaagaagaagcctacttctaggtccgttaaggctggccttcagtttcccgttgggaggatcggtcgttacctgaagaagggaaggtatgcgcagcgggtcggatccggagctcctgtttacttggctgctgtgctcgagtacctagctgctgaagtacttgagttggccggtaatgctgccagagataataagaagaatagaataataccaaggcatgtattgcttgccgttaggaatgatgaagagcttggaaagttgcttgcaggagtgacaattgctcatggaggtgttcttcccaatattaaccctgttctattgcccaagaagtcagagaaggcagcaactaaggaacccaagtctccatccaagggaacaaagtctccaaagaaagcttaggccattccagttattattctcttatgctcttgttgtatgtagttttgccatattttgttaatttgtaggacgaagttgatggattttgataaaattgtgtagtcccttgatctttgtgatactatgttaggattgacatatgagattaatggatgaaactactggtttctgtttttc

SEQ ID NO: 3889 - DNA, 662 bp, Orobanche aegyptiaca
tctttcgtttcttatttttttcattttattttctgtcatttccttctccaccagacaaaaagaatggaagttagtgggaaagtgaagaagggagccgctgggaggaagattggcggcggtccgaggaagaagtcggttacccgatccgtgcgagccggtctccagtttccggttggcaggatcggccgttatctgaagaaaggccgctatgctcagcgggttggtaccggtgctcctgtctacgtggctgctgtgcttgagtatcttgctgctgaggttctggaattagctggaaatgcagcaagagacaacaagaagaacagaataattccgaggcatctgttgcttgctgtgagaaatgatgaagagcttggaaagcttcttgctggagttacaattgctcatggtggagtcataccaaatattaaccctattcttttgcctaagaagactgataaggccgctgaaaagacaactaaatccccagcgaaggccaccaagtctccaaagaaggcttaattcagcgttattgcattgtgttattgtagaggttgttatcggattcttgtaacaaattttatcgcatgagatgtgattatgaatctattttgaaacttaattgatttttttgtcgcatttaccacatttactaattaagacag

SEQ ID NO: 3890 - DNA, 793 bp, Vitis vinifera
cattcagaccgttttctccgataacttcagatccattattcccgatcacactcatcgccgccgccgaagtctgaaactgtgagaaatggagtctaccggaaaagttaagaagggggccggtggaaggaagggtggtggtcccaagaagaagccagtgtctcggtccgttaaggccggtttgcagttcccggtcggaaggattggccgttacctgaagaagggccggtactcccagcgtgtagggactggtgctccagtgtacttggctgccgtgcttgagtacctggctgcagaagtgctagagttggctggaaatgcagctcgggacaataagaagaacaggatcattccaaggcacgttctattggcagtaagaaacgacgaggaactaggaaagctgctctctggagtgaccattgctcatggaggcgttctccccaacatcaacccagtactcttgccaaagaagacagacaaggctaccaaagagcccaagtcaccttccaaggccactaagtctcccaagaaggcttaaccattgcagctacgcccttttccatttgtatgtaatgtgggtttagaagtcctcttctttcttttgttcatgtttagggaggagtcaggaattgaaaacattgtacttcttgaaactcttaatgttatttcttttaggattttctctttgaatcaatggatgaaacccctagttttgcccaaaagcttcaagacccttctctttgacgccattatcttttcgtatggtgagtgttgtcatggggagattggtttgtga

SEQ ID NO: 3891 - DNA, 637 bp, Antirrhinum majus
gcggccgcactcaaatcttctctgttcttcaatatctcaacaacaaatggaagctggtggtaaattgaagaagggagctggaggcagaaagggcggtggaccgaagaagaaaccggtgacccggtccgttcgagccggtctgcagtttccggtcggcagaatcggccggtacctgaagaaggggaggtacgctcagcgtgtcgggaccggagctccggtttacatggcggctgtgctggagtaccttgctgctgaggtgttggagttagctggaaatgcagctagggacaacaagaagaacaggattattccgaggcacgttctgcttgctgtgaggaacgacgaggagcttgggaaactgttggctggagtgacgattgctcacggtggagtcttgccgaacatcaacccggttcttctgcctaagaagtcggagaaggccacaactgagaaggcgacgaagtctccatcaaaggctaccaaatcgcctaagaaggcttagtttataagctgtgttgttgtgttgtggaactgaatgatgtggttgttttatggttaggaaatgtggtgtataaaatgtagtttcgttctccttcaaactgttctgatttggatttaatggagaaattgttagcgg

SEQ ID NO: 3892 - DNA, 634 bp, Hordeum vulgare
aaacacaagacactcccgccttctccgcacctccaatcctgaaatctacccgccatggacgcatcaaccgccggcgccgtctccaaggcgaagaagtacgtggtggggcgcaagctcggcggcggccccaggaagaaggcggtggcgcggtccgtcaaggccgggctgcagttccctgtcagccgcatcgcccgcttcctcaagaagggccgctacgcgcagcgcgtcggcacgggcgcccccgtctacctcgccgccgtcctcgagtacctcgccgccgagcttcttgagctggccgggaacgccgccaaggacaacaagaagtcccgcatcatcccgcgccacctgctgcttgcagtccggaacgacgaggagctcggcaagcttctcgccggcgtcaccatcgcgcacggcggcgtgctgcccaacatcaacccggtgctgctccccaagaagacggctgagaaggagcccaagtcgcccaagaaggccgccaagtcccccaagaaggcatagccgattactgtctagtgcttcctaatagaataagtggttgctgtttgggtaatcgtgtcgatgtagtaatgccctgttctgctttggaaaaaaaaatgtttgttcatgatttacagtg

SEQ ID NO: 3893 - DNA, 733 bp, Bruguiera gymnorhiza
ggtatcgctcatccaacatcacgtatatccattatcgttcgatcttcttatcttgtcttgtttttgctcgttttgtctgtctgtttctcgaggaaaaggaaaatagtttagcggtcttgatttggaaatatcctgggccatggatactacagcaaaagtaaagaaaggagcaggaggccggaagggaggcggtccaaagaagaagccagtgtcccgatccgtaaaggctggtttgcagttcccagttggacggattggccgatacttgaagaaaggccgatactctcagcgtgtcggaactggagctcccgtctacctcgctgccgtgctggaatatcttgctgctgaggtattggagttggcaggcaatgcagccagagacaacaagaaaaacagaatcatccccaggcatgtgctcttggctgtgaggaatgatgaggaactcgggaagcttcttgctggtgttactatagctcatggtggtgtgctgcccaacatcaaccctgtcctgctaccaaagaaatcagagaaggcaatcaaggagccaaagtcgccatccaaggccaccaagtcgccaaagaaggcttagcctagtttctattttgtctccgtacctgtaatcttcccattgtgtacgggcctatctgtacgagatctttatgtttttggaatgtaggaacatgagtagttcaatttcctagcttcagcacagaacaacctgtctattccagat

SEQ ID NO: 3894 - DNA, 742 bp, Manihot esculenta
acacactctctttcacaaacaccaaatcggcgatttccatttttaatctttatttggccagatggaaaccggagggaaagtgaaaaagggagccggagggaggaaaggtggagggccaaagaagaagcccacttctagatcggtcagggcgggtttgcagtttcccgttgggagaatcgggcggtatttgaagaaaggaagatattcgcagcgggtcggaactggggctccagtttacttggccgccgttctggagtatctagctgctgaagtgctggaattggctggaaatgcagcaagagacaacaagaagaacagaataataccaaggcatgtattgcttgctgtgagaaacgatgaagagcttggaaagttgcttgcaggtgtaacaattgctcatggaggtgtacttcccaatattaatcctgttctgttgcccaaaaagactgagaaagccaccaaggaacccaagtcaccatctaaagccactaaatctcccaagaaggcttaggccaatttcagttccctaaccattctgtcttctgtatgtaatttagggttcattgctggtttattttgtaggtaaagttgtttgaatcaatttgtagtccattagatctttgtaataccatgttaggatttgacctattaagattaatggattgaaactacttgtttcctcttctttaagaagagtagagaatatatttccttcaatatatattttttttgcttcctattt

SEQ ID NO: 3895 - DNA, 578 bp, Trifolium pratense
ttcaattccctcatcttctcaaaactcatcttcaaccaccaaaccctaatttcccaatctcgaaatggattccaccacaaacacaaagacaaagaaaggtgccgcaggaagaaaaggcggaggtccaagaaagaagtcagtcaccagatccaccagagctggtcttcaattccccgtcggaagaattggtcgttacttgaagaaaggtcgatacgctcaacgtgtcggtaccggtgctccagtttacttagccgccgttcttgaatatcttgctgctgaggttcttgagttggctggaaatgctgcacgtgataacaagaagaataggataatcccaaggcatgtgttattggctgtgaggaatgatgaagaacttggaaaattgcttgctggtgtcactattgctcatggtggtgttcttccaaatattaacccaattcttttgcctaagaagactgatagatctacttctgctagtaaggagccaaagtctccaaaagctgggaaatcaccaaagaaagcttagatctgtttgaatgaatgaatgattagtttatggattatgattgtgtatatct

SEQ ID NO: 3896 - DNA, 703 bp, Carica papaya
gcaatctcaattgaagaatccgtttttattttcagagaaaaaaaaaaaaaatcttcttctaggttttccggcgaactagtcgggttgttgtagttgagttggattgagcgtttttctactggagatggattctgcaactaaagtgaagaaaggtgcaggaggaaggaaaggaggtgggccaaagaagaagccagtttctagatctgtgaaagccggtcttcagttccccgtcggaagaattgggcggtacttgaagaaaggcagatattcccagagggttggtaccggagctccagtttacatggctgccgtcctcgaatacctagctgctgaagttctcgagcttgcaggcaatgcagctagagacaacaagaaaaacagaatcaaccctagacacgttcttctggcagtaaggaacgatgaggagctcggaaagctgcttgccggagtcaccattgcccacggcggtgttctgcccaatattaacccggtattgttgcctaagaagagtgagaaggcagctgcaaccaaggaatccaagtctccatccaaggcaaccaagtctcccaagaaggcttaggtctgaatcatcggagaccacaagttgggtgtatcttttgacttgtttagttgtatgtaattttgggtctaggacctttttactgccgttactgaatttaggaagaggggaaagtgatgaaat

SEQ ID NO: 3897 - DNA, 727 bp, Arachis hypogaea
ttccatcaccggaaaaagaaaaggaaagaaaaaaaaaagttaattaaggttctgatggacagccccgctgtaaaagggaagaaaggagctgccggaaggagaggcggtggtcccaagaagaagtcagtgtcaaggtccgccaaagccggtctccaattccccgtcggaaggatcggacgctacttgaagaaaggccgttatgctcagcgtttgggaagcggcgctccggtttaccttgccgccgttttggaatacctagttgctgaggttttggaattggctgggaatgctgctagggataacaagaagaacaggattattccaaggcatgtcctgttagctgtgaggaacgatgaagagcttggaaaactgcttgctggtgttaccattgctcatggtggtgttcttcctaacattaaccctgtgcttttgcctaagaagagtcaagctgctgctgctaaggaaccgaagtctccatctaagggcacaaagtctcctaagaaagcttaattgattatgatattttggtgttaggttacttttggtttctctttgattttaatgtatatctgttgttaggtacctttagtcttttttaggctggcaggaatatgtgatgcttgtcatggtatcctcatttggaatttatggtgaatggattattcgaaatagctctttttcatgtagcaaagattagaatttgaatgttaatgcaaattggcttatg

SEQ ID NO: 3898 - DNA, 806 bp, Arachis hypogaea
gctcaaaacactcaaacacacaagtctcgttctcattctctcacaatctctctctttttctccgcaaagaatctgcaatggacgctgcatcgaaagtgaagaagggtgccggtggcaggaagggaggcggcccaaagaagaagccagtttcacgctccgtcaaagccggtctccaatttcccgttggaagaatcggacgttacttgaagaaaggaaggtactctcaacgtgttggaaccggtgcccctgtctaccttgctgccgtattggagtatctagcagctgaggtgttggaattggctggaaatgctgcgagggacaacaagaagaataggattattccaaggcatgttcttttggctgtgaggaacgatgaagaattggggaaattgcttgctggtgttaccattgcacatggtggtgttcttcccaacattaaccctgttttgttgcctaagaagaccgctgagaaagctcccaaggaaacaaagtcaccctccaaggccactaagtctccgaagaaagcttgatttgggtgtttagtgtcaatatgtgcgtgttagatccttaatatataacttgtaacgtgaaagatcgtgatgggtttggattttggaacaacatttatgtaattgttatgtttgtgtcttatgttttagcatttttagccaatcaatagagaacatccaagtttattagtttgccatatttctttttcttttccagcgcataatgttaatattttcgcggcttgctgtcttttagcttaaagggttgaaaatgcttcgtggttttatgtttccgcc

SEQ ID NO: 3899 - DNA, 829 bp, Arachis hypogaea
tcggccttacggccgggggctcaaaacactcaaacacacaactctcgttctcattttctcacaatctctctctctttctccgcaaagaatctgcaatggacgctgcatcgaaagtgaagaagggtgccggtggcaggaaaggaggcggcccaaagaagaagccagtttcccgctccgtcaaagccggtctccagttccccgttggaagaatcggacgttacttgaagaaaggaaggtactcccaacgtgttggaaccggtgcccctgtctaccttgctgccgtattggagtatctagcagctgaggtgttggaattggctggaaatgctgccagggacaacaagaagaacaggattattccaaggcatgttcttttggccgtgaggaacgatgaagaattggggaaattgcttgctggtgttaccattgcacatggtggtgttcttcccaacattaaccctgttttgttgcctaagaaaaccgctgagaaagctcccaaggaaaaaaagtcaccctccaaggccactaagtctccgaagaaagcttgatttgggtgtttagtgtcaatatgtgcgtgttagctccttaatatataacttgtaacgggaaagatcgtgatgggtttggattttgggacaacatttatgtaattgttatgtttgtgtcttatgttttagcatttttagccaatcaatagaaacatccaagtttattagtttgccatatttctttttgtttccaattgcctaatgttaatattttcgcgtcttgttctcttttagcttaaagggctgaaaatgcttcgtggttttatgtttccgccaaagca

SEQ ID NO: 3900 - DNA, 930 bp, Populus trichocarpa
tacgcggatcggtagcactcactcatgaaccgtcgatggaaaacaatccaacagtaagaaatcgtccatccagaaaaccaaaaggttctctccatttttctctcaccaggcaggccccgtatttatctgcccccaaccccatctatgtctctcgcacaaatctaggtttctaattgtctgtgtttactgtgcctgtgagagagagacttctagcaagtagtcgttgtagtagtgatggagactggtggaaaggtgaagaaaggagcagcagggaggaaaggaggcggtccaaagaagaaaccggtgtcccgctccgccaaagccggtcttcagttccctgttggtcggatcggtcgatacttgaagaaaggccgttactctcaacgtgttggatccggagctcccgtctaccttgccgctgtgcttgagtatcttgctgctgaggttttagagctagctggaaatgcagcaagggataacaagaagaacaggataataccaaggcatgtgttgttggctgtgaggaatgatgaagaacttggaaagctacttgcaggtgtgaccatagctcatggcggggtgttgcctaacatcaatcctgttcttttgcctaagaaaaccgaaaaggcagccaaagaacccaagtcaccttccaaggccaccaagtccccgaagaaggcttagccactctacccaccactagtgatagagtatttagttttagcagtccttctttcgatatctgcttcctcgtctatgtctgtaatttgcttttgatgtgcttgccctgcttgtaggtaaatcttttactttgtgtttttcttttctaggatttatttagatccatggagttggctctttacttctactccgccatgtacaacaacatcctcgaatgaatgaaatcaattgttgtgttctaaatgttta

SEQ ID NO: 3901 - DNA, 889 bp, Populus trichocarpa
tccaacagtaagaaatcgtccatccagaaaaccaaaaggttctctccatttttctctcaccaggcaggccccgtatttatctgcccccaaccccatctatgtctctcgcacaaatctagctaggtttctaattgtctgtgtttactgtgcctgtgagagagagacttctagcaagtagtcgttgtagtagtgatggagactggtggaaaggtgaagaaaggagcagcagggaggaagggaggtggtccaaagaagaaaccggtgtcccgctccgccaaagccggtcttcagttccctgttggtcggatcggtcgatacttgaagaaaggccgttactctcaacgtgttggatccggagctcccgtctaccttgccgctgtgcttgagtatcttgctgctgaggttttagagctggctggaaatgcagcaagggataacaagaagaacaggataataccaaggcatgtgttgttggctgtgaggaatgatgaagaacttggaaagctacttgcaggtgtgaccatagctcatggcggggtgttgcctaacatcaatcctgttcttttgcctaagaaaaccgaaaaggcagccaaagaacccaagtcaccttccaaggccaccaagtccccgaagaaggcttagccactctacccaccactagtgatagagtatttagttttagcagtccttctttcgatatctgcttcctcgtctatgtctgtaatttgcttttgatgtgcttgccctgcttgtaggtaaatcttttactttgtgtttttcttttctaggatttatttagatccatggagttggctctttacttctactccgccatgtacaacaacatcctcgaatgaatgaaatcaattgttgtgttctaaatgtttaa

SEQ ID NO: 3902 - DNA, 768 bp, Camellia sinensis
ttgctcggacaaaaaaagcatcacaatagctatatagtggctgtttgtttctcgggaaaatcggtttctgactgagaaagcacaggaagaaaatggatgccggtggaaaggtgaagaaaggtgccgcaggaagaaagggaggcggtccgaagaagaaaccggtttcccggtccgtcaaagccggtttacagttcccggtcggtaggatcagccggtacttgaagaaaggccggtactctcagcgagtcggtaccggtgctccggtctatcttgccgccgtgctcgagtatctcgctgctgaggttttggaattggctggaaatgctgcaagggacaacaagaagaacaggatcataccaaggcatgtgcttctggctgtgaggaatgatgaagaacttggaaagctacttgctggagtgacaattgctcatggaggggtgctacccaacatcaatcctgttcttctccctaagaaaaatgagaaggcaacaaaggagcccaagtctccatccaaggcaaccaagtcaccaaagaaagcctaacttcttaagagtgttaaagagagagtcttgtttacttctctctgtgtatgtaatttccttttctgtttggtatgtaggaaagctagcatcatgttgttagggattgtgtactctttgtttgaatatgcttgttagcacatcagtgttggaaatcacagaaattaaattgttagtttctattcttagttgcgacagaaaaaaacatgtcggccgcctcggcctatgt

SEQ ID NO: 3903 - DNA, 794 bp, Camellia sinensis
tatcggccattacggccggggacgctttgctcggacaaaaaaagcatcacaatagctatatagtggctgtttgtttctcgggaaaatcggtttctgactgagaaagcacaggaagaaaatggatgccggtggaaaggtgaagaaaggtgccgcaggaagaaagggaggcggtccgaagaagaaaccggtttcccggtccgtcaaagccggtttacagttcccggtcggtaggatcagccggtacttgaagaaaggccggtactctcagcgagtcggtaccggtgctccggtctatcttgccgccgtgctcgagtatctcgctgctgaggttttggaattggctggaaatgctgcaagggacaacaagaagaacaggatcataccaaggcatgtgcttctggctgtgaggaatgatgaagaacttggaaagctacttgctggagtgacaattgctcatggaggggtgctacccaacatcaatcctgttcttctccctaagaaaaatgagaaggcaacaaaggagcccaagtctccatccaaggcaaccaagtcaccaaagaaagcctaacttcttaagagtgttaaagagagagtcttgtttacttctctctgtgtatgtaatttccttttctgtttggtatgtaggaaagctagcatcatgttgttagggattgtgtactctttgtttgaatatgcttgttagcacatcagtgttggaaatcacagaaattaaattgttagtttctattcttagttgcgacagaaaaaaacatgtcggccgcctcggcctatgt

SEQ ID NO: 3904 - DNA, 661 bp, Tragopogon dubius
tcaatcacttctttacatagatatacattcatagccataaagagaaatggaaaccaccggaaaagcgaagaagggtgccggaggaaggaagggaggcggcccaaggaagaagtccgtgtctagatccaccaaagctggtcttcaattccccgtcggtagggtcggacgttaccttaagatcggacgttacgctaaacgtgttggaaccggtgctccggtctacctcgccgctgttcttgaatacctagccgctgaagttttggagttggctggaaatgctgcaagggacaacaagaaaagcaggatcatccctagacatgttcttttggctattaggaatgatgaagaacttggaaagcttttgggcggagtaaccattgctcacggtggtgttcttccaaacatcaaccctgttcttttaccaaagaaatctgctgtaactgagccaaagtctccatcgaaagctgctaaatcaccaaagaaagcagcaaaatctcccaagaaaactgaataggtttatgtagtgtgagtgttgttcatctgtttgtgtatttgtagttagatttcatatggagttagttttctaacaattgcgtttgtttagatgatatttcgtatgttgttacctttgtgttcatcaatggaagaaaccacttgtttt

SEQ ID NO: 3905 - DNA, 737 bp, Theobroma cacao
  misc_feature (35)..(35): n is a, c, g, or t
  misc_feature (655)..(655): n is a, c, g, or t
cggggatccctgaattttttttttgtgaaaaaganattaactgcaagaattcatttttcctctaattctcaaattttttgagtgatggatgccggagcgaaagtgaagaaaggagccggaggaaggaaaggaggcggtccgaagaagaaaccggtttctcgctctgtaaaggccgggttgcaatttccggtcggcaggatcggtcgttacttgaagaaaggccgttactctcagcgcgtggggaccggtgctcccgtttaccttgctgctgttctcgagtaccttgctgctgaggttctggagttggctggtaatgctgcgagagacaacaagaagaatagaatcattccgaggcatgttcttttggctgtaaggaatgatgaggaacttgggaagcttttggctggtgtgaccattgctcacggtggagtcttacccaacattaacccagttcttctgccaaagaaaaatgacaaggcgccaaaggaacctaagtcgccatcgaaggctacaaagtctccaaagaagtcacctaagaaggcttagtttagtctagtctttgcttcttatttctcttgtctatgtagcttcctttgtgagctttccttgtaacaaaaatgtggatgttggtaggaatttaggaccattgtacttntaattgtctgtgttgtgtagaacatcctatgtttggaatgaatcaaatgaaatttccatgatcaaattctgtttttatgcca

SEQ ID NO: 3906 - DNA, 613 bp, Brassica napus
ctcctctcctctgttgcagatcagatcaaactcatcgtgtcgacgtaagcaggcatggattcaggaaccaaagtaaagaaaggagcgggtggaagaagaggtggtggtctgaagaagaaacctgtttcccggtctgttaaagccggtttacagttccccgtcggtaggatcggtcggtatctaaagaaaggtcgctactcgaagcgtgttggaaccggagctccggtgtatctcgccgccgttctagagtaccttgctgctgaggttcttgagcttgctggtaacgctgccagagataacaagaagaatcgtatcataccacgccatgttctgttagctgtgaggaacgacgacgagctaggaaagctactcaaaggcgtaacaatcgcacacggtggagttttacctaacataaacccagttctcctcccaaaaaagtctgcgaaagcagcttcaactacaaaagtgatcaagtcaccatcaaaggctaccaaatcccctaagaaggcatagttctcattaccatgtaaactcagttgtaaacaatgtgtaatgttcactcgttcagacaagtctggttatcgttgtaatttaaccacgataacaacgtata

SEQ ID NO: 3907 - DNA, 648 bp, Brassica napus
  misc_feature (425)..(425): n is a, c, g, or t
  misc_feature (571)..(571): n is a, c, g, or t
ttcggcacgaggcctcctctcctctgttgcagatcagatcaaactcatcgtgtcgacgtaagcaggcatggattcaggaaccaaagtaaagaaaggagcgggtggaagaagaggtggtggtccgaagaagaaacctgtttcccggtctgttaaagccggtttacagttccccgtcggtaggatcggtcggtatctaaagaaaggtcgctactcgaagcgtgttggaaccggagctccggtgtatctcgccgccgttctagagtaccttgctgctgaggttcttgagcttgctggtaacgctgccagagataacaagaagaatcgtatcataccacgccatgttctgttagctgtgaggaacgacgacgagctaggaaagctactcaaaggcgtaacaatcgcacacggtggagttttacctaacntaaacccagttctcctcccaaaaaagtctgcgaaagcagcttcaactacaaaagtgatcaagtcaccatcaaaggctaccaaatcccctaagaaggcatagttctcattaccatgtaaactcagttgtaaacaatgtgtaatgttnactcgttcagacaagtctggttatcgttgtaatttaaccacgataacaacgtataaaccctagtgcatgaaaagaaa

SEQ ID NO: 3908 - DNA, 664 bp, Secale cereale
  misc_feature (391)..(391): n is a, c, g, or t
  misc_feature (456)..(456): n is a, c, g, or t
  misc_feature (634)..(634): n is a, c, g, or t
gtgctctctccatcccaatccccacctaccgtccgctctcgcacgccatggacgccacaggcaccggcggcaaggggaagaagggcgcggccgggcgcaaagccggcggccccaggaagaagtcggtgacgcggtccgtgaaggccgggctccagttccccgtcggccgcatcggtcggtacctcaagaagggacctacgcccagcgcgtcggcaccggcgcccccgtctacctcgccgccgtcctcgagtacctcgccgccgagctgctggagctcgccgggaacgccgccaaggacaacaagaagagccgcattatcccccgccacctgctgctcgccgtcaggaacgacgaggagctcggcaagctgctggccggcgtcaccatcgcncacggcggcgtgatccccaagatcaacccggtgctgctccccaagaggacggccgagaaggaggncaaggcgcccaagtcccccaagaaggccgccaaatccccgaagaaggtcgccacaccgaagaaggcttaagagagatgcgttatgtctagttgatgatgtaccctgtttagttgtttaggctgtcttgtgttcgtctggatagtggcgtgaaggtgttctgtctagttgatgtacctngtgttgttcatgttcatggaagaaattcag

SEQ ID NO: 3909 - DNA, 679 bp, Artemisia annua
acgcagtactccgacggggaccacaacctcaaacactctcaaaacaaacactcattcatcatttttataagtaaaaaatggacgggaagaagggagcagcaggaaggaagccggcgggccacgaaagaagtcagttactcgttccgttaaagccgggcttcagtttccagttggtagaatcggaaggtatttgaagaaaggccgttacgctaagcgtgttggaaccggtgctcccgtttatctcgctgcggttcttgagtatctcgcagctgaagtgttggaattggcgggaaatgcggcaagggacaacaagaagactaggattattccgagacatgtgttgttggcgataaggaacgacgaagagcttggaaagctgttgtctggagtcacgattgctcacggtggtgtttgccgaatattaacccggtcttgttgcctaagaagactgctgctaaagaatcgacaccaaagtctcctaagaaagctgcaaagtctcctaagaagactgctgcatagattagtttgatgtaatttttaatggttagatgtaatcacttctatgtaatggaaattgattatttctgtttattctccttgtttttaatattgtatttagtctgcaaatttgataattatgattatggtttagagaataaacatgtttttttatatgtac

SEQ ID NO: 3910 - DNA, 633 bp, Cichorium intybus
atttttttctgatcatacgcgatattggagggagccggaaaagctaagaaaggtgccggaggaagaaagggaggcggtccaaggaagaaggcggtttcccgttctgtcaaagctggtctgcagtttccagttggtaggattggacgttttctgaagaacggacgttatgccaagcgtgtcgggactggtgctccggtttacctcgccgctgtacttgaatacctcgctgctgaagtgctagaattagctggaaacgccgctagggataacaagaagagcagaataattcctagacatcttctattggccataaggaacgatgaagagcttgggaaattactgggtggagttacgattgctcatggtggtgttcttccaaatataaaccctgttctattgccaaagaagacagctgccaaggagccttcaactccatctaaagctgccaaatctcccaagaaagctaaaaatgctgagtagattagttgtttgaatcgtatctttttgttctggttcacaagattagtgtatttagcgtttacgaaaaaatgaactagcttgggaagaattgtatttcaatgatgtatttttaccaaaatacgtaatgataaacacccaaaatagattacaaaa

SEQ ID NO: 3911 - DNA, 580 bp, Cucumis sativus
aaaaccattcccgcaagttcaatccttctcatcgtcatatccactcacccaattccattttcttctcctacccttttgattttacggtgacccgactctagttcccatggaaaccggcggcaagttgaagaagggagctggtggaagaaagggcggtggcccgaagaagaagccggtttcgcgttccgttaaggccggcctccagttccccgttggtaggatcggtcgatacttgaagaatggacgatatgctcgtcgtgttggtactggagctcctgtctacttggccgccgttcttgagtatcttgccgctgaggtgttggaattggctggaaatgcagccagagacaacaagaagaacagaataattcctagacatgtattgttggccataaggaatgatgaagaacttgggaaattgcttgctggtgtaacaattgcacatggtggtgttcttccaaacataaacccagttcttttgccaaagaaaagtgagaaagcaactactaaagaaccaaaatctccatcaaaggctcctaaagcaactaaatctccaaagaaagcttagattttttttttt

SEQ ID NO: 3912 - DNA, 729 bp, Hordeum vulgare
cgcaaaacaaatcctcccccgagcagcgaatcccaggagcatcacctgctaccagcaatggacgtctccggcgctgcagcgaaggggaagaagggcgcggccgggcgcaaggccggcggcccgaggaagaagtcggtgacgcggtccgtcaaggccgggctccagttccccgtcggccgcatcgggcgctacctcaagaagggcagatacgcccagcgcgtcggcaccggcgcccccgtcttcctcgccgccgtcctcgagtacctcgccgccgagctgctggagctcgccgggaacgccgccaaggacaacaagaagagccgcatcatcccgcgccacctgctgctcgccgtcaggaatgacgaggagctcggcaagctgctggccggcgtcaccatcgcgcacggcggcgtgatccccaagatcaacccggtgctgctccccaagaggaccgcggagaaggagggcaaggagcccaagtctcccaagaaggccaccaagtcccccaagaaggccaccaaggcttagagcgatgcgttccatatcgtagattgttgcagtgctcttcgtagtcgcccggtggtgttcctgtagcggtgtcgttttatcttgtagtaatgtgcatgtttaatggaagaacgtcagaaatctctctggcttgcccaaatattctgccgccccttcttatctctgatttgccaaattattgcttaaaaaaaaaaaaaaaaa

SEQ ID NO: 3913 - DNA, 733 bp, Hordeum vulgare
cggcacgaggcaatctcccatcgcaaaacaaatcctcccccgagcagcgaatcccaggagcatcacctgctaccagcaatggacgtctccggcgctgcagcgaaggggaagaagggcgcggccgggcgcaaggccggcggcccgaggaagaagtcggtgacgcggtccgtcaaggccgggctccagttccccgtcggccgcatcgggcgctacctcaagaagggcagatacgcccagcgcgtcggcaccggcgcccccgtcttcctcgccgccgtcctcgagtacctcgccgccgagctgctggagctcgccgggaacgccgccaaggacaacaagaagagccgcatcatcccgcgccacctgctgctcgccgtcaggaatgacgaggagctcggcaagctgctggccggcgtcaccatcgcgcacggcggcgtgatccccaagatcaacccggtgctgctccccaagaggaccgcggagaaggagggcaaggagcccaagtctcccaagaaggccaccaagtcccccaagaaggccaccaaggcttagagcgatgcgttccatatcgtagattgttgcagtgctcttcgtagtcgcccggtggtgttcctgtagcggtgtcgttttatcttgtagtaatgtgcatgtttaatggaagaacgtcagaaatctctctggcttgcccaaatattctgccgccccttcttatctctgatttgccaaattattgctt

SEQ ID NO: 3914 - DNA, 874 bp, Cucumis melo
aaaatcatttccgcaacttcaatccttctcatcgtcatatccactcacccaattccattttcttctcacacccttttgatttttacggccaccccactctagttccgatggaaaccggcggcaagttgaagaagggagctggtggaagaaagggcggcggcccgaagaagaagccggtttcgcgttccgttaaggccggcctccagttccccgttggtaggatcggtcgatacttgaagaatggccgatatgctcgtcgtgttggtactggagcacctgtctacttggccgccgttcttgagtatctcgccgctgaggtgttggagttggctggaaatgccgccagagacaacaagaagaacagaataattcctagacatgtattgttggccataaggaatgatgaagaacttgggaaattgcttgctggtgtaacaattgcacatggtggtgttcttccaaacataaacccagttcttttgccaaagaaaagtgagaaagcaactactaaagaaccaaaatctccatcaaaggctcctaaagcaactaaatctccaaagaaggcttaggttttttcttttttacttttttttttcctccatctgaaaaaaaactttgacttgttctttgcccatttgtatgtagtttgttggctttttaggatcttcttctgtgttgtttatcaaatgtaagctccaaaactgatgaatttgatgaatttggagactctgtatcactcctcatcatcttgatgattaaactttgtattggttatgatttgtttaggccatcgatttgctttcttcaatctgctaatctttgtttggtttaatggatgaggatggaagaatggagatatttggtcaattgacct

SEQ ID NO: 3915 - DNA, 676 bp, Saccharum officinarum
aaccccaatcatcacttccttccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctggccgccgtcctcgagtacctcgccgccgaggtcctggagctggcgggaaacgcggcgcgcgacaacaagaagaaccgcatcatcccgcgtcacgtcctcctcgccatccgcaacgacgaggagctcggcaagctgctggcgggcgtcaccatcgcgcacggcggcgtgctccccaacatccactccgtcctcctccccaagaaggccgccgagagggctgagaaggccgcaccgctaccaaagtccccaagaaaggcccgcgcggcaagtcggccaagaagtagcgtgcctgccttgtctcaattgatcctgatctcaccttggctgagtgggcgtgggatccttttggtggtcttggctgtctgggggtatgtaggatgcgtcccctcagggtcgggtggctccatcgaactagtttgggtcaatc

SEQ ID NO: 3916 - DNA, 691 bp, Triticum aestivum
acagctctcaatcccaatctcccatcacaaaaccaatcctcctccgcgccccgatccccaagagcatcacctgcaagcaatggacgtctcaggcaccggagctggcgccaagggcaagaagggcgcggccgggcgcaaggccggcggccccaggaagaagtcggtgacgcgctccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgctgtcaggaacgacgaggagctcggaaagctgctggccggcgtcaccatcgcgcacggtggcgtgatccccaagatcaacccggtgctcctccccaagaggaccgcggagaaggagggcaaggagcccaagtctcctaagaagacgaccaagtcccccaagaagaccaccaaggcttagatcgatgcgttccatgtcgtagtgttcttcgtagtggtccggtggtgttcctgtagcggtttcgtttcatcttgttatgtgcatgtttaatggaagaacgtcagaaatctctctgacttgctcaaaaaaaaaaaa

SEQ ID NO: 3917 - DNA, 675 bp, Lactuca sativa
tccttgtttgcatacccataaatcacttggtcttcaaagccaaaaagagaaatggaaaccaccggaaaagcgaagaagggtgccggaggaaggaagggcggtggcccaaggaagaagtcggttactcgatccgtcaaagctggtctccagtttcccgttggtagaattgggcgttaccttaaggtcggacgctatgctaaacgtgttggaaccggtgctccggtctacctcgccgctgttcttgaataccttgcggctgaagtgttggagttggctggaaatgctgcaagggataacaagaagaccagaatcatcccaagacatgtccttttggccatcaggaacgacgatgaacttggaaaacttttgggcggagttacgattgctcatggtggtgttcttccaaacatccatgctgttctattgccaaagaagacgactacatcggagcctaaatctccatcaaaggccgcaaagtcaccaaagaaagctgccaaaactccaaagaaagctgaataggctagagtagtttggttgttgttcatctgtgtgtgtatttgtcgttaaattacatatggtgtttagtgttctaaccattgcgtttgtttagactatcgatcgtatgttaccacctctctgtttatcaatggaagaaacctcttgtttctattttca

SEQ ID NO: 3918 - DNA, 641 bp, Brachypodium distachyon
caatggacgtctcaggcaccggagccgggaaagcgaagaagggcgcggcggggcgcaaggccggcgggccgaggaagaaatcagtcactcggtccgtcagggccgggctccagttccccgtgggccgcatcgggcggtacctgaagaagggccgctacgcgcagcgcgtcggcaccggcgcccccgtctacatggccgccgtcctcgagtacctggccgccgaggttctcgagctcgcgggcaacgccgccagggacaacaagaagtcccgcatcatcccgcggcacgtgctgctcgccgtcaggaacgacgatgagctcgggaagctgctggccggagtcaccatcgcgcacggcggggtgttgcccaagatcaacccgattctcctccccaagaagaccgcggagaaggcacccaaggaacccaagtcgccgaagaaggctgctactcccaagaaggccgacgctaaatccccaaagaaggcgtagatgcaggttcgattggttaacttctagatggatatattatggatggatgagccccagagtagttgtggggctgttcgtcttgtggtgtggttgtaccttgtgtttgtagtctctaattgaacaagaatgccaaatattgctacattccaattc

SEQ ID NO: 3919 - DNA, 810 bp, Lactuca sativa
cttgtttgcatacccataaatcactttgtcttcaaagccaaaaagagaaatggaaaccaccggaaaagcgaagaagggtgccggaggaaggaagggcggtggcccaaggaagaagtcggttactcgatccgtcaaagctggtctccagtttcccgttggtagaattgggcgttaccttaaggtcggacgctatgctaaacgtgttggaaccggtgctccggtctacctcgccgctgttcttgaataccttgcggctgaagtgttggagttggctggaaatgctgcaagggataacaagaagaccagaatcatcccaagacatgtccttttggccatcaggaacgacgatgaacttggaaaacttttgggcggagttacgattgctcatggtggtgttcttccaaacatccatgctgttctattgccaaagaagacgactacatcggagcctaaatctccatcaaaggccgcaaagtcaccaaagaaagctgccaaaactccaaagaaagctgaataggctagagtagtttggttgttgttcatctgtgtgtgtatttgtcgttaaattacatatggtgtttagtgttctaaccattgcgtttgtttagactatcgatcgtatgttaccacctctctgtttatcaatggaagaaacctcttgtttctattttcatgtggctttgtttatgtctgttacttcttacattaatgtataatacagtttgtcaaaggcacataaatgatgtaaacttcaataacttatattaagaatatttgagtgatttaggaacaaagattcttggaatgaag

SEQ ID NO: 3920 - DNA, 715 bp, Allium cepa
aaataaaatccggaaaccctagctttaatttagaagttcaaactcaaagcaatggaggcaggcggaaaaatgaagaaaggagctggaggtagaaagggaccgagcggacccaggaagaagtccgtcacaagatcggtcaaagctggtcttcagttccccgtaggacgtatcggcagatacttgaagaagggccgatacgctcaacgtgtcggtaccggagcgcctgtttaccttgccgccgttctggaatatctagcagcggaggtcctagagctggctggaaatgcagcgaaagacaacaagaagaatcgaataattccaagacatgttcttcttgcaataagaaacgatgaggagttgggaaaattgcttggtggagtgaccattgcgcacggtggagtgttgccaaatataaaccctgtccttttgcctaagaagactgctgctaaggaatccgagactccaaaatcacctaagaagactgctgccaaaactcccaaaaaggctgtttaattgatttttatggtagatgtcaattgctgtgtttatataatgaagtttggcggtttgaagttttcctcaaattataatgtcaactgagattgtgtcaagttctgacgtgatatggatttagacttgttttctctcttgcttttacgatccgttgagttgcgtgaatttggttttaagtgataatcagtaataactaaactga

SEQ ID NO: 3921 - DNA, 637 bp, Helianthus annuus
cggggacccaaaaccatttccacacacagaaacacacacaaaacaaaaaaaaaaaaacccaaatggaaaccaccggaaaagctaagaagggtgccgcaggtcgcaaagccggcggtccaaggaagaagtccgtcacccgctccgtcaaagccggtctccagtttcccgtcggcagaatcggccgttacctcaaacacggccggtatgcaaagcgtgtcggtaccggtgctccggtttacctcgccgccgtcttggaataccttgcagctgaagtgttggaattggcaggaaatgcagctagggataacaagaagaacaggataacaccgaggcatgttttgctggcgataaggaacgatgatgaattgggaaagttgttggccggagttacgattgctcatggtggtgttttgccgaacattaacccggtgttgttgccgaagaagagtgctgctgctgcgaaagagcctaataagtcgcctgctaaaactacaaagtctcccaagaaggccgcataagttgggatgggttaagttgtagttaaaatcgggaatgaatgtagtttggtaatagtgttggttatgtttatgttgaggttaatgaatgaatgaaagaaaccgcttgtttcgctaaaaaa

SEQ ID NO: 3922 - DNA, 950 bp, Saccharum officinarum
gtcgacccacgcgtccggagaaatcgaacgcgaaagagggtgacgagagaggggagagagaaagagaggcggggaaggagagcacgggggcttgatcggagatggatgccggagcaaaggtgccgaagaaggccgcggcggggcgtcgcggcggcggcggccccaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgccgaggtcctcgagttggcggggaacgcagcgcgggacaacaagaagaaccggatcatcccgcggcacgtactgctggcgatccgcaacgacgaggagctcgggaagctgctggccggcgtcaccatcgcgcacggcggggttctgcccaacatcaaccctgtgctgctccccaagaagaccgctgctgctgccgccaaggagggcaaagagaagaagtcacccaagaaggcggccgccaagtcgcccaagaaggcggcagccgcataggcccccggcaatgccggtgccctgtctggctgtctctcgctctctttctctgtccgctctgaactgaaacgctcctagctgtcgttgtcggtcaaggtcgttgttgcttgatgcacttgttgtggttgttcgtgtgtaattgcgtgcctttcgcccaatcagcatgtactgtgtaggttgacactggtctaggtttcgatctgggaaacgctggtttagattcaaggagtgtgatctgtgaagggcaggggagggggtgggatctgtgaatcattaggtgctgtttgtaataagattgcgaagatgtgtaaaatccgttctgtgcttccattccctgcttgattgtctggatgcgatatcttttccact

SEQ ID NO: 3923 - DNA, 937 bp, Saccharum officinarum
accggagaaatcgaacgcgaaagagggtgacgagagaggggagagagaaagagaggcggggaaggagagcacgggggcttgatcggagatggatgccggagcaaaggtgccgaagaaggccgcggcggggcgtcgcggcggcggcggccccaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgccgaggtcctcgagttggcggggaacgcagcgcgggacaacaagaagaaccggatcatcccgcggcacgtactgctggcgatccgcaacgacgaggagctcgggaagctgctggccggcgtcaccatcgcgcacggcggggttctgcccaacatcaaccctgtgctgctccccaagaagaccgctgctgctgccgccaaggagggcaaagagaagaagtcacccaagaaggcggccgccaagtcgcccaagaaggcggcagccgcataggcccccggcaatgccggtgccctgtctggctgtctctcgctctctttctctgtccgctctgaactgaaacgctcctagctgtcgttgtcggtcaaggtcgttgttgcttgatgcacttgttgtggttgttcgtgtgtaattgcgtgcctttcgcccaatcagcatgtactgtgtaggttgacactggtctaggtttcgatctgggaaacgctggtttagattcaaggagtgtgatctgtgaagggcaggggagggggtgggatctgtgaatcattaggtgctgtttgtaataagattgcgaagatgtgtaaaatccgttctgtgcttccattccctgcttgattgtctggatgcgatatcttttccact

SEQ ID NO: 3924 - DNA, 647 bp, Solanum melongena
atcatctctccgacaatcaatttttcttacaatcaaatagttgttgaaatggagtctaccggaaaagtgaagaagggtgccggcggcagaaagggtggtggtccaaagaagaagcctgttacccgttctgtcaaggccggtcttcagttccccgtcggtagaattggacggtacttgaagaaaggacaatacgctcaacgtgttggttctggtgctccggtttacttggccgccgttcttgaatatttggctgctgaagtattggaattggctggaaatgctgctcgtgacaacaagaagaacaggattatcccaaggcacttgcttttggctgtgaggaatgatgaggaattagggaaacttcttgctggtgtgacaattgcacatggtggtgttcttccaaacatcaacccagttttgttgccaaagaagactggagctgagaaggcacctaaatctccatccaaagctacaaagtctcccaagaaggcttagatttgattactgtttctttttgtatgtaattctgtttttagaagctgttgattgtcctttatggatattgaaatgggattagttggaactactgttagatctttgttagtttttcctccattatcaatcaatgaaactccttgtttcgactc

SEQ ID NO: 3925 - DNA, 657 bp, Cynara scolymus
  misc_feature (655)..(655): n is a, c, g, or t
cgcggggacatcacttgtcacaaacgaagcgaaagagagaaatggaaactaccggaaaagcgaagaagggtgccggaggccggaaaggaggcggtccaaggaagaaggcggtgactcgttccatcagagctggtctgcagttccccgtcggtaggattggccgttaccttaagaacggacgctatgctaaacgtgtcggaactggtgctccggtttacctcgccgccgttcttgaataccttgctgctgaagttttggaattggcaggaaatgcagcaagagataacaagaagaacagaataatcccaagacatgttttattggcgattaggaatgacgatgagcttggaaaactgttggctggagttaccattgcacatggaggtgttcttcccaacataaacccagttctgttaccaaagaagacagctgcaaaagagcctaaatctccatcaaaagctaccaaatcgccaaagaaagctgattagcttactttaataatgaatgatgttgttcatctgtgtctgtaattgtagttaaattgaaaatggaatttagtttttctaaccattgggtctgttttagatggtcatgatatatttcttggcttggtgtgacatcagtttcaatgcgagaaacctcttgtttctatctnag

SEQ ID NO: 3926 - DNA, 619 bp, Taraxacum officinale
tcaaaacccaaaacaaattcatccataattcctttcttcagagcattttagagatggagtcaaccggaaaggtgaagaagggagccgcaggaaggaaagccggcggtccaaggaagaaggcggtgacccgttcagtcaaagccggtcttcagttcccggtcggtagaatcggccggtttttgaagaaaggacgttatgctcaacgtgttggatccggtgcacccgtctaccttgctgctgtccttgagtacctagcagcagaagtgttggagttggctggaaatgcggctagggacaacaagaagaacagaataatcccgagacatgtgttgttagctattaggaatgatgaggagcttggaaagcttttggctggagttaccatcgctcatggtggtgttttgcctaacattaacccgattcttttgcccaagaagactgctgctaaagaacctaagtctccatcgaaggctactaaatctcccaagaaagcaaagtagtttagttagatatgtataagaagactttgtttttgtcttttgtttgtctggttttagagtagtttatatgttcagatgtgttcaacctctagaagaatgaaacgacttgtttttttaaa

SEQ ID NO: 3927 - DNA, 1272 bp, Zingiber officinale
  misc_feature (1220)..(1220): n is a, c, g, or t
atttgtatattcgtgttcaatattctgtgcttatcagattgctgaaccaaacacatcaggaacttctatgctgccaaagaaggagcattagtttatgtacacagtagaacacaaaccggaaaggaaggtacagatcaacttcatttctttttcctttatgatttcatgacttgaatcagctttaccctttagaatatgaaggcggctggagcaaacgctggcacaagtttagctgctctatagtacccgtagtcgtccttgaaggagcggggacggacacttctggctgacttggccttcgacgccttgcgcgtcccaccaccgccgccagcggctgccttggccgtggcgtctccggtcgcaaacagcgcgacgtcctccgagatcgacatcagcgacggccgccacggtgccgccctccgctgactcttcgtcgacccggtcggcgccgacgtcgtccggtccttcgccgcctccggccgtggcgatcgccagcgaccctcgcgccgaattcggcacgaggcagatcggttagagctcggtgcgcattttacgctcgacggcggagatggagctaggtggcaaggcgaggaagggcgccggcggccggaggggtggtggcgggcctaagaagaagccggtctctcgctccgtcaaggccgggctccagttcccagtcggtcgcatcgggcgctatcttaagaacggccgctacgcgaagcgcgtcggcaccggcgctccggtctacctcgccgccgtgctcgagtacctcgccgccgaggtgttggagctggcggggaacgccgcaagggacaacaagaagaaccggatcataccgcggcacgtgctgttggccatcaggaacgacgaggagctagggaagctactcgccggcgtcacgatcgcccacggaggggtgctgcccaacatcaacccggtactgttgccgaagaaagccgccggcaaggagcccaaatcgccggccaaatccgccgccaagtcaccgaaaaagccttaatttggttcttctacagcaccagttgtcttaattacttcctcggtatgtgatttctatctaaaattagcctctccctttttttttttatggaattgtggcggattgcaacgctgatgttatcgatgaattcaagggattcctgctgtgatcttcttcattttctgggaatttagcatgaatctagttgctgttacttgcgttnaatcttcaacactcatgctaatctctacattgcttgcgtttgtgaaaaaaaa

SEQ ID NO: 3928 - DNA, 632 bp, Zea mays
ttcactccactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgcccccgttctggagtacctcccccccgaggttttggaattggcagggaacccggccaaagacaacaagaagacgggcattatccccccccccgtgctcctggcgatccgcaacgacggggagctcgggaagctgctggccggggtccccatcgcgcccgggggggtcctccccaacatcccctccgtgctcctgcccaagaaggcggcggggaaggcggcccgcggcggccccaaggagcccaagtccccccagaagggcgccaagtccccccagaagggttagaaagtagggttttcctttgcgctgtgtgctgtagcatgttcgtgtttagatttgtggatgggaggggtcctgctctagt

SEQ ID NO: 3929 - DNA, 650 bp, Helianthus annuus
cggcggggatccaaacccaaaacaaaacaaattcatcactacttactattctagatccttttagagatggagtcaaccggaaaggtgaagaagggagccgcaggaaggaaagccggcggtccaaggaagaaggcggtgacccgttcagtcaaagccggtcttcagttcccggtcggtagaatcggccggtttttgaagaaaggtcgttatgctcaacgtgttggatccggtgcacccgtctaccttgctgctgtccttgagtacctagcagcagaagtgttggagttggctggaaatgcggcaagggacaacaagaagaacagaataatcccgagacatgtgttgttggccattaggaatgatgaggagcttggaaagcttttggctggagttaccatcgctcatggtggtgttttgccgaatattaacccgattcttttgcccaagaagactgctgctaaagaacctaagtctccatcgaaggctactaaatctcccaagaaagcgaaatagtttagttagatatgttgttttagtttaattcgtatggtcagatgaatgaaaccacttgtttcgtttttattttttttggtgtttattgtgttaaatttatttttatgaatttctaagctaaaaacaaaatagccaac

SEQ ID NO: 3930 - DNA, 616 bp, Helianthus annuus
atcactcaaaacccaaaacaaattcatccataatttctttcttccgagcattttagtgatggagtcaactggaaaggtgaagaagggagccgcaggaaggaaagccggcggtccaaggaagaaggcggtcacccgttcagtcaaagccggccttcagttcccggtcggtagaatcggccggtttttgaagaaaggtcgttatgctcaacgtgttggatccggtgcacccgtctaccttgctgctgtcctcgagtacctagcagcagaagtgttggagttggctgggaatgcggcaagggacaacaagaagaacagaataatcccgagacatgtgttgttagccattaggaatgatgaggagcttggaaagcttttggctggagttacgatcgctcatggtggtgttttgcctaacattaacccgattcttttgcccaagaagactgccgctaaagaacctaagtctccatcaaaagctactaaatctcccaagaaagcaaagtagattagttagatatgtttgtcttttgtcttttgtttgtctggttttagagtagtttatatgttcagatgtgttcaacctctagaagaatgaaacgacttgttttttaatttt

SEQ ID NO: 3931 - DNA, 543 bp, Helianthus annuus
ttcatcactactttcttttttaatccttttagagatggagtcaaccggaaaggtgaagaagggagccgcaggaaggaaagccggcggtccaaggaagaaggcggtcacccgttctgtcaaagccggtcttcagttcccagtcggtagaatcggccggtttttgaagaaaggacgttatgctcaacgtgttggatccggtgcaccggtttaccttgctgctgtcctcgagtacctagcagcagaagtgttggagttggctggaaatgcggctagggacaacaagaagaacagaataatcccgagacatgtgttgttagccattaggaatgatgaggagcttggaaagcttttggctggagttacaatcgctcatggtggtgttctgcctaacattaaccctattcttttgcccaagaagactgccgctaaagaacctaagtctccatcgaaagctaccaaatctcccaagaaagcgaaatagtttagttagatatgtcgttttagtgtaattcatatggtcagatgaatgaaaccccttgtttc

SEQ ID NO: 3932 - DNA, 613 bp, Lactuca sativa
ccactcattccttctttctttcgtcgacgttattcagagaatggagggagccggaaaagctaagaaaggtgccggaggaaggaagggcggcggcccaaggaagaaggcggtttcccgttctgtcaagccggacttcagtttccggttggtaggatcggacgttttctaaagaaaggccggtatgctcagcgtgtcgggtccggagctccgatttacctcgccgctgttcttgaatacctcgcagctgaagtgttggagttggcgggaaacgctgctagggataacaagaagaccagaataattccaaggcatctcctgttggctattagaaacgatgaagagcttgggaaattattgggcggagttacgattgctcatggtggtgttcttccaatatcaatcctattctattgccaaagaagactgctgctaaggagccatcatctccgtctaaagctgcaaaatctccaaagaaagctaagaaggctgaatagattaagctggttgatttttcatcgttttgtgaaaaatctaggaatggggagaattgtatttcgatgatgtattttaccaaaatacataatattaaaaagcatagattacttcttagaaa

SEQ ID NO: 3933 - DNA, 806 bp, Tropaeolum majus
tacggccgggggcaagaaaaaaactcgactgtcctactctttgttcgtataatatttcggccaactcagtacggttagttaaggcgagttaactcagactttgaatttagaatggatactacagggaaagcaaagaagggagcaggaggaaggaagggaggaggccctaagaagaagtcggttacccggtctgttagggcaggcctccagtttccggtaggtagaatcggtcgttacttgaagaaaggaaggtatgctgctcgagttggtaccggagctccggtttacctagccgcagttctcgagtatcttgccgctgaggttcttgaacttgccggcaacgcagcgagagacaacaagaagtccagaatcattccaaggcatctgttgcttgctgtaaggaacgatgaagaacttggaaaacttctctcaggtgttacaattgctcatggtggagtccttcccaacattaacccaattctattgcctaagaagaccgagaagtcggcacatgagcccaagtctcctgccaaggcagggaagtccccaaagaaagcatagttgaatcagcctcaatcagaattttaacttatgtctagatatatgtatgatgtgggtaggatcagtttttgttgatttgtaggtggtggtggtgggatggcctgtgaatggcattgccatacaaaactagtaatggttctttttgtaatggtctgatattttagtgttattcaatgttatatatcaaatgaatcactttcttttatcctaatagttgctggtaaaaaaaaaaaaaaaaaaggccg

SEQ ID NO: 3934 - DNA, 727 bp, Vitis vinifera
cagcaacgatagcactcacgaattgctcgtttcggacggtgatacctgttttgttttctcgggaatttgattttccgccgactgtatccgggaaatggaggctgctggaaaggtgaagaagggtgccggaggaaggaagggcggtggtcccaagaagaaacccgtatcccgctccgtcaaagctggtcttcaattcccggtcggtcgtatcggcagatacctcaagaagggccgttattctcagcgcgttggaactggtgccccggtctacctcgctgccgtgctggagtacctagctgctgaggttttggagttggctggaaatgcagcaagggataacaagaagaacaggataatcccgaggcatgttttgttggctgtgagaaatgatgaagaacttgggaagcttctagctggagtcacaattgctcatggtggtgtcctgccgaacatcaaccctgttcttctgccaaagaagtctgacaaggcagcaaaggaacccaagtcgccatccaaggccaccaaatctcccaggaaaacttagtttgtcaattgtgttagagaaacacttgtcttcttcttatctctctctgtatgtagtctcccttctctgtccatgggtgataggaaagctttattcgatcagaaaataggagcattgtactctttgtttccatgttctcttaggacattctgtttcaaatgaatgaaattcagttttcagata

SEQ ID NO: 3935 - DNA, 612 bp, Hordeum vulgare
ccgccttctccgcacctccaatcctgaaatctacccgccatggacgcatcaaccgccggcgccgtctccaaggcgaagaagtacgtggtggggcgcaagctcggcggcggccccaggaagaaggcggtggcgcggtccgtcaaggccgggctgcagttccctgtcagccgcatcgcccgcttcctcaagaagggccgctacgcgcagcgcgtcggcatgggcgcccccgtctacctcgcctccgtcctcgagtacctcgccgccgagcttcttgagctggccgggaacgccgccaaggacaacaagaagtcccgcatcatcccgcgccacctgctgcttgcagtccggaacgacgaggagctcggcaagcttctcgccggcgtcaccatcgcgcatggcggcgtgctgcccaacatcaactcggtgctgctccccaagaagacggctgagaaggagcccaagtcgcccaagaaggccgccaagtcccccaagaaggcatagccgattactgtctagtgcttcctaatagaataagtggttgctgtttgggtaatcgtgtcgatgtagtaatgccctgttctgctttggaaaaaaaaatgtttgttcatgatt

SEQ ID NO: 3936 - DNA, 711 bp, Medicago truncatula
attcatcaaattcccaatccaaagcacttcttcttcttctttcttgttcgcattcaaatattcttttcctctcaaaatctcagttcaaaatggacgcaagcaccaagacaacaaagaaaggagccggtggaaggaagggaggaggtccaaggaagaagtcggtgacaagatccatcagagccggactccaattcccagtcggaagaatcggccgttacctgaagaaaggtcgatatgctcagcgtgtcggcaccggtgctccggtttacctagctgcagttcttgaatacctcgctgctgaggttcttgaattggcaggaaacgctgctcgtgataacaagaagaatagaatcattccaaggcatttgttgttggctgttaggaatgatgaagagcttggaaaactgcttgctggtgttacaattgctcatggtggtgttcttccgaacattaacccaattctgttgcctaagaagactgaaagggctaatactggtggcaaggagccaaagactactaaggctggaaagtctcctaagaaagcttagatctgattttaggaagaattaattttttttttttttgcttttgaagatgtaatgaagtaattggatctttctgatcttttttgtttatgaaaatggtgatttaatgatattggtcttcaaaaatgtttctattttacaaagagatgaagttgaattcctattt

SEQ ID NO: 3937 - DNA, 693 bp, Medicago truncatula
atccaaagcacttcttcttcttctttcttgttcgcattcaaatattcttttcctctcaaaatctcagttcaaaatggacgcaagcaccaagacaacaaagaaaggagccggtggaaggaagggaggaggtccaaggaagaagtcggtgacaagatccatcagagccggactccaattcccagtcggaagaatcggccgttacctgaagaaaggtcgatatgctcagcgtgtcggcaccggtgctccggtttacctagctgcagttcttgaatacctcgctgctgaggttcttgaattggcaggaaacgctgctcgtgataacaagaagaatagaatcattccaaggcatttgttgttggctgttaggaatgatgaagagcttggaaaactgcttgctggtgttacaattgctcatggtggtgttcttccgaacattaacccaattctgttgcctaagaagactgaaagggctaatactggtggcaaggagccaaagactactaaggctggaaagtctcctaagaaagcttagatctgattttaggaagaattaattttttttttttgcttttgaagatgtaatgaagtaattggatctttctgatcttttttgtttatgaaaatggtgatttaatgatattggtcttcaaaaatgtttctattttacaaagagatgaagttgaattcctattt

SEQ ID NO: 3938 - DNA, 574 bp, Nuphar advena
aaggcgaagaagggggcggggggaaggaagggaggcggtgctcggaagaagtcggtgacgaggtcagtgaaggcagggcttcagttccccgtcgggaggatcggtcgctacctcaagaagggccgctactcccaccgcgtcggctccggcgcccccgtatatctcgccgccgtcctcgagtacctcgctgctgaggtactggagcttgctggaaatgctgcgagagataacaagaagaaccgtatcataccaaggcacctccttctggccgtgaggaatgatgaagagttgggaaagcttcttcaaggcgttaccattgcccatggtggtgttctccccaacatcaaccctgttcttctgcctaagaagactgagaaggcaaccaaggaagctaaatcgcccaaggcagcgaagtcccctaagaaagcatgatcaacatctggctggtttctgcgtgttgtttgttgcttttaattctccctttgtagaaactccagctgaaacagaattgtgcatttcaaaatggttgtgtattggaaaccctactttttttaatgcaatgtacgttgttttt

SEQ ID NO: 3939 - DNA, 678 bp, Nuphar advena
  misc_feature (7)..(7): n is a, c, g, or t
  misc_feature (593)..(593): n is a, c, g, or t
gttgttntctttcactgtcttcttgtcaatttctctctgtagagactagggagtgtggtgtttctgttttgtttctcagaggtgagtttgttgaaggaagaagagtaatggagggagtaggagggaccccgaaggtgaagaagggtgctggagggaggaagggagggggcccgaagaagaagccggtgtcgaggtcggtgaaggcgggactgcagttccccgtggggaggatcggtaggtacctcaagaagggtcgctactcccagagagttggcactggtgcgcccgtctaccttgctgctgttctcgagtaccttgcggctgaggtcttggagcttgctggaaatgctgcaagggacaacaagaagaaccgaatcattccaaggcatctcctcctggcagtgaggaacgatgaggagttggggaagcttcttcatggtgttacaattgcccatggtggtgtgctccccaacatcaactctgtgctgctgcccaagaagactgagaagacaacaaaggaacccaagtcacccaaggcaaccaaatccccaaggaaagcctgatctgactctctgatcttcagtgtgtgtttnttagtttaattttcttctttgtagaaactccacttgaatcagaattgatcgtctcaattattggctctttatcataaaaaaaaaa

SEQ ID NO: 3940 - DNA, 714 bp, Nuphar advena
gtttctcagaggtgagttttgttgagggaagagaaaaaggggagtaatggagggagtaggagggacccctaaggtgaagaagggtgccggagggaggaagggtggggggccgaagaagaagccggtgacgaggtcggtaaaggcggggttgcagttccctgttgggaggatcggtaggtacctcaagaagggccgctattctcagcgcgtcggtactggtgcgcccgtctaccttgccgctgtccttgagtaccttgcggctgaggtgctggagcttgctggaaatgctgcaagggacaacaagaagaaccgaatcattccaaggcatctcctgctggcagtgaggaacgatgaagagttagggaagcttcttcaaggcgtcaccattgcccatggtggtgtgctccctaacatcaaccctattctgctgcccaagaagactgagaaggcaacgaaggagcccaagtcacccaaggcaaccaaatccccaaggaaagcctgatttgtttctctgaccttcagcgcgtgtttgttgctttgattttcttgtttgtagaaacccacttgaattagaattgatcatctcagttggtggctctgtatctgaatcttctctctgtgtagtttcgcttcagtttcctcttttttgtccacgttggctttgttgcctttctcgataatcttagtggggcatgaatgatttttgttcaaatc

SEQ ID NO: 3941 - DNA, 681 bp, Elaeis guineensis
  misc_feature (666)..(666): n is a, c, g, or t
  misc_feature (675)..(675): n is a, c, g, or t
tacaaggcggaagcgaaagagatcaccggagaggagagagatggagatcgggggcaagctcaagaagggggctggtggccggaggggtgggggtccaaagaagaagccggtctcccggtccgtcaaggccggtctccagttcccggttggccggattggccgctacctcaagaagggccgctactcccagcgcgtcggaaccggagcccctgtctacctcgccgccgtcctcgaatacctcgccgctgaggttctggagctggccgggaacgcggcgcgggacaacaagaagaaccggatcatcccaaggcacgtgctgctggcggtgaggaacgacgaggagctggggaagcttctcgctggggtgaccatcgcccatggaggggttctgcccaacattaacccggtgcttctcccgaagaagaccgcgagcaaggagcccaagtcgcccaccaaggccaccaagtcccccaagaaagcttaggaaccgttgacccttgtgttgttattcctgctttcttaattctgtatgtaattctgtggatccgttttaggttgttttcttcttttgtttggtgtaggggatggtgtaatgaggaggaggggacgagacttggaaaaaaggatttgtatcaattctctttcgtttcaggaaatgttaaaganggtgttttnatgtgg

SEQ ID NO: 3942 - DNA, 804 bp, Elaeis guineensis
gagaaaaatggagaccgggggaaaggttaagaagggcgcaggcggccggaggggtggcggcccgaagaagaagccggtatcccggtccgtcaaggctggccttcagttcccggtcggccggatcggtcgttacctcaagaagggccgctactcccagcgcgtcggcaccggcgcccccgtctacctcgccgccgtcctcgagtacctcgccgctgaggttctggagttggctgggaacgcggcgcgggacaacaagaagaatcggatcatcccgaggcacgtgcttctggcggtgaggaacgacgaggagctgggcaagcttctcgctggtgtgaccatcgcccatggaggggttctgcccaacattaacccggtgcttctcccgaagaagacagcaagcaaggagcccaagtcgccctccaaggccaccaagtcccccaagaaagcttaagagctgacgatccttgtgttgttattccaaccttcgtatttctgtgtgcaatttcgtgatcctttttaggcggttttcttcttgcgtttgtatcggtggtggtgtaaggagaagggtacgaaactggaaaaaagggatttgtattaattctctttcctttcagaaaatgttaagaactgtgtttttactatggacgagcatgttttttcttttatatttttggtcctggaatcgattgtagctttcctagtttctagttgatgtctgatgccccaatttgtggagaaatactgtaccagaatggggactttcgtcgcattgtatgagaacggatatcaattttagaaaattac

SEQ ID NO: 3943 - DNA, 689 bp, Pseudoroegneria spicata
tcgcactcggcaatcagcagtcaggcaatccccacgcacatctctccacttcccgaatcctttctccacctccagcgcagcagctcgccatggacgcctcagccaccgtagccaccgggaaggcgaagaagggcgcggccgggcgcaaggccggaggccccaggaagaagtccgtgtcgcggtccgtcaaggccgggctccagttccccgtcggccgcatcgggcgcttcctcaagaagggccgctacgcgcagcgcgtcggctccggcgcccccgtctacctcgcggccgtcctcgagtacctcgccgccgagctgctggagctcgcaggcaacgccgccaaggacaacaagaagagccgcatcatcccccggcacctgctgctcgccatcaggaacgacgaggagctcggcaagctgctcgccggcatcaccatcgcgcacggcggcgtcatccccaacatcaacccgctgctgctccccaagaagacggccgagaagtcgcccaaggagcccaagtcgcccaagaagaccaccaagtcccccaagaaggcttaggttcattgcttagttaggctgtagctgggatggacggatgggtgtgcttcaggatacttaagttcgaagtagactgttctgccgtgtcgttgtattttctgactgatttcaatggaacaataagttgcttta

SEQ ID NO: 3944 - DNA, 561 bp, Sesamum indicum
tttcagtctcacatcacatcttcttttgtagttcttcattcataatttctttgttactagagagaaatggaaagtggcggcaaattgaagaagggagctgggggaaggaagggcggcggtccgaagaagaagcccgtttcccggtccgtcaaagccggcctccagttcccggtgggcaggatcggacggtatctgaagaagggacgatattcggagcgggtgggtacaggtgcgccggtttacatggctgccgtgctcgagtaccttgctgcagaggttttggaattggctggaaatgcggcgagagacaacaagaagaacagaatcattccgaggcacgttttgctcgcagtgaggaacgatgaagagctcggaaagcttctagctggagtgacaatcgcacacggaggcgttctaccgaacatcaacccagttcttctgccgaagaagtctgagaaggcggcggagaagccagctaagtccccaaccaaggccaccaagtcgccgaagaagggttaactgatccatgtccttgtgaagtgtacaattgaatgacattgt

SEQ ID NO: 3945 - DNA, 538 bp, Sesamum indicum
tttcagtctcacatcacatcttcttttgtagttcttcattcataatttctttgttactagagagaaatggaaagtggcggcaaattgaagaagggagctgggggaaggaagggcggcggtccgaagaagaagcccgtttcccggtccgtcaaagccggcctccagttcccggtgggcaggatcggacggtatctgaagaagggacgatattcggagcgggtgggtacaggtgcgccggtttacatggctgccgtgctcgagtaccttgctgcagaggttttggaattggctggaaatgcggcgagagacaacaagaagaacagaatcattccgaggcacgttttgctcgcagtgaggaacgatgaagagctcggaaagcttctagctggagtgacaatcgcacacggaggcgttctaccgaacatcaacccagttcttctgccgaagaagtctgagaaggcggcggagaagccagctaagtccccaaccaaggccaccaagtcgccgaagaagggttaactgatccatgtccttgtga

SEQ ID NO: 3946 - DNA, 794 bp, Tamarix hispida
  misc_feature (581)..(581): n is a, c, g, or t
tgagcgaggaagggggcacatctccggtccaatcgaagcaacgaacaataatcctttcccgttacctctcgtcttcatacattcgcttagcgtggtcgattcccggcggttcacggcgagaaatggatagcaccggtaaggttaagaagggagctggcggcaggaaaggtggcggcccaaagaagaaaccggtttctaggtcagttaaggctggtttgcagttccctgttggtaggatcggaagattcctgaagaaaggaaggtatgctcagagagtcggttccggtgctcctgtttaccttgccgccgtcctggagtaccttgctgcagaggtattggagctggctgggaatgcagcaagagacaacaagaagaacagaatcattccaaggcatgtgttactcgcagtgaggaacgatgaagagcttggtaaattgctcagtggagtgacgatcgcccatggtggcgttctgccaaacattaacccagttcttcttcccaagagggctgataaatcaggagccaaagaacccaagtctccatctaaggccaccaagtcacccaagaaggcctaagatttnaacagttaaatatgttactgttattttagatggtcgcacaatttcatagttctgtatgtagttatgatgtaattggtggtttgtaggaaggagaaggaagagggttttcagtatttttcagaacctaggatctgaaatttgtgtattttcctccctttgtttgaattttaaactagcatgatcaatcaacttgttgacgatttcatttcgccc

SEQ ID NO: 3947 - DNA, 857 bp, Juglans hindsii x Juglans regia
gggggctccacgatttccattttcagtccaatttcttcttctggtcgtttctcgaggaaattctccttttgcatcaaatttttttcggtcatggaaacggggggaaaggtgaagagaggtgctgcagggaggaagggaggcggtcccaagaagaaaccggtgtcccggtccgttaaagcgggtctgcagttcccagttggacgaatcggccggtacttgaagaaaggccgttactctcagcgtgtgggcaccggtgctcctgtttacctcgctgctgtacttgagtacctagctgctgaggttttggagttggctggaaatgccgcaagagacaacaagaagaacaggattatcccaaggcatgtgctactggccgtgaggaacgatgaagagctcgggaagcttctcgctggtgtgaccattgcccatggaggtgtccttcccaacatcaaccccgtccttctgccaaagaagcctgacaaggttgctaccaaagagcccaagtctccatctaaggccaccaagtcccctaagaaggcctgacccttcgcacaatgtgttgaacaaagtctttgtgtctctgtatgtaatttcctatctgtatttgttgcttgtaaggaagttcatgtccgtagaatttaggataccattgtactgctcgttgtttctgtccttgtagaacatcctttgctttaaattaatcagatcaaattgcagcccagttcgaatttctcgtctgttgcttcattgctaggagtcctagcaatgcccaggttgatcatgaaaatttggatcaaatatgaaggagcagggcaacgttgaaagtggagatgggaaacttttgagagtctgaaaca

SEQ ID NO: 3948 - DNA, 758 bp, Triticum aestivum
  misc_feature (3)..(3): n is a, c, g, or t
  misc_feature (11)..(11): n is a, c, g, or t
ggnctgcaggnaattcggcacgaggccgccttctcaaatctcccatcgcgccaaatctctccgcacctcctcctccagatctagccgccatggacgcctcagccaccggcgccgtctccaaggcgaagaagtacgtggtggggcgcaagctcggcggcggccccaggaagaaggcggtggcgcggtccgtcaaggccgggctgcagttccccgtcggccgcatcggccgcttcctcaagaagggccgctacgcgcagcgcgtcggcatgggcgcccccgtctacctcgcctccgtcctcgagtacctcgccgccgagcttcttgagctggccgggaacgccgccaaggacaacaagaagtcccgcatcatcccgcgccacctgctgctcgccatccggaacgaccaggagctcggcaagctgctcgccggcgtcaccatcgcgcacggcggcgtgctgcccaacatcaaccccgtgctgctccccaagaagacggcggagaaggagcccaagtcgcccaagaaggccgccaagtcccccaagaaggcttagtcgattactgtctagtgattcctgatagtagtagtgttctgtttggataatgatgtcgatgtagtaatgttctgttctgctgagaaaaaagagtcagaaatctctctgacttagtaaattcattctctgttatatgtctgttcatgattttgcaatgccgtctaacagtttcacatctgcatggtaggacaaatcgtgattaccaat

SEQ ID NO: 3949 - DNA, 716 bp, Triticum aestivum
tcatcggtgtctggaaatcactggtgatcagcagcacagtccgcaatctccaatcgccacatctccccacttcccgaatccttttcccttcaagcgcagtagatcgccatggatgcctcagccaccgtagccgccgggaaggcgaagaagggcgcggccgggcgcaaggcgggtggccccaggaagaagtctgtgtcgcggtccgtcaaggccggactccagttccccgtgagccgcatcgggcgctacctgaagaagggccgctacgcccagcgcgtcggcaccggcgctcccgtctacctcgcggcagtcctcgagtacctcgccgccgagctgctggagctcgcggggaacgccgccaaggacaacaagaagagccgcatcaccccccgctacctgctgctcgccgtcaggaacgacgaggagctcggcaagctgctcgccggcgtcaccattgcgcacggcggcgtggtccccaagatcaacccggtgctgctccccaagaagacggctgagaagtcgaccaaggagcccaagtcgccgaagaagaccgccaagtcccctaagaaggcataggaggcgcgtcgctttgcttagattgttgtacgtagctgggatggatctgttgggtgtgcttcagaggagacgattgttgtacgatgctgtatcttctcacctgtgacttccatggaacgatgcgttgcataaaaaaaaaa

SEQ ID NO: 3950 - DNA, 633 bp, Pisum sativum
cttacaacatcagaaaacttttctgctagaatctagtcttcaaatctcgaaatggacgcaagcacaaagacaaagaagggagccggaggaaggaaaggaggaggaccaaggaagaagtccgtcaccagatccgtcagagctggtcttcaatttcccgtaggaagagtcggccgattcttgaagaaaggtagatacgctcagcgtgttggtactggtgctcctgtttacttggctgcagttctcgaatatcttgctgctgaggttcttgagttggctggaaatgcagcacgtgataacaagaagaatagaatcagtccaagacatttgttgttggcagtgaggaatgatgaagagcttggaaaattgcttgctggtgttaccattgcttatggtggtgttcttcccaatatcaacccagtgcttttgcctaagaggaaagaaaacgctgctgccagtactccaaagtctccatctaaggccaagaagtctcccaagaaggcttaaacttggttctaggtttagggaccttttaatatagccgaaatgtttaatgctgtagtaattctatttggatcttcacaatgttatgtaagagttccgcacataaatgaaaacatcttgtttttattataa

SEQ ID NO: 3951 - DNA, 706 bp, Phaseolus coccineus
ccatttatttggttccggggatcacacgcaattctgctcaacatcccttaacctttctcgttcctcacttttgttatttttcaagcgcagctaatttctagggttccgacatggaaaccggtggaaagattaagaagggcgccggaggaagaaagggcggcgggccaaagaagaagccggtcacgaggtccgttagggcgggactccaatttcctgtcggaagagtagggcgttacttgaaaaaaggaaggtacgcgaagcgtgtgggaacccggtgctcccgtttacttggctgctgttcttgaatacctagctgctgaggtgcttgaattggctgggaatgctgctcgtgacaacaagaagaacaggattattcctagacatgtgcttttggctgtgaggaacgatgaagaattggggaaattgctttctggtgtgaccattgcccacggtggtgttcttcccaacattaaccctattctgttgcccaagaagaccgataaggctgccaaggagcccaaatctccatctaaagctaccaaatctcccaagaaggcttagagtatattttaatttagttctgtatatcagtgtttagggtgctttggttgtaacaggaagggggtttgatgttttgaaacactgtattttcatctaattgtgctgtttgaaggagtttgttcatttatcgaaacctcttgttttc

SEQ ID NO: 3952 - DNA, 636 bp, Lactuca sativa
gcggggatcatatcgaagatccgctcatttctcagtgtttattcatcgctaaaagagaaatggaaggcgcagcaaagtcaaagaagggtgccggaggaagaaaggccggtggtccaaggaagaaggcggttacccgctctgtcaaggccggactccagtttcccgtcggtagaattgggcgttttctgaagaaaggacgttatgcgcagcgtgttggcagcggtgctcccgtttacctcgccgctgttcttgaataccttgccgctgaagtgctagagttggctggaaacgcggctagggacaacaagaagaccagaatcattccaagacatcttctgttggccattagaaacgatgaagagcttgggaaattattgggtggagttacgattgctcatggtggcgttctcccaaatatcaatccaattctattgccgaaaaagactgctgccaaggagccttcaactccatccaaagctgctaaatctccaaagaaagctaagaaggctgagtagattatgacgttagaatttgtaggtcttatttggttaagattatattaaaagtttttatgctggtgttgatcatgatttattgaatgaaacgacttgtttcttataattgttgcaacgtggg

SEQ ID NO: 3953 - DNA, 671 bp, Lactuca sativa
cggcggggacatcatctacaatcaactcactcagtcatttctgaaaagcaatacacataaacacatggagggaaccggaaaagtgaagaagggtgccgctggaaggaagggtggtccgaggaagaagtcggtcactcgttcagtcaaagccggtcttcagttccccgtcggtagaatcggtcgttttctgaagaatggacgttatgctaagcgtgttggtaccggtgctccggtgtaccttgctgccgttctcgaataccttgctgcggaagtattagagttagcagggaatgcggccagggacaacaagaagcacagaataatcccaagacatttacttttggcagttaggaacgatgaggaacttggaaaattgttggccggagtaacaattgctcatggtggtgttctaccgaatatcaacccgattcttttgcccaagaagactgctgctgccgcagagccaaaatctccttctaaggctgccaagtcacctaagaaagctgcaaaagcctagtttaatgttacatttaatcctatgggttttaatctgttaatcgtttgtggttgattgttcgttaaagagcttagattagtttttgttaatcagatgtatccaattcgaatgaatgaaacagcttgtttcttaattttatggacttttggagtaa

SEQ ID NO: 3954 - DNA, 754 bp, Lactuca sativa
  misc_feature (666)..(666): n is a, c, g, or t
gcggggatcataacgaagcatctgctcatttctccctgtttattcatcgctaaaagaaaatggaaggcgcagcaaagtcaaagaagggtgccggaggaagaaaggccggtggtccaaggaagaaggcggttacccgctctgtcaaggccggacttcagtttcccgtcggtagaattgggcgttttctgaagaaaggacgttatgcgcagcgtgttggcagcggtgctccggtttacctcgccgctgttcttgaataccttgctgctgaagtgctagagttggctggaaatgctgccagggacaacaagaagaccagaatcattccaagacatcttctgttggccattagaaacgatgaagagcttgggaaattattgggtggagttacgattgctcatggtggtgttcttccaaatatcaatccaattctattgccaaagaagactgctgccaaggagccttcaactccatctaaagcagctaaatctccaaagaaagctaaaaaggccgagtagattatgacattagaatttgtagttctgtttggataagattatagtaaaagtttgtattctgatgttgatcaaggtttagtgaatgaaacgacttgtttcttataattgttgcaacgtgggccttcttattatattcactattttccaaatnatgccaattgagatttagttgtttaactcacttgtttttttattgctgttgtaattatctaatccgcagagcacatttgttagcatgt

SEQ ID NO: 3955 - DNA, 695 bp, Lactuca sativa
cggggacatcatctacatcaactcactcagtcatttctgaaaagcaataaacataaacacatggagggaaccggaaaagtgaagaagggtgccgccggaaggaagggtggtccgaggaagaagtcggtgactcgttcagtcaaagccggtcttcagttccccgtcggtagaatcggtcgttttctgaagaatggacgttatgctaagcgtgttggtaccggtgctccggtgtaccttgctgccgttctcgaataccttgctgcggaagtgttggagttagcagggaatgcagccagagacaacaagaagcacagaataatcccaagacatttacttttggcagttaggaatgatgaggagcttggaaaattgttggccggagtaacaattgctcatggtggtgttctaccgaatatcaacccaattcttttgcccaagaagactgctgctgccgcagagccaaaatctccttctaaggctgccaagtcacctaagaaagctgcaaaagcctagtttaatgttacatttaatcctatgggttttaatctgttaatcgtttatggttgattgttcgttaaagagcttagaatagtttttgttaatcagatgtatccaatttgaatgaatgaaacagcttgtttcttaattttatgtaccttttggagtaacttatgtttgtcgttttttggtaaaaa

SEQ ID NO: 3956 - DNA, 625 bp, Lactuca sativa
  misc_feature (508)..(508): n is a, c, g, or t
atccgaagcctcattcattcgttcactctttcgtcgacgttatcagaattcagaagatgtagggagccggaaaaactaagaaaggtgccggaggaaggaagggaggtggcccaaggaagaaggcggttacccgctctgtaaaggccggactgcagtttcccgtcggtagaattgggcgttttctgaagaaaggacgttatgcgcagcgtgttggaagcggtgctccagtttacctcgccgctgtgcttgaataccttgctgctgaagtgctagagttagctggaaatgcggctagggacaacaagaaaaccagaatcatcccaagacatcttctgttggccattagaaacgatgaagagcttggaaaattactgggtggagttacgattgctcatggtggagttcttccaaacatcaatcctattttgttgccgaagaagactgctgctaaggagccatcaactccttctaaagctgctaaatctccaaagaaagctaagaaggctgnatagattaagctgtttgaattttatccttttgtgaaaaatatagggatggggagaattgtatttcgatgatgtattttaccagaatgcataatgttaaacccttgcttcttacgatc

SEQ ID NO: 3957 - DNA, 654 bp, Zea mays
atcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaagggacacaagaagacccgcatcatcccgcgccacgtgctccttgccatccgcaacgacgaggagctcgggaagctgctgtccggggtcaccatcgcccaggggggggtcctccccaaaataaacccgggggtcctggccaaaaaaaccctttaaaaggggggggccaaggaggccaattcccccaaaaaggcccccaaatccccaaaaaggtaaagggggggggccccttaccccttgaaatttaaaagccccgtttaaaaaaaactttaccccctgggggggccccccctttttttgggaaacg

SEQ ID NO: 3958 - DNA, 601 bp, Senecio madagascariensis
  misc_feature (28)..(28): n is a, c, g, or t
aaaatttaacaagaaatggaaaccaccnggaaaatcaaagaagggcgcaggaggtcgtaaaggcggcggtccacgtaagaagtcggtcacccggtccatcaaagccggtctccagttccccgtcggtagaattggtcggtatttgaaaaacggacgttatgctaaacgtgtcggtaccggtgctccggtttacctcgccgccgttctcgaatacctcgccgccgaggttttggagttagctggaaatgcagctagggataacaagaagactagaattataccgagacatgtgcttttggcaatcaggaatgatgaggagctcggaaaattgttgtctggtgttacgattgctcatggtggtgttttgcctaacattaacccggttttgttgccaaagaagaccgctgcgaaggaggcgactaaatcgcctgttaaaactcccaagtcacctaagaaggctgctgcttagagtagtttgattaatcatggtttatcgttgtttgtatttgtagctaattcaaggatggtatttaggttgattatatctatgtttgtgtatcttgctgtttaatcaatcaaagaaaccgcttgtttctctttc

SEQ ID NO: 3959 - DNA, 698 bp, Lactuca sativa
cggcggggacatcatctacatcaactcactcagtcatttctgaaaagcaatacacataaacacatggagggaaccggaaaagtgaagaagggtgccgctggaaggaagggtggtccgaggaagaagtcggtcactcgttcagtcaaagccggtcttcagttccccgtcggtagaatcggtcgttttctgaagaatggacgttatgctaagcgtgttggtaccggtgctccggtgtaccttgctgccgttctcgaataccttgctgcggaagtattagagttagcagggaatgcggccagggacaacaagaagcacagaataatcccaagacatttacttttggcagttaggaacgatgaggaacttggaaaattgttggccggagtaacaattgctcatggtggtgttctaccgaatatcaacccgattcttttgcccaagaagactgctgctgccgcagagccaaaatctccttctaaggctgccaagtcacctaagaaagctgcaaaagcctagtttaatgttacatttaatcctatgggttttaatctgttaatcgtttgtggttgattgttcgttaaagagcttagattagtttttgttaatcagatgtatccaattcgaatgaatgaaacagcttgtttcttaattttatgtaccttttggagtaacttatgtttgtcgttttttggtaaaaa

SEQ ID NO: 3960 - DNA, 810 bp, Brachypodium distachyon
aaatcaaatcctcccagcagcagcagaaccaaatctctctcgcttccaattcccgaatcctctcacggtcagaagaaggagatggacggagccggcggcaaggcgaagaagggagccgtcgggaagaagctcggcgggccgaggaagaagtccgtgacgcggtccgtcaaggccgggctccagttccccgtcggccgcatcggccggttcctcaagaagggccgctacgcccagcgcgtcggctccggcgcccccgtctacctcgccgccgtcctcgagtacctcgccgccgaggtgctcgagcttgccgggaacgcggcgagggacaacaagaagacgaggatcatcccgcgccacgtgctgctggcgatccgcaacgacgaggagctcgggaggctactgggcggtgtcaccatcgcgcacggcggcgtgctgcccaacatcaacccgctgctgctgcccaagaaggcggccgagaaggccggcaccgagaaggtggccgccaagtcccccaagaagcccgccggcaagtcgcccaagaaggccgccgccaaggcgtagcagatctgatctcatcgtctccctgtatgtagtttagttctttgatttgtagttgtagggcccgtgtgtgtgtgtgagtgagtgagtgaggtttgatctcttcttgtgctttgccctccaatttaatcgccaaaaggaagccgcttgcttcctgttttatgatatatgcaattgcagcacttctcatcgtgtgctgatgtttcaagggtctttttgaagttcagatttgaaatacagttgatgcaccaa

SEQ ID NO: 3961 - DNA, 951 bp, Gossypium hirsutum
  misc_feature (818)..(818): n is a, c, g, or t
  misc_feature (821)..(822): n is a, c, g, or t
  misc_feature (829)..(829): n is a, c, g, or t
  misc_feature (832)..(832): n is a, c, g, or t
  misc_feature (842)..(842): n is a, c, g, or t
  misc_feature (844)..(844): n is a, c, g, or t
  misc_feature (847)..(847): n is a, c, g, or t
  misc_feature (852)..(853): n is a, c, g, or t
  misc_feature (856)..(856): n is a, c, g, or t
  misc_feature (858)..(864): n is a, c, g, or t
  misc_feature (866)..(866): n is a, c, g, or t
  misc_feature (879)..(879): n is a, c, g, or t
  misc_feature (882)..(882): n is a, c, g, or t
  misc_feature (884)..(884): n is a, c, g, or t
  misc_feature (888)..(888): n is a, c, g, or t
  misc_feature (890)..(890): n is a, c, g, or t
  misc_feature (896)..(897): n is a, c, g, or t
  misc_feature (901)..(901): n is a, c, g, or t
  misc_feature (905)..(905): n is a, c, g, or t
  misc_feature (916)..(916): n is a, c, g, or t
  misc_feature (918)..(918): n is a, c, g, or t
  misc_feature (921)..(922): n is a, c, g, or t
  misc_feature (931)..(931): n is a, c, g, or t
  misc_feature (934)..(934): n is a, c, g, or t
  misc_feature (937)..(938): n is a, c, g, or t
  misc_feature (941)..(942): n is a, c, g, or t
  misc_feature (944)..(945): n is a, c, g, or t
acacaaacattttctcgagaaaattttacttcgaaatttcctttcctttttcgattttttcctccgatttgtatttgaagtgatggatgcaggatcaaaggtgaagaaaggagccggaggaaggaaaggcggcggtccaaagaagaagccggtttctcgttcggtgaaagccggattacagtttcccgttggtcgaattggccgatacttgaagaaaggccgatactctcaacgtgtgggaaccggtgctccggtttaccttgctgctgttcttgaataccttgctgctgaggttcttgagttagctggtaatgctgcaagagacaacaagaagaataggatcattccaaggcatgttctattagcagtgagaaacgatgaagagcttgggaagcttttagctggtgtgactattgctcatggtggtgttttacccaatattaacccagttcttttaccaaagaaaaacgagaaagcggctgcaaaagagcctaagtcgccatctaaggctacaaagtctccaaagaaatcacctaagaaggcttagttgtttgtctattatagggtttgttttgatttatctgttaatgtatgtaggttccttttgtgtactttggttgtaggaaaatgttggtaatgttgtttagaatatgttttgtttgaaatgaatgaactgaaattcagattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggnccnnttaaaanaancaaattttantnccnggggnntgnannnnnnnantttttttttaggncancnaaantnaaatanngggngggnttttaaaaacntnggnnggggaaaanccnggnnttnncnnaattaa

SEQ ID NO: 3962 - DNA, 894 bp, Lactuca sativa
cggggtcgcaactctctttagcgggagattgaaatattattggaatttcaaattgtgctcatctcacgcggatcgtgattcaacaaataagaaccgttgattaagacttcatccaacggttgaaacaatgcaatcgatccatagcccccgccacccacctttacataatcaaaccatgtcgatgtttgctcatcaccgaaatccaagcctcaatcgttcgttgactctttcgtcgacgttaatcagaattcaaaagatggagggagctggaaaagctaagaaaggtgccggaggaaggaagggcggtggcccaaggaagaaggcggttacccgctctgtcaaggccggactgcagtttcccgtcggtagaattgggcgttttctgaagaaaggacgttatgcgcagcgtgttggaagcggagctccagtttacctcgccgctgtgcttgaataccttgctgctgaagtgttagagttagctggaaatgcggccagggacaacaagaaaaccagaatcatcccaagacatcttctgttagccattagaaacgatgaagagcttggaaaattactgggtggagttacgattgctcatggtggtgttcttccaaacatcaatcctattttgttgccgaagaagactgctgctaaggagccatcaactccttctaaagctgctaaatctccaaagaaagctaagaaggctgaataggttaagctgtttagaatttatccttttgtgaaaaatatagggatggggagatttgtattcgatgatgtattttaccagaatgcataatgttaaacgcttgcttcttacgatctactgtttaggctttatgacttctatcttagaatgaatctttcaataattcatggagattttgatttccc

SEQ ID NO: 3963 - DNA, 817 bp, Persea americana
ttgagcgatatttcggcgagaaattggagaaatggagggaggcgggaaggtgaagaagggagcggcagggagaaaaggtggcggcccgaagaagaagccggtctccagatcagtcaaagccggtctgcagttcccggttggaagaatcggccgatatctgaagaagggacgatattctcagcgagttggaacgggcgctcctgtgtatctcgctgctgtgcttgaatatctcgccgctgaggtactggaattggctgggaacgctgcacgtgataataagaaaaacaggatcatccctaggcacgtgctcttggctgtaaggaacgatgaggagctgggaaagcttctagcaggagtgaccatagcccatggtggggttattcccaacatcaaccctgtcctccttcccaagaaaactgcagaaaaggcagccaaagagcccaagtcatcttcaaaagcccctaaatctcctaagaaagctgcagctgcttgatatgacatcattttaagtcctcttctttactgttctctgtcttcaatcccttttgtaattgtggatttactttacctttgttgtgtagactaggggatgggagatttaaaccattggaattagcttttttttttcttagaacttaatggcagtggttttagcttgttaatttctagaagatctttgtgtgtgatctgaaccttgtggcaagttggatttgcaaaatttgatgtgtagttagtgtctaaaatgagggttttgatgtttatggagctaatagtatgaattgggaatttgattttttcttaatattaaaaggagtag

SEQ ID NO: 3964 - DNA, 1261 bp, Persea americana
  misc_feature (1216)..(1216): n is a, c, g, or t
tagcctacaagcttttttatgcaatttcattgctaatactctcttcaaatgtctaattaaaagggtgaaggattgaacaaatacatacaatcagaaggcaaactcccaataagtttcataataaaaataaataaatacaaaatcttccaatatgtttgatccaacgattgatacaatagcagaccctcattttagatgtgaatcattccatcccacaacttgtaaataggtattaggtactcaaaaataaatatataggcagacctcgaattcaatgccaaatgctcacccatttgtactctacacactggttggttagaattgtcgagtctctgaacctcaatggaaattcaccgaaaaagaaaaatcagtttagttcgccactgaatggatgatctgcattgtataggatgttcatactcacaatttgaggaaagcagcccacacgcgaattcgcgtgtgggatttcggcgagaaattggagaaatggagggaggcgggaaggtgaagaagggagcggcagggagaaaaggtggcggcccgaagaagaagccggtctccagatcagtcaaagccggtctgcagttcccggttggaagaatcggccgatatctgaagaagggacgatattctcagcgagttggaacgggcgctcctgtgtatctcgctgctgtgcttgaatatctcgccgctgaggtactggaattggctgggaacgctgcacgtgataataagaaaaacaggatcatccctaggcacgtgctcttggctgtaaggaacgatgaggagctgggaaagcttctagcaggagtgaccatagcccatggtggggttattcccaacatcaaccctgtcctccttcccaagaaaactgcagaaaaggcagccaaagagcccaagtcatcttcaaaagcccctaaatctcctaagaaagctgcagctgcttgatatgacatcattttaagtcctcttctttactgttctctgtcttcaattccttttgtaattgtggatttactttacctttgttgtgtagactaggggatgggagatttaaaccattggaattagcttttttttttcttagaacttaatggcagtggttttagcttgttaatttctagaagatctttgtgtgtgatctgaaccttgtggcaagttggatttgcaaaatttgatgtgtagttagtgtctaaaatgggggttttgatgtttntggagctaatagtataaattgggaatttgattttttcttaatatt

SEQ ID NO: 3965 - DNA, 659 bp, Hordeum vulgare
ccaccaaccaccatcaccaaatctctctgcccctatccagctttctctcaaaagctccgtctgtcagcaatggaggtttcaggcgctgcagcgaagggaaagaagggcgctgcagggcgcaaggccggcggcccgaggaagaagtcagtgacgcggtccgtgaaggccgggctccagttccccgtcggccgcatcgggcgctacctcaagaagggccggtacgcgcagcgcgtcggcaccggtgcccccgtctacctcgccgccgtcctcgagtacctggctgccgagctgctggagctcgccgggaacgccgccaaggacaacaagaagagccgcatcatcccgcgccacctgctgctcgccgtcaggaacgacgaggagctcggaaagctgctggccggcgtcaccatcgcgcacggcggcgtgatccccaagatcaacccggtgctgctccccaagaggaccgcggagaaggagggcaaggggcccaagtcccccaagaaggccaccaagtccccgaagaaggccaccaaggcttaggaacacgcataggttgatgtaggttgcttaatgtctgtaacattggtcgttgtttggctaatggtgtcgatgtaatctttgctgttaagagtaatgtcagaaatcactctgatccggaa

SEQ ID NO: 3966 - DNA, 687 bp, Hordeum vulgare
accaactcaccccgcaatccaccaaccaccatcaccaaatctctctgcccctatccagctttctctcaaaagctccgtctgtcagcaatggaggtttcaggcgctgcagcgaagggaaagaagggcgctgcagggcgcaaggccggcggcccgaggaagaagtcagtgacgcggtccgtgaaggccgggctccagttccccgtcggccgcatcgggcgctacctcaagaagggccggtacgcgcagcgcgtcggcaccggtgcccccgtctacctcgccgccgtcctcgagtacctggctgccgagctgctggagctcgccgggaacgccgccaaggacaacaagaagagccgcatcatcccgcgccacctgctgctcgccgtcaggaacgacgaggagctcggaaagctgctggccggcgtcaccatcgcgcacggcggcgtgatccccaagatcaacccggtgctgctccccaagaggaccgcggagaaggagggcaaggggcccaagtcccccaagaaggccaccaagtccccgaagaaggccaccaaggcttaggaacacgcataggttgatgtaggttgcttaatgtctgtaacattggtcgttgtttggctaatggtgtcgatgtaatctttgctgttaagagtaatgtcagaaatcactctgatccggaaaaaaaaaaaa

SEQ ID NO: 3967 - DNA, 625 bp, Cichorium intybus
cgacactcatttctgagatccttagacggagagaaatggaaggaaccggaaaagcgaagaagggcgccgcaggaaggaagggcggtccaaggaagaaggcggtgagccgttcagtcaaagccggtttgcagtttcccgttggtagaatcggtcgatatttgaagaaggggcgttatgctaaacgtgttggaactggtgctacagtttatcttgctgccgtcctcgaatacctcgctgctgaagtgctagagttggcaggaaatgcagccagggacaacaagaagaccagaataatcccaaggcatctactgttggccattaggaacgatgaagagcttggaaaattattggctggagtaacaattgctcatggcggtgtcctaccaaatatcaaccccattctattgcccaagaaaactgctgctgctaaagagccaaaatctccttctaaggctgcaaagtcacccaagaaagccgtaaaagcttagtttattttatatatgcttgtatgggtcttgatcttctaatcattcatgttggctgaattgttaaagagcgtagaatagtttatagattatcagatgtatccaatttaaatgaatgaaacaacttgtttcttttttca

SEQ ID NO: 3968 - DNA, 737 bp, Saccharum officinarum
cgcttcctccaaaccccaatcatcacttccctccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctggccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctccctccactccgtcctcctccccaagaaggccgccgagagggctgagaaagtcgcccaagaaggccgccgccgccaagtcggccaagaagtagcgtgcctgcctcgtctcatctgatcctgatctcagcttggctgagtggtcgtggatccttttgctgttcttgcgtgtctgtgtatgtagtgatgcgtcgcctcatgtgtcgtgtgtctcgatcgatctagttctggttcaatctctagctgtagtggtggttggtcatgggatctccatgttacctaagatttaatgagaacaagaggaagtgc

SEQ ID NO: 3969 - DNA, 678 bp, Taraxacum officinale
  misc_feature (674)..(674): n is a, c, g, or t
  misc_feature (676)..(676): n is a, c, g, or t
cgggatctcatccttgtctacatagccataaattacttcttttcatatccaaaaagagaaatggaaaccaccggaaaagcgaagaagggtgccggaggaaggaagggcggcggcccaaggaagaagtcagtgactcgatccgtcaaagctggtctccagtttccagtcggtagaattgggcgataccttaagctcggacgctacgctaaacgtgtgggaaccggtgctccggtctaccttgccgccgttctcgaataccttgccgctgaagttttggagttagcaggaaatgccgcaagggacaacaagaagaccagaattatcccaagacatgtccttttagccatcaggaacgacgatgaacttggaaaacttttgggtggtgttaccattgctcatggaggtgttcttcccaatatcaacccagttctattacccaagaagaccaccccatcagagcctaaatctccatcaaagggtgccaagtcgccgaagaaagctgccaaaactccaaagaaggctgaataggctactgtagttcggttgttgttcatctgtgtgtatttgtcgttaaattgcatatggagttagttttctaacaattgcgttcgtttagactgtctattttgtggtacaacctttgttatcaatggaagaaacctcttgtttctaananag

SEQ ID NO: 3970 - DNA, 582 bp, Zea mays
atcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccggcaacgcggcgaaggacaacaagaatacttttatcgtcccgcgacacttgctcctggcgatcgtaacgacgttgagctcgcaatttgctgtctggcctcaccatcgcgcacggcggtgtcctccccaacatcaacccggttctcctgcccaaaaagtggccggaaaaggcgtctagccgccgcacaaaggaaaacaagtcccctaaaaaaggcgcccagtccccaaaaaaagcagccaaatcccctaagaaggctaagaaattaa

SEQ ID NO: 3971 - DNA, 787 bp, Panax ginseng
cggggattgcaaatcaatctcgcttcagataagttgtagggtttatattgtcatttgccccagttcaattagttgagagagtgaaatggataacactggaaaagggaaaaaaggcgccggcggcagaaagggaggcggcccaaggaagaaggcagttacccgctccgccagagccggtttacagtttcccgtcggtagaattggccggtatctcaagaagggtcgctatgctcagcgtcttggaaccggtgctccggtttacttggccgccgtgctcgaatacctagctgctgaagtattggagttggccggaaatgctgcaagagacaacaagaagaacaggattattccaaggcatttgctgttggcagtgaggaatgatgaggagctggggaaattgctgggcggagtgacaattgcacatggtggggtgttgccaaatataaacccagttttgttgccaaagaagactgataaggcaaccaaggaacccaagtctccttccaaggcagctaccaagtcccccaagaaagcttaagttcattgattagattttctgttctattagcccaatcagtcatattagtagattaaggcttaattttctctctatccccttgtatgtaatattgggtttttatggaacatgttttgttgaatatctcttttaagtgaatttgggaagatggatattccaagtccgcaccctcattatgagggttaatgttggtgaagatttctatttgctcaatggaagatattacttactgataagggtgtaatgaat

SEQ ID NO: 3972 - DNA, 829 bp, Orobanche aegyptiaca
catatattcttttcttcatttctttttctatcattcacttctaccacaccaaagaaatatggaagccagtgggaaagtgaagaagggagccgctgggaggaagatcggcggcggtccgaggaagaagtcggttacccggtccgtgagagctggtctccagtttccggttggcaggatcggccgttatctgaagaaaggccgctatgcgcagcgcgttggtaccggtgctccagtatacgtggctgctgtgcttgagtaccttgctgctgaggttctggaattagctggaaatgccgcgagagacaacaagaagaacaggataattccgagacacctactgcttgctgtgaggaacgatgaagagcttgggaagcttcttgctggagttacgattgctcatggtggagttataccaaacatcaatcctgttctgttgcctaagaagaatgagaaggacggtgagaagacacctaaatccccagcaaaaaaggccaccaagtctccgaagaaggcataaattagtgtttattgttgaatctgtgatcgaatcacttttgttttcatcaggggttatgttcttgtgtttaggcggagacggtgtttataacttttgtagtaatttgtattttatcctttttagtagttattctgttaaatcccattatttaaatttaatggaaagacagtttccttttcaatttcatatgaatttttttttttttttatttttgacttgttcttcgctggactttgcgtttgaattttcttggaactttttccagtagcacaaaactccgtttatttccacaccggatagttattctttggt

SEQ ID NO: 3973 - DNA, 737 bp, Tragopogon dubius
acgctctctctctctttacctcacctcaagtcaaaaactcgccggaaaacctctactccctccatttgtaccgatcattttctggaatggagaccagtgggaagttgaaaaagggtgctgctggaaggaaggccggcggtccgaagaagaagtcagtcacccgttccgtcaaggccggtcttcagttccccgtcgggagaatcggtcggtacatcaagaatggacgatacgctaagcgtgtgggtaccggtgctccggtttacctcgctgccgttctcgagtaccttgctgctgaggtgttggagttggctggaaatgctgctagagataacaagaagagcaggatcataccaaggcatgttttgttggctgtgagaaatgatgaagaacttggaaagcttctagctggtgtgacgattgctcatggtggtgttcttccaaacatcaatccagttcttttgccaaagaagaatcttgataaagctgaaaaagaaacaaccaaatcaccaaagaaagcagccaaatccccgaagaaagcttaggtgttgaagaaaagagatctgtaatgctctgtttgtatttattcaccttctgttggtgatgtaagtttgatgcgttttggggtagatttagaagtgttgtattttgggttgtttaagttagggtgtaggattgaagaagaatctctctttttccttaatgaaatatttagtttagcacaaaaaaaaaaaaaaaaa

SEQ ID NO: 3974 - DNA, 724 bp, Catharanthus roseus
actagtggatccaaagaattcggcacgaggccaaaattcatcgttgtatcaattgtttattgctcttttaatttgattaatctcaagtgtagcggaatcgatggagactgcaggaaaagtgaagaagggtgccgccggaaggaagggcggtggccctaagaagaagcccgtcactcggtcaactagggctggcttgcaatttccggtcggcagaattggccggtacttgaagaagggtcgctattctcagagagttggtactggtgctccggtttatatggctgcggtccttgaatatttagctgctgaggttcttgagttggctggaaatgctgctagggataacaagaagaacagaataatcccgaggcatgtgcttttggccataagaaatgatgaagaacttgggaaattgttggctggtgtgacaatcgcacatggtggagtgctacctaacataaaccccgtcttgttgccaaagaagactggtgaaaaggtcgccacaaaagaacccaaatctccatcaaaggctacaaaatcccccaaaaaggctgcttagatttgtctaattggattaggcttcttcctttatctagcgtagctcctatgtgtatgtaatgtgggttagagtatttttagccttttgatatggataggagaaaatggtattgtaattgtaaacttgtgatttaggattttcaatttgaatggatcaacttggttg

SEQ ID NO: 3975 - DNA, 958 bp, Catharanthus roseus
ccaaagaatcggcacgaggctcgggcaaaaatatcttctggtatttttattttcttcactagtcgctctagtggtgactgttactgtagtgtagttttaccatttctcggccaccgtgacggatacatggatacggctactgggaaaatgaagaagggagctgctggcaggagaggcggcggtcctaagaagaagcctgtctcccggtcctccagagccggtctacagttcccggtcggaagaatcggccggtacctgaagaaaggtcgatattcgcagcgtgtaggaaccggcgctcctgtctatatggctgctgtcctcgagtaccttgctgctgaggttttagaattggctggaaatgctgcaagagacaacaagaagaacaggatcataccccgacatgtgctgttagctgtgaggaatgatgaggagcttgggaaacttcttgctggtgtgaccattgctcatggaggcgtgcttccaaacattaacccagttcttctgccgaagaagaatgagaaggctgctgcaaaggaaccagccaagtctcctgctaagggcaccaagtcccctaagaaagcttagtttctcatctgttaagaaagggctttgcctctaatctctctgtatgtaatgtcattttctgttctcagtatgtagaagacatttccaaaatttgatcattctgctattgcttttgttttttgtgttaggacatcctgtggctaaaattgatagaatgaatttagattaatcagctcatgtgtagtgtttctattgtgttgaagttcctttaatgtttgttttggatgaaaaatgcttgcttggcttgtaattgtgccgttgatttgatagaaaggaaatagtttgctggttacctattttgttttcttgatttccattctatcacttgtatcctgtttcacttcattgtatagagggtagcagcaattgatgc

SEQ ID NO: 3976 - DNA, 805 bp, Catharanthus roseus
actagtggatccaaagaattcggcacgaggcttcgtttcatcagttttatcattcaattctatcccttttttgacttatcccaagtgtagtggagtcgatggatactgcaggaaaagtgaagaagggtgccgccggaaggaagggcggtggccccaagaagaagcccgtcactcggtcaactagggctggcttgcaatttccggttggtagaattggccggtacttgaagaagggtcgttattctcagcgagttggtaccggtgctccggtttatatggctgccgtccttgaatatttagctgctgaagttcttgagttggctggaaatgctgctagggataataagaagaacagaataatcccaaggcatgtgcttttggccataagaaatgatgaagaacttgggaaattgttggctggtgtgacaatcgcacatggtggagtgctacccaacattaaccccgtgttgttgccaaagaagagtggtgaaaaggttgccaccaaagaaccgaagtctccatcaaaggcaacaaaatccccaaagaaggctgcttagatttgtctaatctgattaggcttcttccttttatcctttgctagcgttgctccgatgtgtatgtaatgtgggttagagcctttttagccttatgttttggaggatagcagaaaatggtattgtaattgttagcttgtgatttaggagcttcaacttgaatcgataaatctgattgaatggaatggcttttgatgaatctgcacgtttttttttttactctttttcatttgaaatttaccaattctcaa

SEQ ID NO: 3977 - DNA, 824 bp, Centaurea maculosa
  misc_feature (776)..(776): n is a, c, g, or t
aagaatcccccaaaaagctcttttacaaattctatccattttccaccttattcgttaagctccttcttctcttattgaaaaatggagaccggtgggaagttgaaaaagggcgctgccggaaggaaggccggcggtggtcccaagaagaagccggttacccgctccgttaaggccggtttgcagtttccggtcggcaggatcggccggtacctgaaaaaaggccggtattccaagcgtgtcggtaccggagctccggtgtacctcgccgccgttctcgagtaccttgctgctgaggtgttggagttggctggaaatgctgctagggacaacaagaagaacaggatcatacccagacatgttttgttggctgtgagaaatgatgatgagcttggaaagcttctctctggtgtgacaattgctcatggtggtgttctaccaaacatcaatccagttcttttgccaaagaagtcacatgaaaaagctacaaaggaaccttcaaaatctccatccaaagcaaccaagtccccaaagaaagcttagttgttgaacagtctctttattctccttgtatctatctattcacctctttttggtgatgtagggatatattaaatgaaatgttatgatggtgttttttagggagatttagaagtacttgtcttttgatatatgattatgtttaggagctaggtttgaagaagaagaatctctctttttctgaatcttttttagatgggtgttacatttgtataagaaaattgttaaagattgctcanatatgttgatgtgtttcttggacaaaacaaatcaaacagggccgcctc

SEQ ID NO: 3978 - DNA, 740 bp, Zingiber officinale
gaggggaaggtaggacgcggggggattgtttcgcgactctcgcccaattgtatcaggggtcttttcggtccaaaccggcacgttacactcgagggcggagatggagacaggtggcaaggcgaggaagggcgccggcggccggaggggcggcggcggacctaagaagaagccggtctctcgatcggtgaaggccggcctccagttccccgtcggtcgcatcggccgctacctcaagcacggacgctacgcgaagcgcgtcggcaccggcgctcccgtctacctcgccgccgtgcttgaataccttgcggccgaggtgctggagctggcggggaacgcggcgagggacaacaagaagacccggatcgtaccgcggcatgtgctgctggcgattaggaacgacgaggagctagggaagctcctcgctggcgtcacgatcgcccatggaggggtgctgcccaacatcaacccagtgctgttgccgaagaaaaccgccagcaaggagcccaagtcgccgagtaagcccgccggcaaatcgcccaaaaaggcttgatttggagctccagttctcgcccttgttctttatccgtaagtaatttttatggtaaaattagcttctttttcccccttttgtctggtggactggtggaatgtaatgtggatgactgatgtgatcgaactaagcagtattaacctgtgcaatctagtatgattctaattcttgttattcgcgttacatcttt

SEQ ID NO: 3979 - DNA, 734 bp, Actinidia deliciosa
  misc_feature (19)..(19): n is a, c, g, or t
  misc_feature (36)..(36): n is a, c, g, or t
  misc_feature (73)..(73): n is a, c, g, or t
  misc_feature (77)..(77): n is a, c, g, or t
  misc_feature (95)..(95): n is a, c, g, or t
  misc_feature (105)..(105): n is a, c, g, or t
  misc_feature (118)..(118): n is a, c, g, or t
  misc_feature (132)..(133): n is a, c, g, or t
  misc_feature (176)..(176): n is a, c, g, or t
  misc_feature (194)..(194): n is a, c, g, or t
  misc_feature (203)..(203): n is a, c, g, or t
  misc_feature (386)..(386): n is a, c, g, or t
aaaaatcccccacctgacnaatccctattttccggntgtttgtttctcgggaaaactgtttttttccgaattnaaantttgggataatggaggcnggaggaaagncgaggaaaggcgngggggggagaaagnntggcggtccgaagaagaaaccggtgtcccgatccgtcaaagcnggattgcagttcccggtnggccggatnggccggtatttgaagaagggtcgttacgctcagcgcgtcggaaccggcgctccggtctacctcgccgccgtgctcgagtacctcgctgccgaggttttggaattggctggcaatgctgcgagagacaacaagaagaacaggatcataccgaggcacgtgcttttggcggtgagaaacgacgangagcttggaaagctgcttgctggtgtgacgattgctcatggaggagtgcttcccaacatcaacccagttcttctccccaagaagaacgaaaaggtggcgacgaaggagcccaagtctccgtccaaggcaaccaagtcaccgaagaaagcagcttaacttcttaggatgttgaagaaagacttttctgcttgtagactctctctctgtatgtaatttggagttctttatttgtgctgtgtaggaaatcctcatgtaatcaggagatatttgtactctttgttttgaatccttgttttaaacatctttgtttggaatgaaagaaatgaattcctagtttaaaaaaaaaaa

SEQ ID NO: 3980 - DNA, 588 bp, Carthamus tinctorius
gcggggatatcaattaatcatcacttgtcaacaacacagcgagaaaaaggagaaaaaatggagactaccggaaaagcgaagaagggcgccggtggccggaaaggaggcggtccaaggaagaaggcggtgactcgctccatcagagctggcctccagttccccgtcggcaggatcggccgttaccttaagaacggccgttatgctaagcgcgtaggtaccggtgctccggtctacctcgccgccgtcctcgaataccttgccgctgaagttttggaattggcagggaatgcagcaagggacaacaagaagaacagaataatcccaagacatgttctgttggcaatcaggaatgatgatgagcttggaaagctgttggctggagtgacaattgcacatggtggtgttcttcccaacatcaacccaattctgctgccaaagaagacagctgcaaaggagcctaaatcaccatcaaaagctaccaaatctccaaagaaagctgattaggttatgaagataatgaaatggtgttgtttatctcttgtctgtaatttgtagttaatttggaaatggaatttagttttctcctaa

SEQ ID NO: 3981 - DNA, 633 bp, Helianthus annuus
  misc_feature (6)..(6): n is a, c, g, or t
ttatgnggccggggacacaaaaccatttcccacacagaaacacacacaaaacaaaatcccaaatggaaaccaccggaaaagctaagaagggtgtcgcaggtcgcaaagccggcggtccaaggaagaagtccgtcacccgctccgtcaaagccggtctccagtttcccgtcggcagaatcggccgttacctcaaacacggccggtatgcaaagcgtgtcggtaccggtgctccggtttacctcgccgccgtcttggaataccttgcagctgaagtgttggaattggctggaaatgcagctagggataacaagaagaacaggataacaccgagacatgttttgttggcgataaggaacgatgatgagctggggaagttgttggccggagttacgattgctcatggtggtgttttgccgaacattaacccggtgttgttgccgaagaagagtgctgctgctgctaaagagactaagtcgcctgttaaacctggaaagtctcccaagaaggccgcataatttgggttgggttaagttgtagttaaaattgggaatgaatgtagtttggtaatagtgtttgttatgtttatgttgaggttaatgaatgaatgaaagaaaccgcttgtttcgctaaaaa

SEQ ID NO: 3982 - DNA, 581 bp, Artemisia annua
cagtggtatcaacgcagtactccgacgggaaaacaaaaacaaaaacaacttcatcttcatccaaatctaaatcctaacacaaacttttttatatttctaaaatggaaacaggtggaaagaaaaagggagcagcgggaaggaaagggccagcagggccaaggaagaagtcggtgacgaggtctgtgaaagctggccttcagtttcctgttgggagaattggaaggtatttgaaaaatgggaggtatgctaaacgtgttgggactggtgctcctgtttatcttgctgctgtccttgagtaccttgctgctgaggttttggagctagctggaaatgccgcaagggacaacaagaagtcaaggatcattccaagacatgttttgttggccatcaggaatgacgatgagctaggaaagcttttatctggtgtgactattgctcacggtggtgttcttccaaacatcaacccggttctattgcctaagaagagtgccacaaaggaatctacccccaagtctccagcgaaagcggccaagtccccaaaaaaattaccgattcaccacacgattctcaagagtgcgtct

SEQ ID NO: 3983 - DNA, 669 bp, Jatropha curcas
aaaaaaaaaaaaaagaaaagaactagacaataaacgggtcggactttcggcggagatggattccggagcaaaagtaaaaaagggagctggtgggaggaaaggcggaggtccgaagaagaagcctacttctaggtcagtcaaagccggtcttcagtttcctgttgggagaatagggcggtacttgaagaagggaaggtatgcgcagcgggttggatccggagctccagtttacatggctgctgttctcgagtacctagctgctgaagtattggaattggctggtaatgcagctagagataacaagaagaacaggataataccaaggcatgtattgcttgcagttagaaatgatgaagagcttggaatcaccgcagagtgaccattgctcatggaggtgttcttcccaatattaatcctgttcttttgcccaaaaagtcagagaaggctactaaagataaggaacctaaatctccatctaaggcaacaaaatctccaaagaaagcttaagtcatttctgttgttattctcttgatcttgttgtatgtgatttagagtatattttgttaatgtgtaggaaaattgagttgatggattttgaaaatttgtgtagtccctttatctttctgatagatgttaggattgacatttgagattaatggatggaacttt

SEQ ID NO: 3984 - DNA, 744 bp, Tropaeolum majus
cggccggggaacctcataaacgctcgaatcattttaccggcggcctcaaaacagtaactctcttaaatatattattctgacattgaattctcatttcttgcctagagataaatggacgccggagggaaagcaaaaaagggcgccggaggtaggaaagcaggtggtccgaagaagaaggctgttaccaggtccattaaagccggtcttcagtttcctgttggtaggattggtcggtacctgaagaaaggccgttactctcagcgttggtgctccggtctatctcgccgctgttcttgagtaccttgctgctgaggttcttgaattggctggtaatgcggcaagggacaacaagaagaatcggattataccgagacatcttctattggcagttaggaatgatgaagagcttgggaagcttcttgctggcgtaacaattgcgcatggtggtgtgttgcctaacatcaatcctgtattgcttccaaagaaatctgaaaaagctggtgccaaagaagccaagtctcccaagactactaaatcgcctaagaaggcttaggttactattgtgtacgtactttactaagtgtatctactcgtccaaagatttcgatccttagaacttaagaaaccatttgtatttctttcttgttttatggaacttacattatctgaatgaggataccaaatttctaaatgctagtatgttgcagaaaatgctatgtccagatttatactattttaccactt

SEQ ID NO: 3985 - DNA, 752 bp, Tropaeolum majus
acagatcaaatttccagcaactcccaaaacaaactttcatttcttactgattccttctcttttccgtccaaaaataaacaattatctccatttgtgtagaaacatggatactggaggaaaaggcaagaagggtgcaggaggaaggaaaggaggcgatcagaagaagaaaccagttacgaggtccattaaagctggtctacagtttccggtggggaggatcggtcgttacttgaagaaaggccgctacgctcagcgtgttggaagtggtgcccccgtatatctcgccgccgttctcgagtaccttgctgctgaggttcttgaattggctgggaatgcggcaaaagataacaagaagactagaatcataccgagacatatcctgttggcagtgaggaacgacgaagaacttggaaaacttcttgcaggtgttacaattgctcatggtggagtgttgcctaacatcaaccctgtgttgctacccaagaaaaccgaaaaggcaggtaaggaacccaagtctccatcaaagacaactaaatcttccaagaagccttaatctttgtcttgcttgtgcaagcattgtgttttttaatactttgtttaaaatggaaaaccatgtgtactactgctgttgtaggaatgctttaggtttgtcggaataggatctattgttgaacatctttgtttttaaaaaaaaaaatgtaatccgagaggaatctggtttctaaataattgggcataactttattcttcca

SEQ ID NO: 3986 - DNA, 760 bp, Orobanche aegyptiaca
cacagagataaacaaacagaaaactaaaatggatgctagtgcaaaggtaaagaagggagctggtgggagaaagggcggcggtccgaagaagaagccagtttctcgatccgtgaaagcgggtctgcagttcccggtcggtaggatcggacggtatctgaagaagggacgctattctcagagggtcggtaccggtgcaccggtttacctggccgcggtgctggaataccttgctgctgaggttctggaattggctggaaatgcagcaagagacaacaagaagaataggataatcccaaggcatcttttgcttgctgtgaggaatgatgaagagcttggaaagcttctagctggagttacaatcgctcatggtggagttatacctaacattaaccctattctgttgcctaagaagactgataaggccgctgagaagacccctaaatccccagcaaaggccacaaagtcgcctaagaaggcttaaatattctacttggatctgggattgactgacttttgttgtttctttagggtttatgttctgattaggtaggagatggtgtttataacttcagtaataatttgtactttatccctttaatgggtacttctgtgaaatcctattaatttaaattttaatggagagacggtttcaaattgatctgctttatttacgtaatttgaaagatttgtatcatggagtttggtgagtatgatttgtatccaagataaccctagatccaagttataccaaacattaact

SEQ ID NO: 3987 - DNA, 672 bp, Pisum sativum
tcaacatccaattctaacaaagcaccgaaatcacagcaactatctagggttcgaaatggacgcaagcacaaagacaaagaagggagccgcaggaaggaaaggaggaggaccaaggaagaaatcagtaaccagatccgtcagagctggacttcaatttcccgttggaagaatcggtcgtttcttgaagaaaggtagatacgctcaacgtgttggtactggtgctccagtttacttggctgcagttctcgaatatcttgctgctgaggttcttgagttggctgggaatgcagcacgtgacaacaagaagaaaagtatcagtccaagacatttgttgttagctgtgaggaatgatgaagagcttggaaaattgcttgctggtgttactattgctcgtggtggtgttcttcctaacatcaacccagtgcttttgcctaagaggactgaaagtgctgctactgctcccaagtcgccttccaaggcaaggaaatctccaaagaaggcttagattagttttctgacttgtgtgtataaccgagctctaggtctttctatgtaacagaatgatttattgcttctgaaaaaatctaattcgatttcactgtctctgatcaagtattagtaaatgaactattcagttgaaacaacttgcttcaactgtcttgcttttcctaa

SEQ ID NO: 3988 - DNA, 606 bp, Taraxacum officinale
  misc_feature (14)..(14): n is a, c, g, or t
  misc_feature (258)..(258): n is a, c, g, or t
  misc_feature (604)..(605): n is a, c, g, or t
gcggggattcacangcaaatcgctcagtcatatttgaaaaacactatacagagaaatggagaagaagggtgccgccggaaggaagggtggtccaaggaagaaggccgtgagtcgttcagtcaaagccggtctccagttccccgttggtagacttggtcgatatctgaagaacggacgttatgctaaacgtgtcggaaccggtgctccggtataccttgctgccgtcctcgaataccttgccgcagaagttctagagtnagcaggaaatgcggccagagacaacaagaagaccagaatcatccccagacatgtgcttttggctgtgaggaacgacgaagagcttggaaaattgttggccggagtaacaatcgctcatggtggtgttctacccaacatcaaccctgttcttttgcccaagaagactgcggctgccaaagagccaaaatctccatccaaagctgctaaatcacccaagaaggctacaaaagcttagtttaagttgctttgtaatcatttgtgtttgctagctcgatgaaaatcctagagtagtttatatattgtcagatgtatccatttttaatgaatgaaacaacttgtttcttanna

SEQ ID NO: 3989 - DNA, 626 bp, Lactuca sativa
catcatctacaatcaaatcaatcggtcatttctgaaaagcactacacttaaacacatggagggaaccggaaaggtgaagaagggtgccgccggaaggaagggtggtccgaggaagaagtcggtgactcgctcagtcaaagccggtcttcagttccccgtcggtagaattggtcgttttctgaagaatggacgttatgctaagcgtgttggtactggtgctccggtgtaccttgctgccgttctcgaataccttgctgccgaagtgctagagttagctgggaatgcagccagggacaacaagaagcacagaataatcccaagacatttacttttggcagttaggaacgacgaggagctaggaaaattgttggccggagtaacaattgctcacggtggtgttctcccgaatatcaacccaattcttttgcccaagaagactgctaccgctacagagccaaaatctccttccaaggctgccaagtcacccaagaaagccgcaaaagcctagtttaatgttatattcaatcctagggaatcattcgtgtttgattgttctttaaagatcgttgaacagtttttagtcaatcagttgtatccaattcgaatgaatgaaacaacttgtttct

SEQ ID NO: 3990 - DNA, 628 bp, Lactuca sativa
catcatctacaatcaaatcaatcggtcatttctgaaaagcactacacttaaacacatggagggaaccggaaaggtgaagaagggtgccgccggaaggaagggtggtccgaggaagaagtcggtgactcgctcagtcaaagccggtcttcagttccccgtcggtagaattggtcgttttctgaagaatggacgttatgctaagcgtgttggtactggtgctccggtgtaccttgctgccgttctcgaataccttgctgccgaagtgctagagttagctgggaatgcagccagggacaacaagaagcacagaataatcccaagacatttacttttggcagttaggaacgacgaggagctaggaaaattgttggccggagtaacaattgctcacggtggtgttctcccgaatatcaacccaattcttttgcccaagaagactgctaccgctacagagccaaaatctccttccaaggctgccaagtcacccaagaaagccgcaaaagcctagtttaatgttatattcaatcctagggaatcattcgtgtttgattgttctttaaagatcgttgaacagtttttagtcaatcagttgtatccaattcgaatgaatgaaacaacttgtttctta

SEQ ID NO: 3991 - DNA, 602 bp, Lactuca sativa
atccgctcatttcacactggtttattcatcgctaaaagaaaaatggaaggcgcagcaaagtcaaagaagggtgccggaggaagaaaggccggtggcccaaggaagaaggcggttacccgctccgtcaaggccggacttcagtttcccgtcggtagaattgggcgttttctgaagaaaggacgttatgcgcagcgtgttggaagcggtgctccggtttacctcgccgctgttcttgaataccttgctgctgaagtgctagagttagctggaaatgcttctagggacaacaagaagaccagaattattccaaggcatcttctgttggccattagaaatgatgaagagcttgggaaattattgggtggagttacgatcgctcatggtggtgttcttccaaatatcaacccaattctattgccaaagaagaccgctgctaaggagccttcaactccatctaaagctgctaaatctccaaaaaaagccaagaaggctgagtaaattatgacgctagaatttgtagttcttttttggtttaagatcatgttacaagtttgtatgatgatgttgatcaatatttaatgaatgaaacgacttgtttctta

SEQ ID NO: 3992 - DNA, 625 bp, Lactuca sativa
ttggcggggatcataacgaagaatccgctcatttcttactgtttattcatcgctaaaagaaaaatggaaggcgcagcaaagtcaaagaagggtgccggaggaagaaaggccggtggtccaaggaagaaggcggttacccgatctgtcaaggccggactgcagtttcccgtcggtagaattgggcgttttctgaagaaaggacgttatgcgcagcgtgttggaagcggtgctccggtttacctcgccgctgttcttgaataccttgctgctgaagtgctagagttagctggaaatgcttctagggacaacaagaagaccagaattattccaaggcatcttctgttggccattagaaatgatgaagagcttgggaaattattaggtggagttacgattgctcatggtggtgttcttccaaatatcaacccaattctattgccaaagaagactgctgccaaggagccttcaactccatctaaagctgctaaatctccaaaaaaggctaagaaggctgagtaaattattacgttagaatttgtagttcttttttggttaagatcatgttataagtttgtatgctgatgttgatcaagatttaatgaatgaaacgacttgtttcttataa

SEQ ID NO: 3993 - DNA, 548 bp, Nicotiana benthamiana
actataatatcaattctttttcaccaatcacaactttgctctttctcatttccaaatggatactgccgggaaagcaaaaaagggtgccggcggcagaaaggctggtggccagtcgaagaagccggtttctcggtccgtcaaagccggtcttcaattcccggtcggtagaattggtcgttacctgaagaagggtcgttacgctcaacgtgttggaagtggtgctccggtttatttggccgctgttcttgagtatttggccgctgaagtgctggaattggctgggaatgcagcgcgtgacaacaagaagaacagaattattccaaggcacgttctgttggctgtgaggaacgatgaagagctagggaagcttcttgctggtgtgacaattgctcatggcggtgttcttccaaatatcaacccgattttgttgcctaagaaaacaggcggagctgaaaaggaaccgaaatctcctgctaaggccacaaaatctcccaggaaagctgtagcttagaccttttaagtgactgctgaaactcaaacttcttttg

SEQ ID NO: 3994 - DNA, 621 bp, Secale cereale
  misc_feature (128)..(128): n is a, c, g, or t
  misc_feature (215)..(215): n is a, c, g, or t
  misc_feature (227)..(227): n is a, c, g, or t
  misc_feature (284)..(284): n is a, c, g, or t
  misc_feature (293)..(293): n is a, c, g, or t
  misc_feature (314)..(314): n is a, c, g, or t
  misc_feature (347)..(347): n is a, c, g, or t
  misc_feature (374)..(374): n is a, c, g, or t
  misc_feature (380)..(381): n is a, c, g, or t
  misc_feature (419)..(419): n is a, c, g, or t
  misc_feature (458)..(458): n is a, c, g, or t
  misc_feature (571)..(571): n is a, c, g, or t
ccacgcgtccgcaaatcctaaatcaccaaccaaatccccctcctctcccgcgtcccgacgagcagcagccgccagacatggacgcctcagccaccggagccggagcgaagggcaagaagggcgcggcngggcgcaaggccggcggccccaggaagaagtcggtgacgcggtccgtcaaggccgggctccagttccccgtcggccgcatcgggcgntacctcaagaanggccggtacgcgaagcgcgtcggcacgggcgcccccgtctacctcgccgccgtcctngagtacctngccgccgagctgctggagctngccgggaacgccgccaaggacaacaagaagtcncgcatcgtgcccaggcacctgctgctngccgtnnggaacgaccaggagctcgggaggctgctggccggcgtnaccatcgcgcacggcggcgtgctgcccaacatcaacccngtgctgctccccaagaggacggcggagaaggagcccaaggagggcaagtcgcccaagaaggccaccaagtccccaaagaaggccgacaagaaggcttagagagagacgctcanacgcgcatcgattagcttgtactagtgcttagtagatctttgctgccaag

SEQ ID NO: 3995 - DNA, 609 bp, Euphorbia esula
  misc_feature (7)..(9): n is a, c, g, or t
gcgaccnnnttaagttcccatggagaccggcggcaagttgaagaagggagcaggaggaagaaagggcggcggcccgaagaagaagcccgtttctcgctccgttaaggccggtctccagttccccgtcggtaggatcggtcgatacttgaagaatggccggtatgctcgacgtgttggtactggagctccggtctacttggccgccgttcttgagtatctcgccgctgaggtgttggaattggctggaaatgcagccagagataacaagaagaacagaataattcctaggcatgtattgttggccataaggaacgatgaagagctcgggaaattgcttgctggtgtaacaattgcacatggtggtgttcttccaaacataaacccagttctgttgccaaagaaaagtgagaaggcaaccactaaagaaccaaaatctccatcaaaggcccccccccccctcctttttttttttttttttttttttttttttttttttttcccaccggaaaaacttttgacttgttctttgcccatttgtatgtactttgttggctttttagggccttcttctgggttgtttatcaatggaagctcaaaactgatgaattt

SEQ ID NO: 3996 - DNA, 771 bp, Helianthus annuus
  misc_feature (628)..(628): n is a, c, g, or t
gcggggacaacaaaccatttattattattcaccgataaacaaacaatacgatcaaatggaggccacaggaaaagctaaaaagggtgccgcaggtcgcaaagcaggcggcccaaggaagaaggccgtcacccggtctatcagagccggtcttcagttcccggtcggtagaattggccgttatttgaagaacggtcgttatgccaaacgtgttggaaccggtgctccggtttatctcgctgctgtgctcgaataccttgctgctgaagtgttggaattggcgggaaacgcagcaagggacaacaagaagaacagaataaacccaagacatgttctgttggcaattaggaatgatgatgagcttggaaagcttttggctggtgtgacgattgctcatggtggtgttctaccaaacattaacccagttttgttaccaaagaagactgctgcgaaagagccgaaatcacctgctaaagctaccaaatctcccaagaaagctgctgcttagacgttagatctgttgttgttcttatgtgatgtgattgtagttaaattgagaatgaatctagctttatgttaattgttatattgtttgttaatgtatggaagaaacctctggtttttgttttanaaaaaaaaacccaaaaaagaggataaaatttttgggcggttgggcccagccgactttttactttagcagagttttgtttgcgggcggccttttagttcatttggccaatttgccctattggggggcggttttaattctactgg

SEQ ID NO: 3997 - DNA, 915 bp, Hordeum vulgare
ggatcccccgggctgttggggttcggcacgaggcaaaagtccgcaatctccacacacatctctcctactcccgaatccgttctccacctagccatggacgcctcagccaccgtagccgccgggaaggggaagaagggcgcggccgggcgcaaggccggcggccccaggaagaagtccgtgtcgcggtccgtcaaggccgggctccagttccccgtcagccgcatcgggcgcttcctcaagaagggccgctacgcgcagcgcgtcggttccggcgcccccgtctacctcgcggcggtcctcgagtacctcgccgccgagctgctggagctggcgggcaacgccgccaaggacaacaagaagagccgcatcaccccccgccacctgctgctcgccatcaggaacgacgaggagctcggcaagctgctcgccggcatcaccatcgcgcacggcggcgtcatccccaacatcaacccggtgctgctccccaagaaaaccgccgagaagtcgcccaaggagcccaagtcgcccaagaagaccgccaagtcccccaagaaggcgtaggcggccattgcatagttaggtcggagtagctgggatggatgttacatgcatgggtgtgcttcagctcgaagcacactgtttccagttgtgtcgttgtatcttcagacctgtgaattctatggaacaatgagttgctttgatcttaggcgcaacccctctgggaaaggaacttgcaaaggaaaacgtttgaggtcgttttcctggtgggaaaatttgatgaggaaaacttcatgggtgcaagggagcccacaccgggagtttgggatttatgagcccgcatttcgccgcaaccgggaacaatgaggatgaaggccttggggattaaatccaaacggcaactgttccccggctgcg

SEQ ID NO: 3998 - DNA, 673 bp, Cicer arietinum
gacaatcatcgattcttctccatttctcatacatcacagcgaaatctcagctagaatctagggttcgaaatttgcaatggatacttctccaaaatcgaagagaggtgctggtggaaggaaaggaggaggaccaaggaagaaggcggtgacaagatccaccagagccggtcttcaattccccgtcggaagaatcggccgttacttgaagaaaggtagatacgctcagcgtgttggcactggtgctcccgtttacctagctgctgttctcgaatatctcgctgctgaggtgcttgagttggctggaaatgcagcacgtgacaacaagaagaatagaattattcctagacatgttttgttagctgtgaggaacgatgaagagcttggaaaattgcttgctggtgttactattgctcatggtggtgttcttcctaatatcaacccgatactattgcctaagaagaatgagagagctgtgaaggaaccaaaatctccatctaaggctgtgaagtctccaaagaaggcttagatttagtttctatttgtatatctaagtttagggttgtattttgttattgaaatatttaatgtgtttgaagctgtgtaagttggatctcgaatgtttctcatgtagaagttttaattcatctatgaaaacaacttgtttttatgttga

SEQ ID NO: 3999 - DNA, 819 bp, Cucumis sativus
actttccattttatttttctcatttcataagaaaaaatgtcatctccgttgaaaccccgtcgtcgttaacctccctcaccttttcatctcttttttctgtttgtttctccggaaaattttctcttccaatggattctggcggcaaggcgaagaaaggcttcgccggcagacgaggtggtgcggattctaagaagaagcctgtctctcgctctgtcaaagccggcctccagtttcccgttggcagaatcggccgctacttgaagaatggccgttactctcaacgagtcggaactggcgctccggtttaccttgctgctgtgcttgagtacctcgctgctgaggttttggaactggctgggaatgcagcaagagacaacaagaagaacaggatcatcccgaggcacgtgctcttggctgtgaggaacgacgaggaactcgggaagcttcttgccggggtgacaattgctcatggtggggtgcttccaaacatcaacccggtccttcttccaaagaaatcagagagggcagcggcagcaaaggagcccaagtctccctccaagggtaccaagtcccccaagaaggcctagcttagcttctcatatgctccacgactactcactgtctgtatttagattggagctatcttcatgtttaggaccacttttttatgtgtttgtgtctttatattgtaggatacttctttatgttatcacaattctcagttgaaatgatgtaaggtttaacatctcttatgaatgtttgtatcttctccactgatgggttaatgtatgtagaaaggctttatgagatggtttgaac

SEQ ID NO: 4000 - DNA, 675 bp, Medicago truncatula
atcacactctccatttctcacaaattcttacatcacagcgaattcgtagcaaaaaatctagagttccaaattccaatctcagaaatggacgcaagcaccaagacgaagaagggagctggtggaaggaaaggtggtccaaggaagaagtcagtgacaagatccaccagagctggtcttcaatttccagtcggaagaatcggtcgttacttgaagaaaggaagatacgctcagcgtgttggtactggtgctcctgtttacttagctgctgttcttgaatatcttgctgctgaggttcttgagttggctggaaatgcagcacgtgacaacaagaagaacaggatcatccctaggcacgtgttgttggctgtgaggaacgatgaagaacttggaaaattgttagctggtgttacaattgcacatggaggtgttcttccaaacatcaacccaatccttttgcctaagaagaacgagaaggctgcaactactaccaaatctccatccaaggctaccaaatctccaaagaaagcttagatttagtttctagggtttggtgtttatatctaagtttagcatagcagacatatttcgatgtgtttgtagcaatgcattttggatctcagtgtgtttctgatgtagtaggagtctgattcatgaatgaaaacatcttgtttttac

SEQ ID NO: 4001 - DNA, 603 bp, Medicago truncatula
attcatcaaattctcaattcaaaccttcttcgcattcaaatttctttctctcaaaatctcagttcaaaatggacaagaaaggagccggtggaaggaagggaggagaaccaaggaagaagtcggtgacaagatcaatcagagccggtcttcaatttccagtgggaagaatcggtagatacttgaagaaaggaagatacgctcagcgtgtaggcacaggtgctccagtatacctagcagcagttcttgaatatctcgctgctgaggttcttgagttggctggaaatgcagcacgtgataacaagaagaatagaatcattccaaggcatgtgttgttggctgttaggaatgatgaagaacttggtaaattgcttaatggtgttaccattgctcatggtggtgtttttcccaacatcaacccaatccttttgcctaagaagactgaaaaggctgtttctaaggaacctaagtctcccaaaaaagctggaaagtctccaaagaaggcttagatctctaggaacaattagataatttaattagtatttctctactttatgtctatgaatatgatggatttaatgagattggacttcaaaattgtttcta

SEQ ID NO: 4002 - DNA, 918 bp, Orobanche aegyptiaca
ttttttttttttttctatttccttctctatcagaaaaaaagaaggaaaaaatggaagccagtggtaaagtgaagaagggagccgctgggaggaagatcggcggtggtccgaggaagaagtcggttacccgatccgtgagagccggtctccagtttccggttggcaggatcggccgttatctgaaaaaaggccgttatgctcagcgggttggcaccggtgctccggtctacgtggctgctgtgctcgagtaccttgctgctgaggttttggaattggctggaaatgcagcaagagacaacaagaagaataggataatcccaaggcatctattgcttgctgtgagaaatgatgaagagcttggaaagcttctagctggagttacaatcgctcatggtggagttataccaaacattaaccctattctgttgcctaagaaggctgataaggccgctgagaagacccctaaatccccagcaaaggccacaaagtcgcctaggaaggcttaatttactattagtttccgagttttagtaaagaaaagaaaagaaaagaaaagaaagataggagagaaaaagaagagaaaggaagtgaagggaaattgtattttgtgttatcgagttggaaggaaataaaatgaaaattaatcattttgttcttttctctcagaatcctttgaaatcggaaggaaagttaggagagaaagctttccttttatttctttctgtttattttcattaaaaaatttaagaacacaaaatatttttttttcctctcatttccatccatttcctttcttttctctcgttaagttaaattcggaaactaagcgttagcgttataacattgtgttattatagaggtggttattgaattcttgtaacaaattttatcacgagattcatactgaattttctgtct

SEQ ID NO: 4003 - DNA, 792 bp, Orobanche aegyptiaca
attcatttcgttttctctccgacaaaaacaaatggacgccagtgggaaagtgaagaagggagccgccgggaggaagatcggcggaggtccgaggaagaaatcggtcactcggtccgtcagagccggtctccagtttccggttggcaggatcggccgttatctgaagaaaggccgctatgctcagcgggttggtaccggtgctccggtctacgtggctgctgtgctcgagtaccttgctgctgaggttctggaattggctggaaatgccgcaagagacaacaagaagaacaggataattccgagacacctgttgctcgctgtgaggaacgatgaagagctaggaaagcttcttgcgggtgttacgattgctcatggtggagttataccaaacattaatcctgtgcttttgccgaagaagaatgagaaggtcggcgagaaggcacctaaatccccagcaaaggccacgaagtctccgaagaaggcttgaattagtgttattgttggtattggatagtgttactgtagagcattttgtgcttttaatgtattttgaatgagtttaaaattaatggaagattgtttacatttagtaagcatatatgctgtgaattgtttctatttacagctgaatgatttgtccaggtttattaagccatatggcaatatattgaaaattagatctgtgaacaaattataatgctattggaattagcaatggattgaaaggtaaaccttattaggaaatgagtgtaccattgtaatcctattttgagtttggacttattttgattt

SEQ ID NO: 4004 - DNA, 606 bp, Pisum sativum
acaaaggtgaaaaaaggagcaggaggaaggaaaggaggaggaccgagaaagaaatcggtgacaagatccgtcagagccggactccaatttcccgtcggaagaatcggtcggtttttgaagaaaggcagatacgctcagcgtgttggtactggtgctcctgtttacctagcagctgttcttgaatatcttgccgccgaggttcttgaattggctggaaatgcggcacgcgataacaagaagaataggattagtccaagacatttgttgttagctgtgaggaatgatgaggaacttggaaaattacttgccggtgttaccattgctcacggtggtgttctacctaacatcaaccctgttcttttgcctaagaggactgaaagtgcttcttctactgcaaaggagcctaaatctccaaaggccaagaaaactcctaagaaagcttagattgaaagatggctttagattctaggtcttgttctgtgttgatagtttagtttaggcacctctaatctagcggatacatatttattgtgtgtatcaatccatgtaattccaattttttctttttctcgtttatgagttttatttgacaatggaatccttaaa

SEQ ID NO: 4005 - DNA, 706 bp, Hordeum vulgare
ttggggttcggcacgaggaatcagcagtcaagcaatctccacacacatctctcctactcccgaatccgttctccacctagccatggacgcctcagccaccgtagccgccgggaaggggaagaagggcgcggccgggcgcaaggccggcggccccaggaagaagtccgtgtcgcggtccgtcaaggccgggctccagttccccgtcagccgcatcgggcgcttcctcaagaagggccgctacgcgcagcgcgtcggttccggcgcccccgtctacctcgcggcggtcctcgagtacctcgccgccgagctgctggagctggcgggcaacgccgccaaggacaacaagaagagccgcatcaccccccgccacctgctgctcgccatcaggaacgacgaggagctcggcaagctgctcgccggcatcaccatcgcgcacggcggcgtcatccccaacatcaacccggtgctgctccccaagaaaaccgccgagaagtcgcccaaggagcccaagtcgcccaagaagaccgccaagtcccccaagaaggcgtaggcggccattgcgtagttaggtcggagtagctgggatggatgttacatgcatgggtgtgcttcaggatacttcagctcgaagtagactgttcttgctgtgtccttgtattttctgaccgtggtttcaatgaaactttgctttcatgcaatgcgttcg

SEQ ID NO: 4006 - DNA, 677 bp, Ocimum basilicum
gcacgaggaaatctctccccatcaatcaatttccctttgctgcaaaattaagaaatggaaaccggcggaaaattgaagaagggtgcaggaggcaggaagggcggtggccccaagaagaagccagtttcccggtccgtcaaggccggtctgcagtttccggttggcagaatcggccggtatctgaagaagggccgttattcccagcgagtcggcaccggcgcccctgtctacatggccgccgtgctggagtatcttgcagctgaggttcttgagttggctggcaatgctgctagggacaataagaagaacaggattattccgaggcatgtattgcttgcagtgaggaatgatgaggagctggggaagcttctggctggagttacgattgcacatggtggagttctacccaacatcaacccagttctgctacccaagaaatccgggaatgtggctgagaagaccccgaagtctcccaaggccaccaagtctcccaagaaggcttgaagctgtgatgctatgttcccatgttttggttgaagggcatcgttttatgttttgtatgtaatttgaattgttgttatgtagggaacatgttcataactggattaaaacctttgtaccctcagttggattgtttttattagagttggaattaaaaccatttctgctactcgttt

SEQ ID NO: 4007 - DNA, 677 bp, Ocimum basilicum
  misc_feature (644)..(644): n is a, c, g, or t
  misc_feature (647)..(647): n is a, c, g, or t
gcacgaggaaatctctccccatcaatcaatttccctttgctgcaaaattaagaaatggaaaccggcggaaaattgaagaagggtgcaggaggcaggaagggcggtggccccaagaagaagccagtttcccggtccgtcaaggccggtctgcagtttccggttggcagaatcggccggtatctgaagaagggccgttattcccagcgagtcggcaccggcgcccctgtctacatggccgccgtgctggagtatcttgcagctgaggttcttgagttggctggcaatgctgctagggacaataagaagaacaggattattccgaggcatgtattgcttgcagtgaggaatgatgaggagctggggaagcttctggctggagttacgattgcacatggtggagttctacccaacatcaacccagttctgctacccaagaaatccgggaatgtggctgagaagaccccgaagtctcccaaggccaccaagtctcccaagaaggcttgaagctgtgatgctatgttcccatgttttggttgaagggcatcgttttatgttttgtatgtaatttgaattgttgttatgtagggaacatgttcataactggattaaaacctttgtaccctcagttggattgtttttattanagntggaattaaaaccatttctgctactcgttt

SEQ ID NO: 4008 - DNA, 707 bp, Phaseolus coccineus
gcgtcttgttctcttgcaattattcctctttcatcactactcagaattttcacctaaatcctagggttctgatatggaaaccgccggcaagatcaagaagggcgccggaggaaggaagggtggcgggccgaagaagaaaccagtgtcaaggtctgtcaaagccggtctacagttccccgtcggaagaattggacggtacttgaagaaaggaaggtacgcgcagcgtgttggaagcggtgctcccatttaccttgctgcagttcttgagtatcttgctgctgaggttcttgagttggctgggaatgctgctagggataacaagaagaacaggattatcccaagacatgttcttttggctgtgaggaatgatgaagagttggggaaattgcttgctggtgtaaccattgcccatggtggtgtgcttcccaacattaaccctgtcttgttgcccaagaagacagagaaggcttccaaggagcctaaatctccatccaaggctaccaagtctccgagaaagtcctagatgacttagtttgcgatgataatttactgtgcacaatgtacatctgtgtttaggctttttcttgtatcatcattgtgatgactttgatacatcatgtagttttgatttttcctcttctttatgatgttgcacttaatcagagtaaacaaggctcagtaatgaatagatttgtctttctgattct

SEQ ID NO: 4009 - DNA, 755 bp, Theobroma cacao
  misc_feature (14)..(16): n is a, c, g, or t
  misc_feature (126)..(126): n is a, c, g, or t
cggggatccgctcnnnatctctcgtgaattccaaaatccagatcggtcttgccaaattcacttcttgaagggtagcgggtgttgtcggggtcgggtgaaccaatggataccggaggaaaagtgaanaagggcgctggaggaaggaagggcggcggcccaaagaagaaacctgtttcaaggtcggttaaagctgggctccaatttcccgttggaaggatcgggcgttacttgaagaaaggaaggtactcgcagcgagtcggaaccggagcaccagtttacatggctgccgttcttgagtacttagccgctgaggttctggaattggctggaaacgcagcgcgtgacaacaagaaaaacaggatcataccaaggcacgtactactcgcagtgaggaacgatgaggaacttgggaagcttctcgccggcgtcaccatcgcccacggtggcgtcttgccaaacatcaaccctgttcttttgccaaagaagactgacaaagccacaaaggaacccaaatctccatcgaaagccaccaagtctctcaagaaagcttaattcgatcaagaaactctcatttttaggccttcttttgttcttatttagttgtatgtgattacggggtctttaggattttggttgttaatgtggatgtgtaggtggaaaactgtttcaaagaaaatttaagatattattgttagactcccattatcatgtatgtgatcttcatggaaatgaaactacttgtttctttaaaaaaa

SEQ ID NO: 4010 - DNA, 743 bp, Manihot esculenta
  misc_feature (303)..(303): n is a, c, g, or t
  misc_feature (325)..(325): n is a, c, g, or t
gacacactctctttcacaaacaccaaatcggcgatttccatttttaatctttatttggccagatggaaaccggagggaaagtgaaaaagggagccggagggaggaaaggtggagggccaaagaagaagcccacttctagatcggtcagggcgggtttgcagtttcccgttgggagaatcgggcggtatttgaagaaaggaagatattcgcagcgggtcggaactggggctccagtttacttggccgccgttctggagtatctagctgctgaagtgctggaattggctggaaatgcagcaaganacaacaagaagaacagaataanaccaaggcatgtattgcttgctgtgagaaacgatgaagagcttggaaagttgcttgcaggtgtaacaattgctcatggaggtgtacttcccaatattaatcctgttctgttgcccaaaaagactgagaaagccaccaaggaacccaagtcaccatctaaagccactaaatctcccaagaaggcttaggccaatttcagttccctaaccattctgtcttctgtatgtaatttagggttcattgctggtttattttgtaggtaaagttgtttgaatcaatttgtagtccattagatctttgtaataccatgttaggatttgacctattaagattaatggattgaaactacttgtttcctcttctttaagaagagtagagaatatatttccttcaatatatattttttttgcttcctattt

SEQ ID NO: 4011 - DNA, 598 bp, Cichorium intybus
ggcgggggatgcaggtgaaaagggtgccgccggaaggaaggcaggcgggccgaagaagaagccagtcaccaagtccgtcaaggccggtcttcagttccccgtcgggagaatcggccggtacatcaaaaaaggtcgttacgccaagcgtgtgggtaccggtgctccggtttacctcgctgccgttctcgagtatcttgctgctgaggttttggagttggctggaaatgctgctagagacaacaagaagaccaggattataccgagacatgttttgttggctgtgagaaatgacgaagaacttggaaagcttctagctggtgtgacaattgctcatggtggtgttcttccaaatatcaatccaattcttttaccgaagaagtctcttgagaaagccacaaaggagccgaaatctcctgctaaatcagctaaatccccgaagaaagcttaaatctttaagaacatgttctataatcatctctttgtatttattcaccttctgttggtgatctaggatagtatgtagttcgatgttttaggggagattttgaagtattttagtttgggttgtttatggtaggacctagatttgaaaaagaat

SEQ ID NO: 4012 - DNA, 612 bp, Trifolium pratense
acttcacaaaacaccgatttcaattttcaatctcgcaatggatacttccccaaaatcgaagaaaggagctggaggaagaaaaggaggaggtccaaggaagaagtcagtaaccagatccactagagtcggtcttcaattccccgtcggaagaatcggccgttacttgaagaaaggtagatacgctcagcgtgttggtaccggagctccggtttacttagccgccgttcttgaatatcttgctgctgaggttcttgaattggctggaaatgctgcacgtgacaacaagaagaataggataatcccaaggcatgtgttattggctgtgaggaatgatgaagagcttggaaaattgcttgctggtgttacaattgctcatggtggtgttcttccaaatattaacccaattcttttgcctaagaagactgatagatctactactgctagtaaggagccaaagtctccaaaggctaagaaatctcctaagaaagcttagatttagattctagggttggttaatgaattagtatgaatttgtgcatatctaagcttaggatcctgttatttaatgtggttgaaacaatgtaatttggatctcatgtatcagcctcgtgc

SEQ ID NO: 4013 - DNA, 758 bp, Actinidia deliciosa
  misc_feature (713)..(713): n is a, c, g, or t
aaaataggttcaccaatctgctatttcggctgtctgtttcttgggaaaatcgtgcaaccgtgaaaatggagaccggtggaaagatgaagaaaggtgctgcgggaagaaggggcggtggtccgaagaagaaaccgattacgcggtccgtcaaggccggcctgcagttccctgtcgggaggatcggccggtacctgaagaaaggccgatacgctcagcgcgtcggcagcggtgctccggtttacctcgccgccgtgctcgagtacctcgctgctgaggttttggaattggctgggaatgctgcgagagacaacaagaagaatagaatcataccgaggcacgtgcttcttgccgtgaggaacgatgaggagcttggaaagctacttgctggtgtgacaattgctcatggaggagtgcttcccaacatcaaccctgttcttctccccaagaaaactcaagcaacaaaggagcccaagtctccaaccaaggccactaagtcacctaagaaagcgtaacttctcggtgtgtctaagaaagcctttttgtgcaattttagctctctagaaactctttctctccctgtatttaacttcatcttctgttgtgatgtgaggaaatcttcatgttgtaggagatattgcaatctgtttcaatttgtttgaaatcaaagacatgaattgttagttcaaatcctgttagtttaatgtattgttgtntgtgttagttttttatttaaaaaaatcatttggctgtttgaaaaa

SEQ ID NO: 4014 - DNA, 667 bp, Medicago truncatula
cttctccgcattcaaattttctttttctctcaaaatttttctcagtttgaaatggaggcaagcaccaagacaacaaagaagggagcaggaggaaggaagggaggaggaccaaggaagaagtcggtgacaagatccatcagagctggtcttcaatttccggttggaagaatcggtagatacttgaagaaaggaagatacgctcagcgtgtaggcacaggtgctccagtatacctagcagcagttcttgaatatctcgctgctgaggttcttgagttggctggaaatgcagcacgtgataacaagaagaatagaatcattccaaggcatgtgttgttggctgttaggaatgatgaagaacttggtaaattgcttaatggtgttaccattgctcatggtggtgttcttccaaacattaaccccatcctcttgcctaagaagactgaaaaaactgctcctaaggagccaaagaaggctggaaagtctccaaagaaggcttagatctgatctgttttcaatctttagatgattgtgtttatatctaagactagggttactttatgtgatataaatcggttttagtgctttcatataatgtaactccatcttattgcatttctcctttaggacttttatctatcaatgaaaattattcaatttcaatattatt

SEQ ID NO: 4015 - DNA, 782 bp, Quercus alba
gagcggccgcccgggcaggtacgcgggacttcatatctacctctctctctctgtcacactctttacccttcaaatctcaatccttcattctctacagttttcgtctcagtcttgcccggcaggtgtttgtgtttttgtctcttagaatggataagaaaggtgctggtggaagaaaaggtagcggctcaaggaagaagtcggttacccggtccgtcaaagctggtttgcaattcccagtcggtaggataggccggtaccttaagaaaggaaggtacgcccaacgttgtggatcaggtgcccctgtttacatggctgctgtgcttgagtaccttgctgctgaggtgttggagttggctggaaatgcagctcgtgacaacaaaaagactaggattatcccaaggcatgtgttgctagctgtgaggaatgatgaagagcttggaaaattgcttgctggtgttactatagctcatggtggggtccttcctaatatcaaccctattttgttgccaaagaagactgagaagattaccaaagagcccaagtctccttccaaggctgcaaagtcacccaagaaggcttagcttagtctttagcctaaatttagaagcttggttttcattttgtatgtaagctggttttaggatcttgcttattttttgttaatttttgttgattgttgtgtaggggaaagttaatggatttgaaacagctttgtcgcctctatgttaggactttggcaatgaattaatggatgaaatgaaaccacttgtttctactaccat

SEQ ID NO: 4016 - DNA, 779 bp, Arachis hypogaea
gatcttcatcatcatcactctcttcacacccaaaaaactcatcctttccgtaaactttcttcatggacagccccgccggaaaaaccaagaaaggagccgccggtaggagaggcggtggtcccaagaggaagccagtctcaaggtccgtcaaagccggtctccaattccccgtcggaagaatcggacgcttcctgaagaaaggccgttactctcagcgcgtcggaaccggtgctccggtttacctcgccgccgttttggaatacctagccgcggaggtgttggagttggctgggaatgctgctagagacaacaagaagaataggattattccaaggcatgtgttgttagctgtgaggaacgatgaggagcttggaaaattgcttgctggtgttaccattgctcatggtggtgtccttcctaacataaaccctgttctgttgcccaagaaatctcaaactgctaccaaggaaccaaagtctccatctaagggcactaagtctcctaagaaggcttgatcttatagttgatgatgctaagttgttgttattagtttgttttggaacttttatttttcatgtatatgtatgttgttagatttttctcttagatcagtcccttggaaaagaatgtaatgcttttatggtttaaagttatctcaatgatgtagggttccaaaacgaattgaaagcagctcgtttcaattcattcttgtagctttaataccaatgcattttgtccatgtttttttagcctagtaacttattaccattttcttcagc

SEQ ID NO: 4017 - DNA, 780 bp, Nicotiana tabacum
  misc_feature (779)..(779): n is a, c, g, or t
tctctcgctccgacaaccaattttttccttcaaatcattcatcatcctgctctaaattcttctatcttcaaatggatactagcggcaaagcgaagaaaggtgcagccggaagaagaggcggcggtccaaagaagaagccggttacccggtccgtgagagccggtcttcagttcccggtcggtagaatcggtcggtacctgaaaaaaggccgttacgctcaacgtgttggtactggtgctcccgtttacttggctgctgttctcgaatatctggctgctgaagtgttggagttggctggaaatgcggcacgtgacaacaagaagaacaggattatcccaaggcatgtgcttttagctgtgaggaatgatgaagagttagggaagttgcttgctggcgtgacaattgcacatggtggtgttcttcccaacattaacccaattttgttgcctaagaagactggaggtgataaggctggcaaagaacctaaatctccttccaaagctaccaaatctcctaagaaggcttagatttagtggttgtaatagccttttgtttttctatctttatttggatatttactgtatgtatctgtgctgttagaatgtgttcgatcgttcttcggggatgacaaaagggaattaattggaacttggaactgttagaccttactaggttgttttctattatcaggttgttttctattatcaatcaatgaaaccccttgtttcgattttaaaacaacccacatgacgacacaaaaaaaaaaggggcgccacggnt

SEQ ID NO: 4018 - DNA, 754 bp, Triphysaria pusilla
gcaattagtgacggagaagtttcacgctttaccccaaatctgcaagctcaatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtcggcaggatcggtcggtttctgaagaagggtcgctatgctcagcgcgtgggttctggtgccccggtttacctggctgcggttcttgagtaccttgctgctgaggttctggagttagctggaaatgcagcaagagacaacaagaaaagcaggattatcccgaggcacttgttgctggctgtgaggaacgatgaggagcttggtaaacttctggctggagtgacaattgctcatggtggtgtaattccgaacataaacccggttctgttgcccaagaaatccgacaaggtggctgagaaggcgcctaaatcgccatcgaaggctgctaagtctccgaaaaaggcttaaaattcatgttcaattttgaaaggggggtgagtgtcgattggtgtgcggcgccgggcggcggaggtggcggtgggattttgaaagtgtggtgagtgttttgtggctcgacaccggtggtgatttagaacatatgtaatagttctttttaaactaaatagttcaattttttcttattcagaacaataaattgttttgtatggaaaaaa

SEQ ID NO: 4019 - DNA, 688 bp, Triphysaria pusilla
ggactcaagttctatcccatacctaaatctgcttccattctcatcctattgagtagcttttgtaatttgattttagtaccagagagaaatggaaaccggagggaaagcgaagaagggagctgctggaaggaaggctggcggtccgaagaagaaatccgtctcccgctcagtgaaagccggtctccagtttccggtcggcaggatcggacgttttctgaagaagggacgttatgctcagcgcgtgggttctggtgccccggtttacttggcggcggttttggagtacctcgctgctgaggttttggagttggctggaaatgcagcaagagacaacaagaagtcaaggattattcctaggcacttgttgcttgcagtgaggaatgatgaggagctcggtaaactacttgctggagtgacaattgcgcatggtggtgtgataccgaacattaacccggttcttttgccaaagaaaaccgataagggggctgacaaggaacccaaatcgccatcaaaggcaaccaaatctcctaaaaaggcttaaatctattgttctttgttttgtagagttgtaagtttgattaatgttgctctcatattggtatttaggaaggatattgcgcttttattgtgttttgtttggatcattatatcaatgaaccgatttgaatttaaataaaaaaaaaaaaaa

SEQ ID NO: 4020 - DNA, 675 bp, Triphysaria pusilla
ggactcaagttctatcccatacctaaatctgcttcaattctcatcctcttgagtagcttttgttatttgattttagtaccagagaaaaatggaaaccggtgggaaagcaaagaagggtgctgctggaaggaaggctggcggtccgaagaagaaatccgtctcccgctctgtgaaagccggtctccagtttccggtcggcaggatcggacgttttttgaagaagggacgatatgctcaacgtgtgggttctggtgccccggtttacttggcggcggttttggaatacctcgctgctgaggttttggagttggctggaaatgcagcaagagacaacaagaagtcaaggatcattcctaggcacttgttgcttgcagtgaggaatgatgaggagctcggtaaactacttgctggagtgacaattgctcatggtggcgtgataccgaacattaacccggttctgttgccaaagaaaaccgataagggggctgacaaggaacccaaatcgccatcaaaggcaaccaaatctcctaaaaaggcttaaatctaatgttctttgttttgtagagttgtaagtttggttaatgttgcactcatattgatatttaggaaggatattctgcttttattgtgttttgtttggatcattatatcaatgaaccgatttgaatttaaata

SEQ ID NO: 4021 - DNA, 710 bp, Triticum aestivum
ccacgcgtccgcacgcactcccgcaacacagcgcgctcccgtcccgccttctcaaatcccaattccccatcggccatcgccgaatctctccgcgcctccaccccgccagacgccatggacgcctcagccgccggcgccgttccgaaggcgaagaagtacgtggtggggcgcaagctcggcggcggccccaggaagcaggcggtggcgcggtccgtcaaggccgggttgcagttccccgtcggccgcatcgggcggttcctcaagaagggccgctacgcgcagcgcgtcggcatgggcgcccccgtctacctcgcctccgtcctcgagtacctcgccgccgagctgctggagctcgccgggaacgccgccaaggacaacaagaagtcccgcatcatcccgcgccacctgctgctcgccatccggaacgaccaggagctcggcaggctgctcgccggcgtcaccatcgcccacggcggcgtgctgcccaacatcaaccccgtgctgctccccaagaaggcggccgacaaggagcccaagtcgcccaagaaggccgccaagtcccccaagaaagcctagtcgattacttactgtctagtaggagtacttcgtaatagaattagtgttcgctgtttgggtaatggtgtcgatgtagtgatgttctgctctgctttgaaaaaaagaacgtcagagatctctctgacttgctgtaa

SEQ ID NO: 4022 - DNA, 626 bp, Triticum aestivum
  misc_feature (589)..(589): n is a, c, g, or t
  misc_feature (591)..(591): n is a, c, g, or t
  misc_feature (593)..(593): n is a, c, g, or t
  misc_feature (599)..(599): n is a, c, g, or t
cgccttctcaaatctctcatcgcgccaaatctctccgcacctcctcctaccagagccaccgccgccatggacgcctcacccaccggcgccgtctccaaggcgaagaagtacgtggtggggcgcaagctgggcggcggccccaggaagaaggcggtggcgcggtccgtcaaggccgggctgcagttccctgtcggccgcatcggccgcttcctcaagaagggccgctacgcgcagcgcgtcggcatgggcgcccccgtctacctcgcctccgtcctcgagtacctcgccgccgagctgctcgagctcgccgggaacgccgccaaggacaacaagaagtcccgcatcatcccgcgccacctgctgcttgccatccggaacgaccaggagctcggcaagctgctcgccggcgtcaccatcgcgcatggaggcgtgctgcccaacatcaaccctgtgctgctccccaagaagacgacggagaaggagcccaagtcgcccaagaaggccgccaagtcccccaagaaggcttagtcgattactgtccagtgcttcgtagtagaattagtgatcgctgtttaggtaatggtgtcgntntngtaatnttctgtaaaaaggctatcagcaaaaag

SEQ ID NO: 4023 - DNA, 649 bp, Heritiera littoralis
tctgtattcgaagcgatggatgccggagggaaagtgaagaagggagcaggaggaaggaaaggaggcggtccaaagaagaaaccggtttcgcgctctgtgaaagccgggttgcagtttccggtcggtcggatcggtcggtacttgaagaaagggcgttactctcaacgtgtcggaaccggtgctcccgtgtacctcgctgctgttcttgagtaccttgctgctgaggtcctggagttggctggtaatgctgcaagagacaacaagaagaataggatcattccgaggcatgttcttctggctgtgaggaatgatgaggaacttgggaagctgttggctggtgtgactattgctcatggtggtgttttacccaacattaacccggttcttctaccgaagaaaaatgagaaggcggtgaaggaacccaagtcgccatcgaaggctacaaagtctccaaagaagtcacttaagaaggcttagtctagtctttgcttattatttctcgtgtgtgtagcttcctttgtgtactctggctgtagaaaaatgttgatgttggtaggaattcagggccattgtagttctaattgtctgtgttgtctaaaacaaactgtgttttgaatgaatgacatgaaatttccatgacctgattcta

SEQ ID NO: 4024 - DNA, 695 bp, Hordeum vulgare
gcgacgaacaccctccgcaatccccactcgcccaccaaatccctccgctcccgcgtcccgacgagcaccagccaccagagatggacgcctcgggcaccggagccggagcgaaggggaagaagggcgcggcgggccgcaaggccggcgggccgaggaagaagtcggtgacgcggtcggtcaaggccgggctccagttccccgtcggccgcatcgggcggtacctcaagaagggccggtacgcgaagcgcgtcggcacgggcgcccccgtctacctcgccgccgtcctcgagtacctggccgccgagctgttggagctcgccgggaacgccgccaaggacaacaagaagtcccgcatcgtgcccaggcacctgctcctcgccgtgaggaacgaccaggagctcgggaggctgctggccggcgtcaccatcgcgcacggcggcgtgctgcctaacatcaacccggtgctgctccccaagaggacggcggagaaggagcccaaggagggcaagtcgcccaagaaggccgccaagtcccccaagaaggccgacaagaaggcctagagagatttgcttagccccctgtagtgctctgttgtaacattgcttgctgtttcgctaatggtgtcggtgtagatctgtgctgcgaatgtcagaaatctctctgatttgagcaaattgttgacaaattcttctctt

SEQ ID NO: 4025 - DNA, 630 bp, Lactuca sativa
aagcctcattcattcattaactttttcgtcgacgttaatcggaattcagaagatggagggagccggaaaaactaagaaaggtgccggaggacggaagggcggtggtccaaggaagaaggcggttacccggtctgtcaaggccggactgcagtttcccgtgggtagaattgggcgttttctgaagaaaggacgttatgcgcagcgtgttggaatcggtgctccagtttacctcgccgctgttcttgaataccttgctgctgaagtgctagagttagctggaaatgcggctagggacaacaagaaaaccagaatcatcccaagacatcttctgttggccattagaaacgatgaagagcttggaaaattactgggtggagttacgattgctcatggtggtgttcttccaaacatcaatcctattttgttgccaaagaagactgctgcaaaggagccatcaattccttctaaagctgctaaatctccaaagaaagctaagaagtctgaatagattaagctttttgaattttaagcttttgtgaaaaatatagggatggggagaattgtatttcgatgatgtattttaccaaaatacaaaatgttaaacccttgcttcttacatctactgtttag

SEQ ID NO: 4026 - DNA, 687 bp, Hordeum vulgare
ggaaaaagcagtcaagcgacgaacaccctccgcaatccccactcgcccaccaaatccctccgctcccgcgtcccgacgagcaccagccaccagagatggacgcctcaggcaccggagccggagcgaaggggaagaagggcgcggcggggcgcaaggccggcgggccgaggaagaagtcggtgacgcggtcggtcaaggccgggctccagttccccgtcggccgcatcgggcggtacctcaagaagggccggtacgcgaagcgcgtcggcacgggcgcccccgtctacctcgccgccgtcctcgagtacctggccgcggagcttctggagctcgccgggaacgccgccaaggacaacaagaagtcccgcatcgtgcccaggcacctgctcctcgccgtgaggaacgaccaggagctcgggaggctgctggccggcgtcaccatcgcgcacggcggcgtgctgcccaacatcaacccggtgctgctccccaagaggaccgcggagaaggagcccaaggagggcaagtcgcccaagaaggccgccaagtcccccaagaaggccgacaagaaggcctagagagatttgcttagccccttgtagtgctctgtggtaacattgcttgctgtttcgctaatggtgtcggtgtagatctgtgctgcgaatgttagaaatctctctgatttgagcg

SEQ ID NO: 4027 - DNA, 714 bp, Hordeum vulgare
cggcacgaggctcagtctggctctctccatctccatcccaatcccgacctaccgcccgctcccgcagcaaggcatggacgcctccggcaccgtcgcgaagggcaagaagggcgccgccgggcgcaaggccggcagccccaggaagaagtcggtgtcccgctcggtcaaggccggcctccagttccccgtcggccgcatcgggcggtacctcaagaagggccgctacgcgcagcgcgtcggcacgggcgcccccgtctacctcgcggccgtcctcgagtacctggccgccgagctgcttgagctcgccgggaacgccgccaaggacaacaagaagagccgcatcatcccccgccacctgttgctcgccgtcaggaacgacgaggagctcggcaagctgctggccggcgtcaccatcgcgcacggcggcgtggtccccaacatcaacacggtgctgctccccaagaggaccgcggagaaggagggcaaggcgccaaagtcccccaagaaggcgcccaagtcccccaagaaggccgccaagtcgcccaagaaggccgccaccccgaagaaggcctgatggagatgcgttctgtgtcgtttaggctgtgtgctgcgtagtgttcttcttctgaatctgaataggggtgtgaagtcgttcgttagttgttgatgtaccttgtgttgtgatggaaggaattcagaaatctcgtttgagtt

SEQ ID NO: 4028 - DNA, 663 bp, Saccharum officinarum
  misc_feature (54)..(54): n is a, c, g, or t
  misc_feature (211)..(211): n is a, c, g, or t
  misc_feature (262)..(262): n is a, c, g, or t
  misc_feature (451)..(451): n is a, c, g, or t
  misc_feature (454)..(454): n is a, c, g, or t
  misc_feature (471)..(471): n is a, c, g, or t
  misc_feature (473)..(473): n is a, c, g, or t
  misc_feature (489)..(490): n is a, c, g, or t
cccgcttcctccaaaccccaatcatcacttccctccaaatcccatttccctctnagcacccgcgactcgcgagatggacggcggcggcgcgaaggtgaagaaggcggcggcggggcggaagctgggcggcggcgggccgaagaagaagccggtgtcgcggtccgtcaaggccgggctgcagttccccgtgggccgcatcgggcggtacctnaagaaggggcggtacgcgcagcgcgtgggcacgggcgcgcccgtctacctngccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctgcccaacatccactccgtnctnctccccaagaaggccgncnagagggctgagaaggnngccaccgctacccaagtgcccaagaaggcccggcgccaagtcgcttaaagaaggagtagtggccccgtttcgtctcattttgaatctgatcttaactttgcctgagtggttcggggatgccttttgctggtcttggcgggtctgtgtgtatgtagggatgcgttgccccatgt

SEQ ID NO: 4029 - DNA, 700 bp, Cleome gynandra
attttcctctgaaacgttgacatccatggattcaggagcgaaattgaagaaaggtgttgctggaagaagaggaggcggtccgaagaaaaaaccggtttcacgatcggttaaagccggtcttcagtttccagtcggcaggatcggtcggtatctgaagaaaggtcggtactcgcagcgtatcggaacaggtgctccggtgtatctcgccgccgtgctcgagtatcttgcggcggaggttcttgagcttgccggtaacgcagcaagagacaacaagaagaatcgtatcataccacgccatgtcttgttagcagtgaggaacgatgaagaactcgggaagcttctccaaggagtgacgattgcacacgggggcgtgttgcctaacataaaccctgttcttctcccaaagaaacccgagaagaacgtggcagcagcagctacaacgaaggaatcaaaatcgccatcgaaggcgaccaaatcaccaaagaaggcatagccttctcttctcttgtgtaagttgaaaaccctaagctactttgtgtatgttgttggtctgtagagacagagacattaatgtgaagtttgtgtcagcatagttctcttcttcttgtcttaacttctcattgtcagttttaaattaaaccaatcttaatttcagattctgattgtgtcttgtgccttaccggtcactcatttgtttgaa

SEQ ID NO: 4030 - DNA, 659 bp, Artemisia annua
aagcatggtatcaacgcagtactccgacggggacaacaatcacacacactcaaaacacatttataaacacacacacacattttataaaaatcaaatggagggaaccggtaaaatcaagaagggagcagcaggaaggaaagctggtgggccacgaaagaagtcagttacccgatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgataaggaacgatgaggagctcggaaagctgttgtctggtgttacgattgctcatggtggtgttttgccaaacattaacccggtcttgttgcctaagaagactgctgctaaagaatcaacaccaaagtctccatccaaagttgggaagtctcctaagaaagccgctgcttagattagtttgatgtcgttgatttgatagtgaagttagtgtagtttgtatgattagatgtaatcgtttaaattgaatgaaaaccacttgtttctgtttaaactacagtgct

SEQ ID NO: 4031 - DNA, 575 bp, Artemisia annua
aaatggagggaaccggtaaaatcaagaagggagcagcaggaaggaaagccggtgggccccgtaagaagtcggttaccagatctgttaaagccgggcttcagtttccagttggaagaattggaaggtatttgaagaaaggtcgttatgctaagcgtgttggtactggtgctcctgtttatctcgctgccgtcctcgagtatctcgcagctgaagtgttggagttggctggaaatgcagcaagggacaataagaagaccagaataatcccaagacatgtgttgttggcgataaggaatgacgaggagcttggaaagttgttgtctggagttacgattgctcacggtggtgttttgccgaatatcaacccggtcttgttgcctaagaagactgctgctaaagaatcaacaccaaagtctccatccaaagttggaaagtcgccaaagaaagctgctgcttagattagtttgattgtgatttggggtgttttcttttggttggtttcgtagagaagttagtgtagttaatttgattagatgtaatcgtttctactgaatgaaaactacttgtttctgttt

SEQ ID NO: 4032 - DNA, 645 bp, Artemisia annua
tactccgacggggaccacattcacacacactcaaaacacacacacacacattcatcacttacccatttataaaaaaacaatggagggaaccggtaaaatcaagaagggagcagcaggaaggaaggccggtgggccccgaaagaagtcggttactcgatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgattaggaatgacgaggagcttggaaagttgttgtctggtgttacgattgctcacggtggtgttttgccaaacattaacccggtcttgttgcctaagaagactgctgctaaagaatcaacaccaaagtccccatccaaagttggaaagtcacctaagaaagctgctgcttagattagtttgatgtcgttgatttgatagtgaagttagtgtagtttgtatgattagatgtaatcgtttaaattgaatgaaaaccacttgtttctgttctaaactacagtgct

SEQ ID NO: 4033 - DNA, 605 bp, Artemisia annua
cacacacattcatcacttactcatttctttaaacaatggagggaaccggtaaaatcaagaagggagcagcaggaaggaaagccggtgggccccgtaagaagtcggttaccagatctgttaaagccgggcttcagtttccagttggaagaattggaaggtatttgaagaaaggtcgttacgctaagcgtgttggtactggtgctcccgtttatctcgctgccgtcctcgagtatcttgcagctgaagtgttggaattggctggaaatgcagcaagggacaacaagaagaccagaataatcccaaggcatgtgttgttggcgataaggaacgacgaggagcttggaaagttgttgtctggagttacgattgctcacggtggtgttttgccgaatatcaacccggtcttgttgcctaagaagactgctgctaaagaatcaacaccaaagtctccatcgaaagttggaaagtcgccaaagaaagctgctgcttagattagtttgattgtgatttggggtgttttcttttggttggtttcgtagagaagttagtgtagttaatttgattagatgtaatcgtttctactgaatgaaaactacttgtttctg

SEQ ID NO: 4034 - DNA, 722 bp, Ipomoea nil
ggtgctcaatcctccgcattaagcgctccaatctttttatacccaaagagtttagcttaatttagcttatcattccatggatgctccggcggcgaagataaagaagggtgccggcggccggaaaggcggcggcccgaagaagaagccggttacccgctccgtccgtgccgggcttcagttcccggtgggtaggatcgggcgttacctcaagaagggccgctatgcccagcgtgtcggcaccggcgctcctgtttacatggctgccgttctcgaatacctggctgccgaggttttggagttggctggaaatgcagcgagggacaacaagaagaacaggatcattcccagacatgttcttttggctgtgaggaacgatgaggagctggggaagttgttggctggggtgaccattgcccatggtggggtgctgcccaacataaaccctgtgttgttgcccaagaagagtggatctgaggcaacaaaggagccaaaggcaaaggctgccaagtcccccaagaagaaggctgcttgatttgatagtgtagattagtggggttttgtcccttgtttctgtatgtgacttggggccattctttgcttatagaaggtgtaattgttagttgtgttgtaaacgtaatgtttggttatcaattaatgaaactctttttcatttctattgtctatggactctgctttgttgaattatattgttgggttcaaat

SEQ ID NO: 4035 - DNA, 661 bp, Artemisia annua
agcactgtagaagcagtggttcaacgcagtactccgacggggacaacaatcacacacactcaaaacacatttataaacacacacacacattttataaaaatcaaatggagggaaccggtaaaatcaagaagggagcagcaggaaggaaagctggtgggccacgaaagaagtcggttaccagatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgataaggaacgatgaggagcttggaaagttgttgtctggagttacgattgctcacggtggtgttttgccaaacatcaacccggtcttgttgcctaagaagactgctgctaaagaatcaaccccaaagtctccatccaaagttggaaaatcgccaaagaaagctgctgcttagattagtttgatgtggttgatgtgatagtgaattgaagttaatgtagtttgtatgattagatgtaatcatttaaattgaatgaagaccacttgtttctgttt

SEQ ID NO: 4036 - DNA, 609 bp, Artemisia annua
cggatctcaaaacacatttataaacacacacacacattttataaaaatcaaatggagggaaccggtaaaatcaagaagggagcagcaggaaggaaagctggtgggccacgaaagaagtcggttactcgatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgataaggaacgatgaggagctcggaaagctgttgtctggtgttacgattgctcatggtggtgttttgccaaacatcaacccggtcttgttgcctaagaagactgctgctaaagaatcaacaccaaagtccccatccaaagttggaaagtcacctaagaaagctgctgcttagattagtttgatgtggttgatgtgatagtgaattgaagttaatgtagtttgtatgattagatgtaatcatttaaattgaatgaagaccacttgtttctgttta

SEQ ID NO: 4037 - DNA, 681 bp, Artemisia annua
ctcaaaacacacacacattcatcaatcactcatttctttaaaaaatggagggaaccggtaaaatcaagaagggagcagcaggaaggaaagccggtgggccccgtaagaagtcggttaccagatctgttaaagccgggcttcagtttccagttggaagaattggaaggtatttgaagaaaggtcgttatgctaagcgtgttggtactggtgctcctgtttatctcgctgccgtcctcgagtatctcgcagctgaagtgttggagttggctggaaatgcagcaagggacaataagaagaccagaataatcccaagacatgtgttgttggcgataaggaatgacgaggagcttggaaagttgttgtctggagttacgattgctcatggtggtgttttgccgaatatcaacccggtcttgttgcctaagaagactgctgctaaagaatcaacaccaaagtctccatccaaagttggaaagtcgccaaagaaagctgctgcttagattagtttgattgtgatttggggtgttttcttttggttggtttcgtagagaagttagtgtagttaatttgattagatgtaatcgtttctactgaatgaaaactacttgtttctgtttattttctttgtgttgataatttggttgtgaaacctagataacaatgattagtatttggagtttg

SEQ ID NO: 4038 - DNA, 725 bp, Ipomoea nil
gatcgtgctcaatcctccgcattaagcgctccaatctttttatacccaaagagtttagcttaatttagcttatcattccatggatgctccggcggcgaagataaagaagggtgccggcggccggaaaggcggcggcccgaagaagaagccggttacccgctccgtccgtgccgggcttcagttcccggtgggtaggatcgggcgttacctcaagaagggccgctatgcccagcgtgtcggcaccggcgctcctgtttacatggctgccgttctcgaatacctggctgccgaggttttggagttggctggaaatgcagcgagggacaacaagaagaacaggatcattcccagacatgttcttttggctgtgaggaacgatgaggagctggggaagttgttggctggggtgaccattgcccatggtggggtgctgcccaacataaaccctgtgttgttgcccaagaagagtggatctgaggcaacaaaggagccaaaggcaaaggctgccaagtcccccaagaagaaggctgcttgatttgatagtgtagattagtggggttttgtcccttgtttctgtatgtgacttggggccattctttgcttatagaaggtgtaattgttagttgtgttgtaaacgtaatgtttggttatcaattaatgaaactctttttcatttctattgtctatggactctgctttgttgaattatattgttgggttcaaat

SEQ ID NO: 4039 - DNA, 595 bp, Helianthus annuus
  misc_feature (26)..(26): n is a, c, g, or t
  misc_feature (44)..(44): n is a, c, g, or t
  misc_feature (214)..(214): n is a, c, g, or t
  misc_feature (286)..(286): n is a, c, g, or t
  misc_feature (292)..(292): n is a, c, g, or t
gacacaaaaccatttcccacacaganacacacacaaagcaaaancccaaatggaaaccaccggaaaagctaagaagggtgccgcaggtcgcaaagctggcggtccaaggaagaagtccgtcacccgctccgtcaaagccggtctccagtttcccgtcggcagaatcggccgtttcctcaaacacggccggtatgcaaagcgtgtcggcaccggngctccggtttacctcgccgccgtcctcgaataccttgcagctgaagtgttggaattggcgggaaatgcagcnaggganaacaagaagaacaggataacaccgagacatgttttgttggcgataaggaacgatgatgagctggggaagttgttggctggagttacgattgcacacggtggtgttttgccgaacattaacccggtgttgttgccaaagaagagtgctgctgctgcgaaagagcctggaaagccgcctgctaagactggaaagtctccgaagaaggccgcataatttgggtcgggttaagttgtagttaaaattgggaatgaatgtagtttggtaatagtgtttgttatgtttatgttgaggttaatgaatgaa

SEQ ID NO: 4040 - DNA, 808 bp, Orobanche aegyptiaca
tttcatatctatcctttttgaatcacagagtaaaaaagaaacagaaacagaaaatggatgctagtgcaaaggtaaagaagggagctggtgggagaaagggcggcggtccgaagaagaagccggtttctcgatccgtgaaagccggtctgcagttcccggtcggtaggatcggacggtatctgaagaagggacgctattctcagcgtgtcggtaccggtgcaccggtttacatggccgcggtgctggaataccttgctgctgaggttctggaattggctggaaatgccgcaagagacaacaagaagaacagggtaatcccaaggcacctattgcttgctgttaggaatgatgaagaacttggaaagcttcttgctggagttacgattgcacatggtggagttataccaaacattaaccctattctcttgcctaagaagagtgataaggttgctgagaagacgcctaaatccccagcaaagaaggctgccaagtctccaaagaaggcataaattagtgtttgttattgaatctgtgattgataggtttgtgttgtttctttaggagttatgttcttgtgtttatgtaggagaccgtgtttataactttagcaatttgtacttttatcctttttgttggtatttctgttaattcctattatttcagtctgatggaattgcagttcctttccaatttcattttgttactcaacttgattaatggctagaactttattttctttcaatatgaaggtaagtaagaattgaattttttcccaggtttttatgctatgatggcatttgttcagtaa

SEQ ID NO: 4041 - DNA, 621 bp, Lactuca sativa
  misc_feature (258)..(258): n is a, c, g, or t
  misc_feature (274)..(274): n is a, c, g, or t
  misc_feature (278)..(278): n is a, c, g, or t
ccgaagaaccactcattccttctttctttcgtcgacgttattcagagaatggagggagccggaaaagctaagaaaggtgccggaggaaggaagggcggcggcccaaggaagaaggcggtttcccgttctgtcaagccggacttcagtttccggttggtaggatcggacgttttctaaagaaaggccggtatgctcagcgtgtcgggtccggagctccgatttacctcgccgctgttcttgaatacctcgcagctgaantgttggagttggcggnaaangctgctagggataacaagaagaccagaataattccaaggcatctcctgttggctattagaaacgatgaagagcttgggaaattattgggcggagttacgattgctcatggtggtgttcttccaatatcaatcctattctattgccaaagaagactgctgctaaggagccatcatctccgtctaaagctgcaaaatctccaaagaaagctaagaaggctgaatagattaagctggttgatttttcatcgttttgtgaaaaatctaggaatggggagaattgtatttcgatgatgtattttaccaaaatacataatattaaaaagcatagattacttcttagaaa

SEQ ID NO: 4042 - DNA, 885 bp, Sorghum bicolor
gggaaaaaacacggagaaatcgaacgcgaaagagggtgacgagggaggagaggagagagaaagagaggcggggaaggagatagcacgggggctttatcggagatggatgccggagcaaaggtgccgaagaaggccgcggcagggcgtcgcggcggcggcggcccgaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgccgaggtcctcgagttggcggggaacgcagcgcgggacaacaagaaaaaccggatcatcccgcggcacgtactgctggcgatccgcaacgacgaggagctcgggaagctgctggccggcgtcaccatcgcgcatggcggggttctgcccaacatcaaccctgtgttgctcccaaagaagaccgctgccgccgccgccaaggagggcaaagagaagaagtcacccaagaaggccgccaccaagtcgcccaagaaggcggctgccgcataggctcccgccaatgccggtgcccttgtctcttgctctcttcctctgtccgctctgaactgaaacgctcctagctgtcgttgtcggtcaaggtcgttgttgcttgatgcatttgttgtggttgttcgtgtgtaattgcgcgcctttcgcccaatccgcatgtactgtgtaggttgacactggtttaggtttcgatctgtgaaacgctggtttagattcaaggagtgtgtgagctgtgaagggcaggggatggggtgggatctgtgaatcattagatgctgtttgtaataatattgcgaagatgtg

SEQ ID NO: 4043 - DNA, 895 bp, Sorghum bicolor
agggtgacgagggaggagaggagagagaaagagaggcggggaaggagatagcacgggggctttatcggagatggatgccggagcaaaggtgccgaagaaggccgcggcagggcgtcgcggcggcggcggcccgaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgccgaggtcctcgagttggcggggaacgcagcgcgggacaacaagaaaaaccggatcatcccgcggcacgtactgctggcgatccgcaacgacgaggagctcgggaagctgctggccggcgtcaccatcgcgcatggcggggttctgcccaacatcaaccctgtgttgctcccaaagaagaccgctgccgccgccgccaaggagggcaaagagaagaagtcacccaagaaggccgccaccaagtcgcccaagaaggcggctgccgcataggctcccgccaatgccggtgcccttgtctcttgctctcttcctctgtccgctctgaactgaaacgctcctagctgtcgttgtcggtcaaggtcgttgttgcttgatgcatttgttgtggttgttcgtgtgtaattgcgcgcctttcgcccaatccgcatgtactgtgtaggttgacactggtttaggtttcgatctgtgaaacgctggtttagattcaaggagtgtgtgagctgtgaagggcaggggatggggtgggatctgtgaatcattagatgctgtttgtaataatattgcgaagatgtgtaaaatccgttctgtgcttccattccgtgcttgattgtctgg

SEQ ID NO: 4044 - DNA, 705 bp, Cleome spinosa
gggggggaaaggtgatcatttcctctgtgacgtagtcaacaaccatggatgctggagcaaaattgaagaagggtgcgggcggaagaagaggaggtggtccgaagaaaaagccggtttcgcgatcggtcaaatccggtcttcagttcccggtcggcaggatcggtcggtatctgaagaaaggtcggtattcgcagcgtgtcggaaccggtgctccggtgtatctcgccgccgttctcgagtatcttgctgcagaggttctagagctcgctggtaacgcagcaagggacaacaagaagaaccgcataataccacggcacattttgctagccgtgaggaacgacgaagaactcgggaggcttctacaaggagtgacaattgcgcatggaggagtgttgcccaacataaaccctgttctcctaccaaagaaacccgaaaagactgcagctgctgtgaaggagaccaagtcgccgccatcaaaggcagccaaatctcctaagaaggcatagtaccattctgtgttaacttgaaaaaaaacctctaccaaccgacccaatgtgtatgtttgctctgtagagacagtaacatttatgtggagtttgtgttatcattgtatgcagctgcatagttctctgcttgtcttaacaaacatctgaagttcagattctgattgtgatctcagactcggtgttcaccgatttgttgggt

SEQ ID NO: 4045 - DNA, 860 bp, Solanum melongena
aaaattcattgcaattctatcacttcccaccaattatttgttaaaattatcattttgggtttcacttttgtaagctagaaatatggagaagaagggtgctggaggaagaaagggtggtggcccaaagaagaagccagttacaagatctgttaaagctggattgcagtttccggtgggtagaattgggcgttacttgaaaaagggtcggtattctcagcgtgttggaactggtgctcctgtttatcttgctgctgtgcttgagtaccttgctgctgaggtattggagttggcgggaaatgcagcaagagataacaagaaaaacagaatcataccaaggcatgttttgttagctgtgaggaacgatgaagaacttggaaaacttctagctggtgttacaattgctcatggaggtgttcttcctaatatcaatccagttcttctgcctaagaaatctgataaagttggaaaagaacctgctaaatctccatctaaggctaccaagtcaccaaaaaaggcctaaatttctgaagacaaacgacttgtttggcgatggacattgtaccaaagttgcatgatttaggattaatgactccgtgtttggttcaaataatctgttaatgtgtgtagttttggtatctatttatgcttcttgtagggatgaaaggtcttgttgaaaactaggaacagtttatttgttttttgttttgtaaaacaaatgatttgtcactttatcaattactactacttcaatggttacaaatgaaatggcctagttttgttgttgtatttgtgtcgaattctttaaaaatgagctatttttgaagagtttgacatgtatccgtaaacatttttacagagtt

SEQ ID NO: 4046 - DNA, 725 bp, Panax ginseng
ggggatggtcgattggacaaacaccctttttagttttaatctttgtttctctctagattccggttgtttttataatttctcctcgactcattgaaataaaatggagactggtggaaaatttaagaaaggtgccgccggaaggaaaggaggcggtcccaagaagaagtcggtgtctcgctccgtcaaggccggactacagttccccgtcggaagaatcggccggtacctcaaagtgggtcgttatgctaagcgcgtcggctccggagctccggtctacctagctgccgttcttgagtacctagctgctgaggttttagagttggctggaaatgcagcgagggacaacaagaagaaaacgattataccaaggcatgttctattggctgtgaggaatgatgaggagcttggaaggcttcttgctggagttacaattgctcatggaggtgtgcttcccaacattaacccagttctgttgccgaagaagtctgagaaggcagctaaggaacctaccaagtcaccctcaaaggcaactaaatccccaaggaaagcttagttatggtttctttctctgtgtgtttagaagaaagaagcctagttgtagctttctagttcctctcttgtatgtaatttgttttacagttgtgggggttttaggaaatttgtgccctttagttgttaggccgaattgtagtttctctttctgtttcctcctgttagtccttgaa

SEQ ID NO: 4047 - DNA, 752 bp, Malus domestica
tttcacttctacaatttatttaattattttctgtttgtttctcgggaaagtcggttcagaagttgatcccagcgcggagggcagggtgatggaaaccggtgggaagttcaagaaaggcgcaggagggaggagagccggcggtcccaagaaaaaaccggttacccggtctgtgagagctggtctgcagttcccggtcggacgtatcggccggtacttgaagcatggccgatacgctcagcgaatcggaaccggagctccggtttatctggctgctgtgctcgagtaccttgctgctgaggttttggaactggctggaaatgctgcaagagacaacaagaagaatcgcattatcccaaggcatgtgctattggccgtgaggaacgatgaagaacttggaaagctcctgaagggtgtgacaattgctcatggcggtgttcttcccaacatcaatcctgtgcttctgccaaagaagcatgagagggttgcgaaagagcccaagtcgcccgtcaaagctgccaccaagtcccctaagaaggcataactgatctaattagcagtgtctatggtagtacctgtctatggagtctccatgtctgtacatggttagtaggatgccttcatgtgtcgttatccccttcgttatccccctaggacttaagactctttgcactctctgtttcaatatccgcttagaacatctgtgtttcatatgaaatgaaattcacccgacttctagattttcgccttttgca

SEQ ID NO: 4048 - DNA, 638 bp, Malus domestica
ccccaagtcactcattgtttttccgacgtgcaacagagaagagatctgagaaatggaaggtggtggaaaagttaagaagggtgcggcaggaaggaagggaggcggtccgagggctaagccggtcacccggtccatcaaggccggtttgcagttccccgtcggtaggattggccggtacttgaagaagggtcgctatgctcagcgcgtcggaaccggcgctccggtatatctggccgccgtcctcgagtacctcgccgctgaagtgctggagttggcaggaaacgcagcccgtgacaacaagaagaacagaatcatcccaaggcacttgctcctcgcggttcggaacgacgaagagttgggaaaattgcttgctggtgtgaccattgcccacggtggtgttcttccaaacatcaacccaattctgttgccaaagaagactgacaaggctaccaaggaacccaaatctccttccaaggccaccaaatctcccaagaaatcagcttagtcattagactagaatagacaaggctagtaatgaacctagttctatatgattctcagttgtaatttttggggcttgtgacttattttgttgttttgtggtgaaattggtacgaaaggccaatgtaattactctg

SEQ ID NO: 4049 - DNA, 681 bp, Centaurea maculosa
  misc_feature (41)..(41): n is a, c, g, or t
  misc_feature (66)..(67): n is a, c, g, or t
  misc_feature (527)..(527): n is a, c, g, or t
  misc_feature (668)..(668): n is a, c, g, or t
ggcggggacaaatcatcacttgtcaatatatcaccagaganaaaagagagaagaagaaaatggaanntaccggaaaagcgaagaagggcgccggtggccggaaaggtggcggtccgaggaagaaggcggtgactcgctccatcagagctggcctccagtttcccgtcggtaggattggccggtatcttaagaacggccgttatgctaagcgtgtaggtaccggagctccggtgtacctcgccgccgtgctcgaataccttgccgctgaagttttggaattggcagggaatgcagcaagggataacaagaagaacaggataatccctagacatgttcttttggcaattaggaatgatgatgagcttggaaagcttttggctggagttactattgcacatggtggtgttcttcccaacataaacccaattctgctaccaaagaagacagctgcaaaggagcctaaatcaccatcaaaatcaacaaaatctccaaagaaagctgattaggttgctttattaaatgaatgntgttgtttatggctgtctgtaatttgtagttaaattggaaatggaatttagttttcttctaaccattgagactgttttagatgttgatgttgattatatgttgttatggatcagtttcaatgcaagaaaccccttgtttcnatgtacttgctta

SEQ ID NO: 4050 - DNA, 736 bp, Centaurea maculosa
ttgagaaatggagaccggtgggaagttgaaaaagggcgctgccggaaggaaggccggtggtggtcccaagaagaagccggttacccgctccgttaaggccggtttgcagtttccggtcggcaggatcggccggtacctgaaaaaaggtcgctattcgaagcgtgtcggtaccggtgctccggtgtacctcgccgccgttctcgagtaccttgctgctgaggtgttggagttggctggaaatgctgctagagacaacaagaagaacaggatcataccaagacatgtgttgttggctgtgagaaatgatgatgagcttggaaagcttctttctggtgtgacaattgctcatggtggtgttctacctaacatcaatccagttcttttgccaaagaagtcacatgacaaagctacaaaggaacctgcaaaatctccatcaaaagcaaccaagtccccaaagaaggcttagttgttgaacaacctcttcattctccttgtatctatctattcacctttttttggtgatgtagggatatattaagtggtatggtgttttttagggagatttagaagtactgtcttttgaaatgaatatgtttaggagctaggggttgaagaagaagaatctctctttttctgaatcttttttagatgggtgttacatttgtataagaaaattgttaaagattgctcaaatatgttgatgtgtttcttggatattggtgatttgtgttccaaa

SEQ ID NO: 4051 - DNA, 743 bp, Rosa hybrid cultivar
gaaattttactttattactttttctctgtttaattccaggccgaggtttgagctatggagaccggaggcaagttcaagaagggcgccggaggcaggaaggccggcggtcccaagaagaagccggtgacccggtcgaccaaagccggactgcagttccccgtcggaagaatcggccggtacttgaagaatggccggtacgctcagcgggtcggatccggagctccggtttaccttgctgctgtgctcgagtaccttgctgctgaggttttggaattggctggaaatgctgccagagacaacaagaagaatcgcataatcccaaggcacgtgctattggctgtgaggaatgatgaagaactcggaaagctgcttgctggtgtgacaattgctcatggtggtgtgcttcccaacatcaaccctgtgcttctgccaaagaactctgggaagacggctgcgaaggagccaaagtctccatccaaagccaccaagtcccctaagaaggcggcttaggcttaacttctctcagtactctgatctgatcagtagtgtatgtggtagtcatgtatctctgtatgaaatctacctgtttgtatttcatttctagggttgctcgttatgcccttaggatttcatatcattgtacaagctttatttccatttcctgttgaacatcgatccttcatttcagatgaaatgaaatttgcctgactcctaaattattgcctgtgaaatttgcacttgta

SEQ ID NO: 4052 - DNA, 744 bp, Rosa hybrid cultivar
  misc_feature (739)..(739): n is a, c, g, or t
gcaaattttactttattactttttctctgtttaattccaggccgaggtttgagctatggagaccggaggcaagttcaagaagggcgccggaggcaggaaggccggcggtcccaagaagaagccggtgacccggtcgaccaaagccggactgcagttccccgtcggaagaatcggccggtacttgaagaatggccggtacgctcagcgggtcggatccggagctccggtttaccttgctgctgtgctcgagtaccttgctgctgaggttttggaattggctggaaatgctgccagagacaacaagaagaatcgcataatcccaaggcacgtgctattggctgtgaggaatgatgaagaactcggaaagctgcttgctggtgtgacaattgctcatggtggtgtgcttcccaacatcaaccctgtgcttctgccaaagaactctgggaagacggctgcgaaggagccaaagtctccatccaaagccaccaagtcccctaagaaggcggcttaggcttaacttctctcagtactctgatctgatcagtagtgtatgtggtagtcatgtatctctgtatgaaatctacctgtttgtatttcatttctagggttgctcgttatgcccttaggatttcatatcattgtacaagctttatttccatttcctgttgaacatcgatccttcatttcagatgaaatgaaatttgcctgactcctaaattattgcctgtgaaatttgcanttgta

SEQ ID NO: 4053 - DNA, 703 bp, Fragaria vesca
ggagaccggaggcaagttcaagaagggcgccggagggaggaaggccggcggtcccaagaagaagccggtgacccggtccaccaaggccggtctgcagttcccggtcggaagaatcggccggtacttgaagaacggccggtatgctcagcgggtcggatccggagctcctgtttaccttgctgctgtgctcgagtaccttgctgctgaggttctggaattggctggaaatgctgcaagagacaacaagaagaatcgcattatcccaaggcatgtgttattggctgtgaggaatgatgaagaactcggaaagctgcttgctggtgtgacaattgctcatggtggtgtgcttcccaacatcaaccctgtgcttctgccaaagaactctggcaagacggctgccaaggagcccaagtctccatccaaagccaccaagtcccctaagaaggcggcttaggcttaacttttctcagtactctgatctgatcaatagtgtatgtggtagccatgtatctctctgtatggaatctccccgtgtatttcatttctagggttgctcatcatgcccttaggatttcatatcattgtacaatcgttatttccctttcctttagaatctcaatctttcatttcagatgaaatgaaatttgcccgactattacctgtgaaatttgcagttggaatgttatataactaatgttctttt

SEQ ID NO: 4054 - DNA, 646 bp, Saccharum officinarum
ctctcaatctcaaagcgcagcagcagcaaccgccggcggccatggacgtgagcggagcaggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcggccacggcggtgtccttcccaacattcactctttggttcttccaaaaaggtgggccagaaggcggccaaggacccaatttgccaagaaggcggcaagttccccaagaagggctagagtggtttttgttttttagaggcaagggagggttcttcttttgacctttaccatttgtgctgccttgtaaaataaatcattgttaatggtcctttggaacgtttttgttcttggtggtaattggaatggttatttagtact

SEQ ID NO: 4055 - DNA, 588 bp, Saccharum officinarum
caccactcacattcacaacgcccacagcccacaaaattttctgctgtcaatcacagcacgaacggcgaacgatcatggaacccagacgagccaccggcaaggcaaacaaaggtgctgccgatcgcaaggctggcaggccacggaagaagtcggtgtcgcggtccgtcaaggccgggctgcagttccccgtcggccgtatcgggcgctacctcaagaagggccggtacgcgcagcgcgtgggcacgggcgcccccgtctacctcgccgccgtcctggagtacctcgccgccgaggtgctggagctggccgggaacgcggcgagggacaacaagaagacgcgcatcatcccccgccacgtgctcctggccatccgcaacgacgaggagctcgggaagctgctggccggcgtcaccatcgcgcacggtggcgtcctccccaacatcaacccggtgctcctgcccaagaaggtggccgagaaggcggccagcggcagcaacaagcaggccaagtcccccaagaaggcttagaaaataggggctccattaacactgggttgtaacttggtcgtgtttaaatctgtggatggga

SEQ ID NO: 4056 - DNA, 937 bp, Nicotiana tabacum
catctctcgctccgacaatcaagatttccttcaaatctttcatcattttggtctaaaattctaatatctgcaaatggatactagcggaaaagcgaagaaaggtgcagccggaagaagagtcggcggtccaaagaagaagccggttacccggtctgttagagccggtcttcagttcccggtcggtagaatcggtcgatacttgaaaaaaggccggtacgctcaacgtgttggtactggtgctcccgtttacttagctgctgttctcgaatatttggctgctgaagtgttggaattggccggaaatgcagcacgtgacaacaagaagaacaggattattccaaggcatgtgcttttagctgtgaggaatgatgaagagctagggaagttgcttgctggtgtgacaattgcacatggtggtgttcttcccaacattaacccaattttgttgccaaagaaaactggaggtgaaaaggctggcaaagaacataaatctccttccaaagcaaccaaatctcctaagaaggcttagatttagtggctgttataagcctcttgcttttctatctttatttggatcttcattgtatgtaattctggtgttagattgtgttaatgtctttcagggatattaaaaaggaaactagttggaacttgttagatcttgttaggtgttcctctattatcaatcaatgaaacctcttgtttcgattttacaatttcaaaaaaaaattttttttttttgattatatgtatcagtcactaaaaccagtcttcgaccagaaattattgcaagcggtttggacaatcatacttacataaggatcaaacgggctcttttcagaaaagatccatgctttcaagtttcaactctgttctcacataaaaaatttctccaagcaactgctatttcagggtcatagaccagcggccgcatgag

SEQ ID NO: 4057 - DNA, 631 bp, Artemisia annua
acacacactcatttcaccttcaaaaacacacacatatcaaatctaaaaaatggacgcttcaaaaaccaagaagggagccggtggacgtaagggaggaagaagtcggtgacccggtctgtgaaagccgggcttcagtttccggtcgggagaattggtaggtatttgaagaatggaaggtatgccaagagggttgggactggtgctccggtttatcttgctgctgtccttgaataccttgctgctgaggaattggcaggaaacgcagcaagggacaacaagaagaccaggatcatcccaaggcacgttctattggcaatcaggaacgatgacgagcttggaaagttgttatctggagtgacaattgcacacggaggagtgcttcccaacattaacccagtcttgttgccaaagaagactgccgcaaaggagcctaagtcaccaagtaaaggaaagtctcctaagaaggccgctgccactgctgctgagtagattgggtagtgtttgggttgtgggtgttgctgggttgtttgtaatttgtagttaatgaatgattatgtggtcagttgtttgtttaggttgttatggtttatgtgttgttgatcgttggttattaatgaagaaacttcttgtt

SEQ ID NO: 4058 - DNA, 670 bp, Medicago truncatula
attcatcaaattctcaattcaaaccttcttcgcattcaaatttctttctctcaaaatctcagttcaaaatggacaagaaaggagccggtggaaggaagggaggaggaccaaggaagaagtcggtgacaagatccatcagagccggtcttcaatttccggttggaagaatcggtagatacttgaagaaaggaagatacgctcagcgtgtaggcacaggtgctccagtatacctagcagcagttcttgaatatctcgctgctgaggttcttgagttggctggaaatgcagcacgtgataacaagaagaatagaatcattccaaggcatgtgttgttggctgttaggaatgatgaagagcttggtaaattgcttaatggtgttaccattgctcatggtggtgttcttccaaacattaaccccatcctcttgcctaagaagactgaaaaagctgttcctaaggagccaaagaaggctggaaagtctccaaagaaggcttagatctgatctgttttcaatctttagatgattgtgtttatatctaagactagggttactttatgtcatagaaatcggttttagtgctttcatataatgcaatgtaactccatcttattgcatttctcctttaggacttttatctatcaatgaaatttattcaatttcaatattat

SEQ ID NO: 4059 - DNA, 821 bp, Mimulus guttatus
ctcaaaccccccacttatttaatagcagcaccaccttcacaaatcaacacgcactattacaacttctctctctagctcagaatctgattcttcttatcaaaccctttttgtagcagagagaaatggaaacaggcggaaaaatgaagaaaggtgctgctggaaggaagggaaccggtccgaagaagaaaccggtttcccggtcaatgaaagccggcctgcagttccccgtcggtagaatcggtcggtatttgaagaagggacggtattctcagcgagtcggatccggtgctccagtttacatggctgctgttctcgagtacctcgcagctgaggttcttgaattggctggaaatgctgcaagagacaacaagaagaacagaattattccaaggcatttgctacttgctgtgaggaacgacgaagagctgggtaagcttcttgctggtgtaacaattgcacatggtggagtgataccaaacatcaaccctgttcttcttcctaagaaatccgaaaaggctgctgctgcagagaaatcccccaaatccccggcaaaggcgacaaagtctcctaagaaggcttaaatcataagtttgtttagagtgtccaaagggatttgttgttgtgcaggagtttgagttcttgtgtatgtaattgggatgttgatgttagagtatgtagggaaaaaaggctgttgtttataactggattaatccctttgtactacttgtttgactgtttttctttattagagttgtcttcattttgaattaaattgaaaaaactattgctgcttagttttaataaccggaattagttatttg

SEQ ID NO: 4060 - DNA, 716 bp, Avena sativa
cctcatcctctccaatccccattccgtcccaaatcctctgcctccttctcgccggagcaagcaagtcagcagccaaggagatggacggcagcaaggcgaagaaggtggcggtgaagaagctcggcgggccgaggaagaagtcggtgacccgctccgtcaaggccgggctccagttccccgtcggcaggatcggccggtacctcaagaacggccgctacgccaagcgcgtcggcaccggcgcccccgtctacctcgccgccgtcctcgagtacctcgcagctgaggttctggagcttgcgggcaacgcggcgaaggacaacaagaagtcccggatcatcccgaggcaccttctcctcgccatccgcaacgaccaggagctcgggaggctgctcggcggcgtcaccatcgcccacggcggcgtgctgcccaacatcaacccggtgctgctccccaagaagtccgtcgagaaggccgagaaggccgccgctaagtcgcccaagaaggccaccaagtctcccaagaaggccgccaaggcctagatccggaccggtctcatgatgagctaggctctgtatgcgtggctgtgattgtgtactcggtgcctcgattcagagtcgggcagatgtagtttagattggtttggtcagtgtagtagttccctttcgttgtaatgtaactgtgaacatggggaagccgcttgcttcctctcctctatg

SEQ ID NO: 4061 - DNA, 879 bp, Orobanche aegyptiaca
cttcttcttcttgaacagtcgttttcgtaacaaagaaagaaaaaacagagaaaatggatactagtgcaaaggtaaagaagggagctggtggcagaaagggcggcggtccgaagaagaagccggtttctcgatccgtgaaggccggtctgcagttcccggtcggtaggatcggacggtatctgaagaagggacgttactctcagagggtcggtaccggtgcgccggtttatatggccgccgtgctggaataccttgctgctgaggttcttgaattagctggaaatgcagcaagagacaacaagaagaacaggataattccaaggcatctgctgcttgctgtgaggaatgatgaggagcttggaaagcttcttgccggagtcacaattgctcatggtggagttataccaaacattaaccctattctgctgccgaagaagagtgataaggttgctgagaagacgcctaaatccccagccaaggccaccaaatctcctaagaaagcttaaatttgttaatgtcgtatctgggattgaatggcttctttttttagaggttatgttcttgcgggtttagatagaaacggtgtttataactttaggagtaatttgtactttattctgtttatcggcaattctgttagatctcatttaatggaaagacagtttcaaatggatctgcattatttacttacttttgaattgcttgacccatgaagtttagtgtttgagtacttggaatatttcgactaatgatgaatggtgagtgagaattgagttgtaactaaacaagccgaagaattccaaattcttgaatttgtttaattacaattgtttaatttattatcagtaatatgttaatgtatttactaaaaaaaaaaaa

SEQ ID NO: 4062 - DNA, 604 bp, Orobanche aegyptiaca
atatctccttcttcttattcatttcgttttctatcagatcagaaaaaatggaagccagtgggaaagtgaagaagggagccgctgggaggaagatcggcggtggtccgaggaagaaatcggttacccggtccgtgagagccggtctccagtttccggttggcaggatcggccgttatctgaagaaaggccgctatgctcagagggttggtaccggtgctccagtctacctggctgctgtgcttgagtaccttgctgctgaggttctggaattggctggaaatgcagctagagacaacaagaagaacaggataattccgagacatctgttgcttgctgtgaggaacgatgaagagctcggaaagcttcttgctggtgttacgatcgctcatggtggagttataccaaacattaaccctattcttttgcctaagaagaatgacaaggtcggtgagaagacccctaaatccccagcaaaggccaccaagtcacctaagaaggcctaaattagtgttgtcgatattggatagtgttagtgtagagccttttgtgcttttaatgtattattggtaatgattttgaaattaatggaaaattgtttacattt

SEQ ID NO: 4063 - DNA, 732 bp, Pisum sativum
accaagaaaggagcaggaggaaggaaatcaccacaattcatcaacgtccgattccaacaaagcaccgaaatctcaacaataatctagtgttcgaaatggacgcaagcaaacagaccaagaaaggagcaggaggaaggaaaggaggaggtccaaggaagaagtcagtgaccagatccgttagagctggtcttcaattcccagttggaagaatcggtcgattcttgaagaaaggtagatatgctcaacgtgttggtactggcgctcctgtttacttggctgcagttctcgaatatctcgctgctgaggttcttgagttggctggaaatgcagcacgtgacaacaagaagaaaagtatcagtccaagacatttgttgttagctgtgaggaatgatgaagagcttggaaaattgcttgctggtgttaccattgctcgtggtggtgttctacctaacatcaacccggtgcttttgcctaagaggactgaaagtgctgctgccagtactcctaagtctccatcaaaggccaagaaatctccaaagaaggcttagagtagttttcggatttgtgtgtataactgatctctaggtctttcttatgtagcataatgatttattgctattagagaaaatgtaattcgagttcactgtcctctgattaagtataatatgataaattcagtcgaaacaacttgcttcaactttttagtttccacctctatgtgagtcataaatg

SEQ ID NO: 4064 - DNA, 580 bp, Pisum sativum
gcacaaaggtgaagaaaggagccggtggaaggaaaggaggaggaccaaggaagaaatcggtgacaagatctgttagagccggacttcaatttcccgtcagtagaatcggtcgttttttgaagaaaggaagatatgctcagcgtgttggtaccggtgctcctgtttacttggccgctgttcttgaatatcttgctgctgaggttcttgagttggctggaaacgcagcacgtgacaacaagaagaatagaattagtccaagacatttgctgctggctgtgaggaacgatgaagaacttggaaaattacttgctggtgttaccattgctcatggtggtgttcttcctaacatcaaccctgttcttttgcctaagaggactgaaagtgcttcttcttctgcaaaggaacctaaatctccatcaaaggccaagaaaactcccaagaaagcttagattttgcttctcccttctgtgttgatatctcttaatcttagtttttaggcgtctctctctttttaatatataacaagcaatcaatgtaattccaatgtcattagttaatgaaatccttttatttttagtac

SEQ ID NO: 4065 - DNA, 706 bp, Triphysaria pusilla
tcgctttaccccaaatctgcaagctcaatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtcggcaggatcggtcggtttttgaagaagggtcgctatgctcagcgcgtgggttccggtgctccggtttacctggctgcggttcttgagtaccttgctgctgaggttctggagttagctggaaatgcagcaagagacaacaagaaaagcaggattatcccgaggcacttgttgctggccgtgaggaacgatgaggagcttggtaaacttcttgctggagtgacaattgctcatggtggtgtaataccgaacataaacccggttctgttgcccaagaaatctgacaaggttgctgagaagtcgcccaaatcgccatcaaaggccaccaaatctccgaaaaaggcttgaaaactgtgttttaggtgatagattgtctttgatttgtagagttgtaatttggattaatgttgttggtgtggttgaagtaggaactaggaatgatatttgtgcttttaatttggtatttgtcaatgagacttcttgtaatttcattcagaaattaaactctttgaattcttatttttgaatg

SEQ ID NO: 4066 - DNA, 658 bp, Antirrhinum majus
gagtcaatttgcgtttagtaacaaaagaatggaaactggtggtaaaataaaaaggagctgcaggtagaaagatcggcggtccaaagaagaaaccagtctcccggtccacaaaagccggtctacagttcccggtcggcaggatcggccggtacttgaagaaaggccgatacgcacagagagtcggaaccggagctccggtttacatggccgctgtgctggagtaccttgctgctgaggttttggaattggctggaaatgcggcgagggacaacaagaagaacaggattattcctcgtcatttgttgcttgctgtgaggaatgacgaggagcttggtaagcttctggctggtgtgacgattgcgcatggaggagttttgccgaatatcaacccggttctgttgccgaagaagtcggagaaggcagcagagaaggcggcgaaatcgccatcaaaggctaccaagtctcctaagaaggcttagatgatgttgttgtattgggagatttagtggcattgttgtttttctaagttttgagttagtctgtatgtagttgaattagcggtgttggtatgtagaagaaatgttgttcataactcatgttcaactgggtctgttagatttagctgcatttgaaatgaatcaaagagattggtactgtt

SEQ ID NO: 4067 - DNA, 710 bp, Antirrhinum majus
  misc_feature (19)..(19): n is a, c, g, or t
  misc_feature (624)..(624): n is a, c, g, or t
  misc_feature (710)..(710): n is a, c, g, or t
tttacccctcatcctcagntcagcaaccgtcaaatcgcaatggaggccgtcgcaaaggttaaaaagggcgccggaggaaggaagggcggaggcccgaagaagaagccggtgactagatccgttcgggccgggcttcaattccccgtcgggagaatcggccggtacttgaagaaaggccggtacgctcagcgtgtcggcaccggagctccggtgtacatggctgctgttctggagtacttagctgcagaggttttggaattggctggcaatgctgcacgggacaataagaagaataggatcattcctcgccatgttctgttggcggtgaggaacgatgaggagctggggaaactgttatctggtgttacgattgcgcacggtggtgtgcttccgaacattaatccggtgcttctgcctaagaagactggtggtgataaggctgagaaggcaccgaagtctccgtcgaaggctggtaaatcgcccaagaaggccgctgcttgatttgagctttttttaagctgttttgtatgtagtagtggtattaggagaattcggtgtatgcgctggtgttatatcagcttttgctatggattggattaatgaaaatcagcttttgtcaaaaanataatttaataaggtgctctgggtctctgcgttgtttccacgtctagtgccaggcggttttatggtattacattgttactgtgtan

SEQ ID NO: 4068 - DNA, 898 bp, Hordeum vulgare
gttctagatcacaaccagccgccccaaatccacctctcgccggagccccagcaagcaagcaaggcaaggtagccaggaagatggacggcagcaaggcgaagaaggtggcggggaagaagctgggcgggccgaggaagaagtcggtgaccaggtccatcaaggccggcctccagttccccgtcggccgcatcggccgcttcctcaagaagggccgctacgcccagcgcgtcggctccggcgcccccgtctacctcgccgccgtcctcgagtacctcgccgccgaggtgctggagctggcggggaacgcggccaaggacaacaagaagacccgcatcgtgccacggcacctgctgctggccatccgcaacgaccaggagctcgggaggctgctcgccggcgtcaccatcgcccacggcggcgtcatccccaacatcaacccggtgctgctccccaagaagtccgccgagaaggccgagaaggccggcgccgccgccaagtcgcccaagaagcccgccaagtcccccaagaaggccgccaaggcctagatccggccggcagtagctgtctcagcgaactgacgatgctccgtcggcggctctcgcgtgcgcagcgtccctcttaatttagctatgtcattgagtgttcgtgtttgattaggtgtagtggctgtctcggtggctgatttcaatatgtatcatcctgatgtaatcgcgaaccaaggggaagccgcttgcttcctgcttgactgatggattatcaactaagcgtttctgaaacttaatttgtctctgttggtttatccagatcttgctttttgtatgaagagacttattcaggctttttgctgtaaatcactgaactgaattggttcaatttgttatctgagatccaatcctat

SEQ ID NO: 4069 - DNA, 767 bp, Castanea mollissima
tctctctctgtcacactctttgcctttcaaatctcaatcagtcattctctacagttttcgtttcagtcttgcccggtaggtgtttgtgtttttgtcttctataatggataagaaaggtgccgggggaagaaaaggtagtggctcaaggaagaagtcggttccccgatccgtcaaagctggtttgcaattcccagtcggtaggataggtcggtaccttaagaaaggaaggtacgccaagcgttttggatcaggtgcccctgtttatatggcagccgtgcttgagtaccttgctgctgaggtgttggagttggctggaaatgcagctcgtgacaacaagaagactaggataatcccaaggcatgtgttgctagctgtgaggaatgatgaagagcttggaaaattgcttgctggtgttactatagctcatggtggggtccttcctaatatcaaccctgttttgttgccaaagaagactgagaaggctaccaaagagcctaagtctccttccaaggctaccaagtcacccaagaaggcttagcttagtctttagcctaagtttagatgcttggttttcattttgtatgtaagctggttttaggatcttgcttatttttttgttgattgttgtgtaggggaaaagttaatggatttgaaacagctttgtgatctctatgttaggattttggtaatgaattaatggatgaaatgaaaccacttgtttctactaccaaaattaacgggtaatgttattagtatttttttgttgg

SEQ ID NO: 4070 - DNA, 732 bp, Festuca arundinacea
  misc_feature (37)..(38): n is a, c, g, or t
  misc_feature (99)..(99): n is a, c, g, or t
  misc_feature (102)..(102): n is a, c, g, or t
  misc_feature (104)..(105): n is a, c, g, or t
  misc_feature (112)..(112): n is a, c, g, or t
  misc_feature (162)..(162): n is a, c, g, or t
  misc_feature (237)..(237): n is a, c, g, or t
  misc_feature (273)..(273): n is a, c, g, or t
  misc_feature (288)..(288): n is a, c, g, or t
ggcacgaggatcgcatcctcctctcccatcacacccnnatcctctcgccggagccaagcaagcagcaaggaaatggacgccagcaagggaaagaagttngcngnnaagaagntcggcgggccgaggaagaagtcggtgacccgctccgtcaaggccgggctncagttccccgtcggccgcatcgggcggtacctcaagaagggccgctacgccaagcgcgtcggcaccggcgccccngtctacctcgccgccgtcctcgagtacctcgcagcngaggttctggagctngcgggcaacgcggcgagggacaacaagaagtccaggatagtcccgaggcacctgctgctggccatccgcaacgaccaggagctcgggaggctgctcggcggtgtcaccatcgcccacggcggcgtgctgcccaacatcaacccggtgcttctccccaagaagtccgttgagaaggctgagaaggtcgctgccaagtcgcccaagaaggctgccaagtcccccaagaaggccgctaaggcgtagatctggaccatgctgatgatgatgaactaggctctgtgtgattgtgctactccttgtgtacttagtgctttgattgagagtctggtctatttgtagtttagtagctcggtttgtttggggacagtcccttgactttgctatgtaatcgtgagcatgaggaagccgcttgcttcctctgtctaatcaattatccaagttatg

SEQ ID NO: 4071 - DNA, 654 bp, Festuca arundinacea
  misc_feature (159)..(159): n is a, c, g, or t
gcaaggaagatggacgccagcaagggcaagaagttcgcggcgaagaagctcggcgggccgaggaagaagtcggtgacccgctccgtcaaggccgggctgcagttccccgtcggccgcatcggccggtacctcaagaagggccgctacgccaagcgcgtnggcaccggcgcccccgtctacctcgccgccgtcctcgagtacctcgcagccgaggtcctggagctggccggcaacgcggcgagggacaacaagaagtcccggatagtgccgaggcacctgctgctggccatccgcaacgaccaggagctcgggaggctgctcggcggcgtcaccatcgctcacggcggcgtgctgcccaacatcaacccggtgcttctccccaagaagtccgttgagaaggctgagaaggtcgccgccaagtcgcccaagaaggcggccaagtcccccaagaaggctgccaaggcgtagatccggaccatgctgatgttgatgaactaggctctgcgtggttgtgctactctttgtgtacttagtgctttgatggagagtctggtctagttgtagtttagtagctcggtttggtcggggacatggttccttgactttgctgtgtaatcgtgagcatgaggaagccgcttgcttcctctgtctaat

SEQ ID NO: 4072 - DNA, 626 bp, Actinidia deliciosa
  misc_feature (573)..(573): n is a, c, g, or t
aggctcaccaatctgctatttcggctgtttgtttctccggaaaatcgtgcaaccgtgaaaatggagaccggtggaaagatgaagaaaggtgcagcgggaagaaggggcggtggtccgaagaagaaaccgattacccggtccgtcaaggccgggctgcagttcccggtcgggaggatcggtcggtacctgaagaaaggccgatacgctcagcgcgtcggcagcggtgctccggtttacctcgccgccgtgctggagtacctcgctgctgaggttttggaattggctgggaatgctgcaagagacaacaagaagaacaggataataccgaggcacgtgcttcttgctgtgaggaacgatgaggagcttggaaagctacttgctggtgtgacaattgctcatgggggagtgcttcccaacatcaaccctattcttctccccaagaaaactcaagcaacaaaggagcccaagtctccaaccaaggccaccaagtcacctaagaaagcataacttatccatgtgtctaagaaaacctttatgtgcaattttagctcactctctctttctctccctgtntttaacttcatcttctgttgtgatgtgaggaaatcttcatgttgtacgagata

SEQ ID NO: 4073 - DNA, 618 bp, Lactuca sativa
  misc_feature (430)..(430): n is a, c, g, or t
  misc_feature (458)..(458): n is a, c, g, or t
cggggatcctaacgaaaatacgctaatttctcactgtttattcatcgctaaaagaaaaatggaaggcgtagcaaagtcaaagaagggtgccggaggaagaaaggccggtggtccaaggaagaaggcggttacccgctctgtcaaggccggactccagtttcccgtcggtagaattgggcgttttctgaagaaaggacgttatgcgcagcgtgttggaagcggtgctccggtttacctcgccgctgttcttgaataccttgccgctgaagtgctagagttagctggaaatgcttctagggacaacaagaagaccagaatcattccaaggcatcttctgttggccattagaaatgatgaagagcttgggaaattattaggtggagttacgattgctcatggtggtgttcttccaaatattaatccagttctnttgcctaagaagactgctgccaaggagncatcaactccatctaaagctgctaaatctccaaaaaaagctaagaaggctgagtaaattattgacgttagagtttgtagttctgttttggttaagatcacattataagtttgtatgctgatgctgatcaagatttaatgagtgaaacgacttgtttctta

SEQ ID NO: 4074 - DNA, 728 bp, Lactuca sativa
aaactcgccggaaaacttaggatttgttcattttcctcgattattttatctagaactcatctaccttgaaatgcagaccagtgggaaggtgaaaaagggtgctgccggaaggaaggcaggtggtccaaagaagaagtccgtgtccaggtccgtcaaggccggtcttcagttccccgtcgggagaatcggccggtacatcaagaatggccggtacgccaagcgtgtcggtagcggtgctccgatttacctcgccgccgttctcgagtaccttgctgctgaggtgttggagttggctggaaatgctgccagagacaacaagaaatcgaggatcataccaagacatgttttgttggctgtgagaaatgatgaagagcttggaaagcttttagctggtgtgacaattgctcatggtggtgttcttcccaacattaatccaattcttttgccaaagaaatctcttgagaaagccacaaaggagcccaaatctcccgctaaagcagctaaatccccaaggaaggcttagttgttgaagaacatgctctatcattatctgtttgtatctattcaccttctgttagtgtctcttggtgatgtaggatagtttgaaggctaatgcgttttagggtttaggtttgaagaagaatctctctttttcgaattgaaaattgtaatctttttaatttaatggatcatttggcatgtctttggccatctacaagaaaattgct

SEQ ID NO: 4075 - DNA, 665 bp, Lactuca sativa
  misc_feature (66)..(66): n is a, c, g, or t
  misc_feature (75)..(75): n is a, c, g, or t
aaaactcgccggaaaacttaggatttgttcattttcctcgattattttatctagaactcctctacnttgaaatgnagaccagtgggaaggtgaaaaagggtgctgccggaaggaaggcaggtggtccaaagaagaagtccgtgtccaggtccgtcaaggccggtcttcagttccccgtcgggagaatcggccggtacatcaagaatggccggtacgccaagcgtgtcggtagcggtgctccgatttacctcgccgccgttctcgagtaccttgctgctgaggtgttggagttggctggaaatgctgccagagacaacaagaaatcgaggatcataccaagacatgttttgttggctgtgagaaatgatgaagagcttggaaagcttttagctggtgtgacaattgctcatggtggtgttcttcccaacattaatccaattcttttgccaaagaaatctcttgagaaagccacaaaggagcccaaatctcccgctaaagcagctaaatccccaaggaaggcttagttgttgaagaacatgctctatcattatctgtttgtatctattcaccttctgttagtgtctcttggtgatgtaggatagtttgaaggctaatgcgttttagggtttaggtttgaagaagaatctctctttttcgaattgaaa

SEQ ID NO: 4076 - DNA, 641 bp, Lactuca sativa
  misc_feature (17)..(17): n is a, c, g, or t
cggggatcataacgaanaatccgttcatttctcactgtttattcatcgctaaaagaaaaatggaagccgcagcaaagtcgaagaagggtgccggaggaagaaaggccggtggtccaaggaagaaggcggttacccgctctgtcaaggccggactgcagtttcccgtcggtagaattgggcgttttctgaagaaaggacgttatgcgcagcgtgttggcagtggtgctccggtttacctcgccgctgttcttgaataccttgccgctgaagttctagagttggctggaaatgcgtccagggacaacaagaagaccagaatcattccaagacatcttctgttggccattagaaacgatgaagagcttgggaaattattgggtggagttacgattgctcatggtggcgttctcccaaatatcaatccaattctattgccaaagaagactgctgccaaggagccttcaactccatctaaagctgctaaatctccaaagaaagctaagaaggctgaatagattatgacgttagaatttgtagttttttttttggttaagattatattaaaagtttgtatgctgatgttgatcatggtttaatgaatggaacgacttgtttcttataattgttgcaacgtgggtctt

SEQ ID NO: 4077 - DNA, 662 bp, Liriodendron tulipifera
ctcgtgctcgatattttcgcgagaactttgcgggatggaggggacgggaaaggtgaagaagggcgccggagggaggaaaggaggcggtccgaagaagaagccggtttcccggtccgtgaaagccggtctgcagttcccggtcggtaggatcggccggtatttgaagaagggccgatactcgcagcgtgtcggaacgggcgccccggtttatctcgctgctgttcttgagtatctcgcagctgaggttcttgaattggcgggaaatgcagcacgtgacaacaagaagaacagaatcgtcccgaggcatgtgctattggcggtaaggaatgatgaggagctgggaaagcttttgaaaggtgtaacaattgctcatgggggagtcctacccaacatcaaccctgtccttcttccgaagaaaactggagctgcagctgagaaggcaggcaaggagccaagatccccttccaaggctgccaaatcccccaaggcttgattctaattctctcaaaggaaaagaaccttctctcagcacctttgtatgtaatcattagggtttagtggttttcttgttgtaggagagggtatcttcccttgctttcttaatgacattgtcttcatgtcctttgtgtttgaatgatactgtttccccccctttgtcaatg

SEQ ID NO: 4078 - DNA, 682 bp, Zea mays
aaccacatcaaccaaccccaccgaatccacctctcgccggagtcccagcaaggagcgagcaagccaggaagatggacgccagcaagctgaagaaggtggccgggaagaagttcggcgggccgaggaagaagtcggtgaccaggtccgtcaaggccggcctccagttccccgtcggccgcatcgggcgctacctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaggcacctgctgctggccatccgcaacgaccaggagctcgggaggctgctgtccggcgtcaccatcgcgcacggcggcgtcatccccaacatcaacccggtgctgctccccaagaagaccgccgagaaggccgagaagaccgccgccaagtcgcccaagaaggccaccaagtcccccaagaaggccaccaaggcctagatcgtagtagtgcggtgtgctgatggttccagtttggttagatgtagtagctgtttcactctgtatcctgcgcccctgatgtaatcggaatcaaaggggaagccgcttgcttcctcttgacttatgaattagtatcaactaagcgtttctgg

SEQ ID NO: 4079 - DNA, 680 bp, Medicago truncatula
gattcaaaccttcttcgcattcaaattttctttttctctcaaaatttttctcagtttgaaatggaggcaagcaccaagacaacaaagaagggagccggtggaaggaaaggaggaggtccaaggaagaagtcggtgacaagatcaatcagagccggtcttcaatttccagtgggaagaatcggtagatacttgaagaaaggaagatacgctcagcgtgtaggcacaggtgctccagtatacctagcagcagttcttgaatatctcgctgctgaggttcttgagttggctggaaatgcagcacgtgataacaagaagaatagaatcattccaaggcatgtgttgttggctgttaggaatgatgaagagcttggtaaattgcttaatggtgttaccattgctcatggtggtgttcttccaaacattaaccccatcctcttgcctaagaagactgaaaaggctgtttctaaggagccaaagaaggctggaaagtctccaaagaaggcttagatctgatctgttttcaatctttagatgattgtgtttatatctaagactagggttactttatgtcatagaaatcggttttagtgctttcatataatgcaatgtaactccatcttattgcatttctcctttaggacttttatctatcaatgaaatttattcaatttcaatattat

SEQ ID NO: 4080 - DNA, 737 bp, Nicotiana benthamiana
  misc_feature (5)..(5): n is a, c, g, or t
  misc_feature (13)..(14): n is a, c, g, or t
ttacngccggggnnatctctcgctccgacaatcaagttttccttcaaatcattcatcatttttgtctaaattctattatctgcaaatggataccagcggaaaagctaagaaaggcgcggccggaagaagaggcggcggtccaaagaagaagccggttacccggtccgtgagagccggtcttcagttcccagtcggtagaattggtcgttacctgaaaaaaggccgatacgcccagcgcgttggtactggtgctcccgtttacttggctgctgtgcttgaatacttggccgctgaagtgttggaattggctggaaatgcggcacgtgacaacaagaagaacaggattatcccacggcatgtgcttttagctgtgaggaatgatgaagagttagggaagttgcttgctggtgtgacaattgcacatggtggtgttcttcccaacattaacccaattttgttgcctaagaagaccggaagtgacaaggcgggcaaagatcctaaatctccttccaaagctaccaaatctcctaagaaggcttagatttaatgtctgttacaagccttttgtttttctatgtttacttggatcttcactgtatgtaattcttgttttagaatgtgtttgattttcctgttgaaaagggaattagttggaattgctagatcttattaggttgtcctctattatcaatcaatgaaaccccttgtttcgaatttaaaaaaaagatatttaaaaa

SEQ ID NO: 4081 - DNA, 726 bp, Petunia hybrida
gcggggcctcatctcacgctccacaatcaaatcctcttacattttttgtttgtgtctaaatttaatttaattatcttcaaaaatggagactggtggaaaagtgaagaagggtgctgctggtagaaggggtggcggcccaaaaaagaagccggtttcccggtctgtaagagccggtctacaattcccggtcggtagaattggccgttacttgaaaaaaggtcgttatgctcaacgtgttggtactggtgctcctgtttatttagctgctgttcttgaatatttagctgctgaggtgttggaattggctggaaatgcggcaagggacaacaagaagaacaggataataccaaggcatttgttattagctgtgaggaatgatgaagagttgggaaagcttcttgctggtgtgacaattgcacatggtggtgttttaccaaatattaacccagtgctgttgcccaagaagactggtggcagtgaaaaggctggcaaagaacctaaatctccatccaaagctaccaaatcaccaaagaaagcttaagatttagtgattttgtggaagcttttgttgtttttgtatgtaatccttggtgttagattgtgttgatttcatgtttaaggagaaagaaactagttttaactttgttagatgtgttgttaagtgtcttcttctattatcaatcaatgaaacctcttgtttcgaaaaaataatataattcgaattca

SEQ ID NO: 4082 - DNA, 727 bp, Papaver somniferum
  misc_feature (9)..(9): n is a, c, g, or t
  misc_feature (19)..(19): n is a, c, g, or t
  misc_feature (58)..(58): n is a, c, g, or t
  misc_feature (66)..(67): n is a, c, g, or t
  misc_feature (73)..(73): n is a, c, g, or t
  misc_feature (96)..(96): n is a, c, g, or t
  misc_feature (113)..(113): n is a, c, g, or t
  misc_feature (203)..(203): n is a, c, g, or t
  misc_feature (224)..(224): n is a, c, g, or t
  misc_feature (230)..(230): n is a, c, g, or t
  misc_feature (257)..(257): n is a, c, g, or t
  misc_feature (315)..(315): n is a, c, g, or t
  misc_feature (501)..(501): n is a, c, g, or t
  misc_feature (553)..(553): n is a, c, g, or t
  misc_feature (624)..(624): n is a, c, g, or t
  misc_feature (629)..(629): n is a, c, g, or t
  misc_feature (658)..(658): n is a, c, g, or t
  misc_feature (674)..(674): n is a, c, g, or t
  misc_feature (686)..(686): n is a, c, g, or t
  misc_feature (698)..(698): n is a, c, g, or t
cagatcaanccatattccnttctctttcccaaatcaccatttttaccggcatctgaanttccggtnngaaatnatccagattccagctattatcancaatggacgcaactggnaaagtgaagaaaggtgctggtggaagaaaaggaaatggtggtccaaagaagaaatcagtaacaagatctgttagagctggtttacaattnccagtaggtagaattggtagntacttnaagaaaggacgttatgctcaacgtatnggtagtggtgctcctgtttatcttgctgctgttcttgaataccttgctgctgaggttntggaattggctggaaatgcagctatagataacaagaagaaaacaatcaacccaaggcacattttgttggcagttaggaacgacgaggaattgggaaagcttctagcaggtgttaccattgctcatggaggagtcctgccaaatattaacccagtcttattgccaaagaagtctgaaaggtcaaccncagctgcatccaaagagcctaaatcaccagtcaaagccgccaagtctcctangaaggcttaaatgtctgtcgcagcaaaacaactatgaagacaaaataaccgaaaaatgaagggaaaaaaanctctnttctctttgtatgtaattctgggattatnttttatctgtagattntgtagtttgttntctttgtttgtntgaatgaaaccacttgtttctcttgctct

SEQ ID NO: 4083 - DNA, 808 bp, Senecio madagascariensis
cagaaaaccaattaaagatcaccaaagcttatataaatcacccccaatcatttcctatcttcacgctccgacaacaactcgccggaaacctaacaaactcccatttttcaaaatctccggccatcaaaatggaagccggtggaaaggcaaagaaaggagcagccggaaggaaagccggcggacctaggaagaaatccgtcacacggtcggtgaaagccggacttcagttccccgtcggtagaatcggccggtatttgaagaaaggccgttatgctaaacgtgtaggtaccggtgctccggtttacctcgctgccgtcctcgaataccttgctgctgaggttttggaattagctggaaatgctgctagggacaacaagaagactagaattataccgaggcatgttttgttggcggtgaggaatgatgaagagcttggaaagcttctagctggtgtaacgattgctcatggtggtgttcttcctaatattaacccggttcttttgcctaagaagtctcagtctggaaaagagcctgctagtaaatctccggttaaagcgactaagtcaccaaagaaaggtgctgctgcttaaatgttgaaggagtagatggacgatttgtgtgtatgtattgttgtttggtgaagtaggatggttttaactgaatcgtgtttttaggggaggtttagaaggattgtgtatgctcattgttgatttttaggatgtaggtatgattgtatgaagaagaatctctctttttcgatatcttgacaattgttaattttctgaagttataaagcgtttttagcatt

SEQ ID NO: 4084 - DNA, 597 bp, Saccharum officinarum
  misc_feature (7)..(7): n is a, c, g, or t
ttccccnaattctaaacaaatatagtgtctattgaccttccgcaccccttcccgattcacccatccatccacgcgtccgaggactcaactggcgatctctataccgatcttggagccgcagcagcttccaccacccatggacgtgagcggagccggagccggcgggaaggcgatgaaaggcgcggtggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaagtgctcgagctcgccggcaacgcggccagggacaacaagaagacgcgcatcatcccgcgccacgtgctcctggctatccgcaacgacgaagagctcggcaagctgctggccggcgtcaccatcgcccacggcggcgttctccccaacatacactctgtgctccttccccaaaaagtggtcctataaagcgggcaaagagccacaagtctcccaaaaaaggccccctagtcccccaa

SEQ ID NO: 4085 - DNA, 535 bp, Saccharum officinarum
ctcgcattcctccaatctccacagggctttctccccgggaagccactcgaagcgcagctgcggccagggactccaccggcgccggagcgggagggaaggtgaagaagggagcgggcgggcgcaaggccggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgccgatgaggttctggagctcgccgggaacgcagccagtgacaacaagaagacccccatcatcctccggcacatgctgcttgcgatccgcaacgacgaggagcttggaaagctgcttggccgatgtgaccatcgcccacgaggtcgtgctgcccaacatccactcaattctgctgtccaaaaaaacgccataaaaagctttcagaaaggagcccaagtctcccaataagcttccaaaccctccaaaaaagtata

SEQ ID NO: 4086 - DNA, 823 bp, Helianthus annuus
  misc_feature (46)..(46): n is a, c, g, or t
ggggttaaaaaacctctcactcctcccctattcccacgctctctcnctctctctctctctacaaacaaacactcgccggaaaaccaccattcaatccgttttctccacaaaagttgtcatggacgccggtggaaagttgaagaaaggtgctgccggaaggaaagcaggcggtccgaagaagaaaccggtcacacggtccgttaaagccggtttgcagtttcctgttggtaggatcggccggtacctcaaggttggacgctacgcgaaacgagtcggtactggtgctccggtttatctcgctgctgtgcttgaataccttgctgctgaggttttggaattggctggaaatgctgcaagagacaacaagaagaacagaatcaacccgaggcatgtgttgttggctgtgagaaatgatgatgagctcggaaagcttcttgcgggtgtgacaatcgctcatgggggtgttcttccaaacatcaatccggttcttttgccaaagaagtctcatgacaaagctgcaaaggaacccaaatctccggctaaaccaaccaaatctccgaagaaagcttagtttgtttatccacatttccatggtgatgtagggtatatcaaatttatggtgtttttagagatgatttagtaggattgtattgtgatgctatgttgatgttaggacctaggtgtgaagaaagaagaagaatctctctttttctaaatgaaaattgttaaatttctgaagttatgaaatcctttgaacatgtgtttgattgatgtgtactacattcattgtttgctcaattgtttatatatgtttcttgaaaaa

SEQ ID NO: 4087 - DNA, 845 bp, Nicotiana tabacum
  misc_feature (584)..(584): n is a, c, g, or t
ggccattacggccggggcatccacatctaccgctccgacaatcaactgataatatcaattataatacacaaatcacaactttggtctttttcatttccagatggatactgccggaaaagcgaaaaaaggtgccggcggtaggaaggttggcggccaatcgaagaagccggtttcccggtccgtcaaagccggtcttcaattcccggttggtagaattggtcgttacctgaagaagggtcgttacgctcaacgtgttggaagtggtgctccggtttatttggctgctgttcttgaatatttggccgctgaagtgttggaattggctgggaatgcagcgcgtgacaacaagaagaacagaattattccaaggcacgttctgttggctgtgaggaacgatgaagagctagggaagcttcttgccggtgtgaccattgctcatggcggtgtgcttcccaatatcaacccgattttgttgcctaagaaaactggtgctgaaaaggcaccgaaatctccagctaaggccacaaaatctcccaggaaagctgcagcttagaatttgtttttagtgactgttgaaactgaantttattttgtatgtaattctggtcctagatctagttcttttgttagtgagggaatttgagaagaatattgttgtaattctgaacttcgagtattagagttgtaggttatgagatagttgagtctttccttagttcgtacatttgtgaggctagtttggtagggtttttgtctgagacagctagcggcaatattgtgtcttactactttttcgtttcatagagccgactctatttaatggttaccgcttttgctttgcacct

SEQ ID NO: 4088 - DNA, 571 bp, Triphysaria pusilla
  misc_feature (44)..(44): n is a, c, g, or t
  misc_feature (263)..(263): n is a, c, g, or t
cgctttaccccaaatctgcaagctcaatttcatcttcatcctcntcactaacttctttcattcagagaaaaatggaaaccggtgggaaagtgaaaaagggagccgctggaaggaaggccggtggaccaaagaagaaatccgtcacccgctccgtcaaagccggtctccagtttcctgtcggcaggatcggtcggtttttgaagaagggtcgctatgctcagcgcgtgggttccggtgctccggtttacctggctgcggttctngagtaccttgctgctgaggttctggagttggctggaaatgcagcaagagacaacaagaaaagcaggattatcccgaggcacttgttgctggctgtgaggaacgatgaggagcttggtaaacttcttgctggagtgacaattgtgcatggtggagtaatcccgaacataaacccggttctgttgcccaagaaatccgacaaggtggctgagaaggcgcctaaatcgccatcgaaggctgctaagtctccgaaaaaggcttaaaatttttgtcaaattttgaaagggggtgagtgtcaattggtgtgcgg

SEQ ID NO: 4089 - DNA, 781 bp, Triphysaria pusilla
gcaattagtgacggagaagtttcacgctttaccccaaatctgcaagctcgatttcatcttcatcctcttcactaacttctttcattcagagaaaaatggaaaccggtgggaaagtgaaaaagggagccgctggaaggaaggccggtggaccaaagaagaaatccgtcacccgctccgtcaaagccggtctccagtttcctgtcggcaggatcgggcggtttctgaagaagggtcgctattctcagcgtgtgggttctggtgccccggtttacctggctgcggttcttgagtaccttgctgctgaggttctggagttagctggaaatgcagcaagagacaacaagaaaagcaggattatcccaaggcacttgctgctggctgtgaggaacgatgaggagcttggcaaacttcttgctggagtgacaattgctcatggtggtgtaattcccaacataaacccggttctgttgcccaagaaatccgacaaggtggctgagaaggcgcctaaatcgccatcgaaggctgctaagtctccgaaaaaggcttaaaattcatgttcaatattgaaagggggtgagtgtcgattggtgtgcggcgccgggcggcggaggtggctgtgagattttggtttttggagttgggctttaaaaactggaggaacagttttgtggctcgacaccggtcagtgatgtagaacatatgtactttatttttatagttctttttaaactaaatagtccaatttctacttattcagaacaaaaaattgttgattgttgta

SEQ ID NO: 4090 - DNA, 792 bp, Triphysaria pusilla
cattacggccgggggaacgcgatccaaacccaccacccaccatttcaactgagaattttacataattactcctcaatcagtcaattacacagcaaaacctaataatggatgctagtgcaaaggttaagaagggagctggtgggagaaagggcggtggcccaaagaagaaacctgtttcacgatccgtgaaagccggtctccagttcccggtcggcaggatcggccggtatctaaaaaagggacgatattctgagcgtgttggttccggcgcaccggtttatatggcggcggttctggagtatcttgctgctgaggtcctggagttggctggaaatgctgcaagagacaacaagaagaacaggattataccaaggcatgtgttgcttgcagtgaggaacgatgaggagcttggtaaacttcttgctggagttacaattgcacatggtggtgtaataccgaacataaaccctgttttgttgcccaagaaggcggctgagaaggcatctaaatcgccagccaaggcaactaagtctccaaagaaggcttaaactacgattctttgctaaatgtgtgattgaatgatctttgatgttttttagggattgtgtgatcttgttgggttattgtaggtgatgatgtctataactggagtaatttgtacttcttatcttttttattgctacttttgttgttaaatcccataattgaaatttaatggaaagatagattcttttcagatttctgaaactgaaaggcatggtttggttgcaatttatgtttctttgattggca

SEQ ID NO: 4091 - DNA, 738 bp, Hordeum vulgare
ggaaaaagcagtcaagcgacgaacaccctccgcaatccccactcgcccaccaaatccctccgctcccgcgtcccgacgagcaccagccaccagagatggacgcctcagccaccggagccggagcgaaggggaagaagggcgcggcggggcgcaaggccggcgggccgaggaagaagtcggtgacgcggtcggtcaaggccgggctccagttccccgtcggccgcatcgggcggtacctcaagaagggccggtacgcgaagcgcgtcggcacgggcgcccccgtctacctcgccgccgtcctcgagtacctggccgcggagcttctggagctcgccgggaacgccgccaaggacaacaagaagtcccgcatcgtgcccaggcacctgctcctcgccgtgaggaacgaccaggagctcgggaggctgctggccggcgtcaccatcgcgcacggcggcgtgctgcccaacatcaacccggtgctgctccccaagaggaccgcggagaaggagcccaaggagggcaagtcgcccaagaaggccgccaagtcccccaagaaggccgacaagaaggcctagagagatttgcttagccccttgtagtgctctgtggtaacattgcttgctgtttcgctaatggtgtcggtgtagatctgtgctgcgaatgttagaaatctctctgatttgagcgaattgttgacaaattcttctcttgttggtattgcaatgttagcataggtgc

SEQ ID NO: 4092 - DNA, 631 bp, Lactuca sativa
  misc_feature (18)..(18): n is a, c, g, or t
tggcggggatcatccganaatccgctaatttctcgctgtttattcatcgctaaaaggaaaatggaaggagcagcaaaggcaaagaagggtgccggaggaagaaaggccggtggtccaaggaagaaggcggtaacccgctccgtcaaggccggacttcagtttcccgtcggtagaattgggcgttttctgaagaaaggacgttatgctcagcgtgttggaagcggtgctccggtttacctcgccgctgttcttgaataccttgctgctgaagtgctagagttggctggaaacgcggctagggacaacaagaagaccagaatcattccaaggcatcttctgttggccattagaaatgacgaagaacttgggaaattattgggcggagttacgattgctcatggtggcgttcttcctaatatcaatcctattctattgccaaagaagactgctgccaaggagccttcaactccatctaaagctgctaagtctccaaagaaagctaagaaggatgagtagattatgacgtcagaatttgtagttcttttttggttaagattatattataaatttgtaagctgttgttgatcaaggtttaatgaatgaaacgacttgtttcttataattgttgcaa

SEQ ID NO: 4093 - DNA, 936 bp, Zea mays
acgcaacgctccagattgcagtaccgccctccacacaacgaaaacacaaacgcacacaagcacacgacgcaagggtgacgactgacgagagggggagagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgactcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgc

SEQ ID NO: 4094 - DNA, 730 bp, Triphysaria pusilla
tcgaggctttacggattctctccttcttcacctcccagagttcaccagctaatgcatcgccaactttgggaacaccatcgccatttgcaacctttgcttttcatctgacatacaattttcctcctaaccaatcatctttgcaccaaaaccaaaaatggaagctactccaaaggcaaagaagggagctgctggaagaaaggccggtggaccaaagaagaaatccgtcacccgctccgtcaaagccggtctccagtttcctgtaggcaggatcggtcggtttctgaagaagggtcgctatgctcagcgcgtgggttctggtgccccggtttacctggctgcggttctagaataccttgctgctgaggtattggagttggctggaaatgcagcaagagacaacaagaaaagcaggattatcccaaggcacttgctgctggccgtgaggaacgatgaggagcttggtaaacttctggctggagtgacaattgctcatggtggtgttataccgaatataaacccggttctgttgcctaagaaatccgacaaggtggctgagaaagcacccaaatcgccatcgaaggctgccaagtctccgagaaaggcttagactgaaatttgttctttctgaatgtgggattgggattgggataaaataacctttattggtttgtagggattgtgttatcttgtggttatgtaggtgatgatgtttataactgcagtaattgta

SEQ ID NO: 4095 - DNA, 573 bp, Triphysaria pusilla
agaaatggaaaccggagggaaagcgaagaagggagctgctggaaggaaggctggcggtccgaagaagaaatccgtctcccgctcagtgaaagccggtctccagtttccggtcggcaggatcggacgttttctgaagaagggacgttatgctcagcgcgtcggttctggtgccccggtttacctggctgcggttctagaataccttgctgctgaggtattggagttggctggaaatgcagcaagagacaacaagaaaagcaggattatcccaaggcacttgctgctcgccgtgaggaacgatgaggagcttggtaaacttctggctggagtgacaattgctcatggtggcgttataccgaacataaacccggttctgttgcccaagaaatctgacaaggtggctgagaaggcacccaaatcaccatcgaaggctactaagtctccgagaaaggcttagactgagatttttctttctgaatgtgggactgggataaaataacctttattggtttgtagggattgtgttatcttgtggctatgtaggtgttgatgtttataactgcagtaattgta

SEQ ID NO: 4096 - DNA, 741 bp, Artemisia annua
cggggacaacaaatacaaaaacaacttcatcttcatccaaatctaaatccaaacacaaactttttatatatttctaaaaatggaaacaggtggaaagaaaaagggagcagcaggaaggaaagggccatctggcccaaggaagaagtcggtgacaaggtctgtgaaagctggccttcagtttcctgttgggaggattggaaggtatttgaaaaatgggaggtatgctaaacgtgtgggtactggtgctcctgtttatcttgctgctgtccttgagtacctcgctgctgaggttttggagctagctggaaatgccgcaagggacaacaagaagtcaaggatcataccgagacacgttttgttggccatcaggaatgacgatgagctaggaaagcttttatctggtgtgactattgctcacggtggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgacttttatcgtgttgtagggttatgtaggagaattgtatgctggtttgtttatgttaggacctaggtatggagaagaatctctcttctttgttatcagaatttttagtttccgaatgtatgaaaatgtgtaagcttcaatttgaatgggtactacatttgattgc

SEQ ID NO: 4097 - DNA, 610 bp, Artemisia annua
ggaccacaatcacacacactcaaaacacattaaacacacacacacattttataaaaatcaaatggagggaaccggtaaaattaagaagggagcagcaggaaggaaagctggtgggccccgaaagaagtcagtaactcgatccgtgaaagccgggcttcagtttccagttgggaggattggaaggtatttgaagaaaggtcgttacgctaagcgtgttggtactggtgctcccgtttacctcgctgccgtcctcgagtatctcgcagctgaagtgttggaattggctggaaatgcagcaagggacaacaagaagaccagaataatcccgagacatgtgttgttggcgataaggaatgacgaggagctcggaaagttgttgtctggagttacgattgctcatggtggtgttttgccgaatatcaacccggtcttgttgcctaagaagactgctgctaaagaatcaacaccaaagtccccttccaaagttggaaagtctcctaagaaaaccgctgcttagattagtttgatgttgttgatttgatagtgaagttattgtagtttgtatgattagatgtaatcatttctactgaatgaaaactacttgtttctg

SEQ ID NO: 4098 - DNA, 647 bp, Artemisia annua
gattcacacacactcaaaacacacacatattcatcaactactcatttgtttaaaaaatggagggaaccggtaaaatcaagaagggagtagcaggaaggaaggctggtgggccccgtaagaagtcggttaccagatctgttaaagccgggcttcagtttccagttggaagaattggaaggtatttgaagaaaggtcgttatgctaagcgtgttggtactggtgctcccgtttatctcgctgccgtcctcgagtatctcgcagctgaagtgttggagttggctggaaatgcagcaagggacaacaagaagaccagaataatcccaagacatgtgttgttggcgataaggaacgacgaggagcttggaaagttgttgtctggtgttacgattgctcacgggggtgttttgccgaatatcaacccggtcttgttgcctaagaagactgctgctaaagaatcaacaccaaagtctccatccaaagttggaaagtcgccaaagaaagctgctgcttagattagtttgattgtgatttggggtgttttcttttggttggtttcgtagtagttaagttttagtgttgttaatttgattagatgtaatcgtttctactgaatgaaaactacttgtttctgtttaaatgtcgagcgt

SEQ ID NO: 4099 - DNA, 751 bp, Artemisia annua
aaaaacaaatacaaaaacaacttcatcttcatccaaatccaaacaatcttttacatttctaaaaatggaaacaggtggaaagaaaaagggagcagcaggaaggaaagggccagcagggccaaggaagaagtcggtgacaaggtctgtgaaagctggccttcagtttcctgttgggagaattggaaggtatttgaaaaatgggaggtatgcgaaacgtgtgggtactggtgctcctgtttatcttgctgctgtccttgagtaccttgctgctgaggttttggagctagctggaaatgctgctagggacaacaagaagtcaaggatcattccaagacatgttttgttggctataaggaatgacgatgagctaggaaagttgttatctggtgtgactattgctcacggtggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgactgttatcgtgttgtagggttatgtaggagaattgtatgctggtttgtttatgttaggacctaggtggctaggtatgaagaagaatctctcttcttcgttatcagaatttttagtttccgaatgtatgaaaatgtgtaagcttcaatttgaatgggtactacatttgattgcaaaagatggtgatgttt

SEQ ID NO: 4100 - DNA, 735 bp, Artemisia annua
caacaaatacaaaaacaacttcatcttcatccaaatctaaatccaaacaaacttttttaacatttctaaaaatggaaactggtggaaagaaaaagggagcagcaggaaggaaagggccagctgggccaaggaagaagtcggtgacaaggtctgtgaaagctggccttcagtttcctgttgggagaattggaaggtatttgaaaaatgggaggtatgctaaacgtgttggtactggtgctcctgtttatcttgctgctgtccttgagtaccttgctgctgaggttttggagctagctggaaatgctgctagggacaacaagaagtcaaggatcataccgagacatgttctgttggctataaggaatgacgatgagcttggaaagttgttatctggtgtgactattgctcacggcggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgactattattgtgttgtagggttatgtaggagaattgtatgctggtttgtttattttaggatctaggtatgaagaagaatctctcttctttgggttatcagaatttttagtttccggatgtatgaaaatgtgtaagcttcaatttgaatgggtactacatttgattgc

SEQ ID NO: 4101 - DNA, 727 bp, Artemisia annua
caacttcatcttcatccaaatctaaatccaaacacaaacttttatatttctttctaaaaatggaaacaggtggaaagaaaaagggagcagcaggaaggaaagggccagcagggccaaggaagaagtcggtgacaaggtctgtgaaagctggccttcagtttcctgttgggaggattggaaggtatttgaaaaatgggaggtatgcgaaacgtgtgggtactggtgctcctgtttatcttgctgctgtccttgagtaccttgctgctgaggttttggagctagctggaaatgctgcaagggacaacaagaagtcaaggatcataccgagacatgttctgttggctataaggaatgacgatgagcttggaaagttgttatctggtgtgactattgctcatggtggtgttcttccaaacatcaacccggttctgttgcctaagaagagtgccacaaaggaatctacccccaagtctccagcgaaagcggccaagtccccaaagaaagctgctgcttagttattgaagaaatgttaccctttgtgatgtaggttgacttgacttttatcgtgttgtagggttatgtaggagaattgtatgctggtttgtttattttaggatctaggtatgaagaagaatctctcttctttgggttatcagaatttttagtttccgaatgtatgaaaatgtgtaagcttcaatttgaatgggtactacatttgattgcaaaa

SEQ ID NO: 4102 - DNA, 651 bp, Artemisia annua
tactccaacgggctctcgcgcaaatttaggttctcttagaagaccaaaagtattgttggcgggtcaagtgataccattttcttccagcctgaacacgaaaaacacacaaacacattcatcacttacccatttataaaaaacaatggagggaaccggtaaaatcaagaagggagcagcaggaaggaaagctggtgggccccgaaagaagtcggttactcgatctgttaaagcggggcttcagtttccagttggaagaattggaaggtatttgaagaaaggtcgttatgctaagcgtgttggtactggtgctcctgtttatctcgctgccgtcctcgagtatctcgcagctgaagtgttggagttggctggaaatgcagcaagggacaataagaagaccagaataatcccaagacatgtgttgttggcgataaggaatgacgaggagcttggaaagttgttgtctggagttacgattgctcacggtggtgttttgccgaatatcaacccggtcttgttgcctaagaagactgctgctaaagaatcaacaccaaagtctccatccaaagttggaaagtctcctaagaaaactgctgcttagattagtttgatgtggttgatttgatagtgaagttagtgtagtttgtatgatta

SEQ ID NO: 4103 - DNA, 752 bp, Artemisia annua
ccggggacaacaaaaacaaatacaaaaacaacttcatcttcatccaaatccaaacaatcttttacatttctaaaaatggaaacaggtggaaagaaaaagggagcagcaggaaggaaagggccagcagggccaaggaagaagtcggtgacaaggtctgtgaaagctggccttcagtttcctgttgggagaattggaaggtatttgaaaaatgggaggtatgcgaaacgtgtgggtactggtgctcctgtttatcttgctgctgtccttgagtaccttgctgctgaggttttggagctagctggaaatgctgcaagggacaacaagaagtcaaggatcataccgagacatgttctgttggctataaggaatgacgatgagcttggaaagttgttatctggtgtgactattgctcatggtggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgacttttatcgtgttgtagggttatgtaggagaattgtatgctggtttgtttatgttaggacctaggtggctaggtatgaagaagaatctctcttcttcgttatcagaattttttagtttccgaatgtatgaaaatgtgtaagcttcaatttgaatgggtactacatttgattgcaaaaaa

SEQ ID NO: 4104 - DNA, 717 bp, Artemisia annua
aacaacttcaacttcatcttcatccaaatccaaacaatcttttacatttctaaaaatggaaactggtggaaagaaaaagggagcagcaggaaggaaagggccatctgggccaaggaagaagtcggtgacaaggtctgtgaaagctggccttcagtttcctgttgggaggattggaaggtatttgaaaaatgggaggtatgcgaaacgtgtgggtactggtgctcctgtttatcttgctgctgtccttgagtaccttgctgctgaggttttggagctagctggaaatgccgcaagggacaacaagaagtcaaggatcataccgagacacgttttgttggccatcaggaatgacgatgagctaggaaagttgttatctggtgtgactattgctcatggtggtgttcttccaaacatcaacccggttctattgcctaagaagagtgccactaaggaatctacccccaagtctccagcgaaagcggccaagtcccctaagaaagctgctgcttagttattgaagaaatgtaaccctttgtgatgtaggttgacttgacttttatcgtgttgtagggttatgtaggagaattttatgctggtttgtttatgttaggacctaggtatgaagaagaatctctcttcttcgttatcaggatttttagtttccgaatgtatgaaaatgtgtaagcttcaatttgaatgggtactacatttgattgc

SEQ ID NO: 4105 - DNA, 910 bp, Oryza sativa
ctcctcccccaaaaggaaaaaaaataggaagaaaaaaaaatcgaacaaaacagaagagggagaaagcttggggaggaggagctcgtcgcgatcgatggaggtgggagcgaaggtgcccaagaaggccggcgccggcggccgccgcggcggcggcgggccgaagaagaagccggtgtcccgctccgtcaaggccgggctccagttccccgtcggccgtatcggccgctacctcaagcaaggccgctactcccagcgcatcggcaccggcgcccccgtctacctcgccgccgtcctcgagtacctcgccgccgaggtgctcgagcttgcggggaacgcggcgcgggacaacaagaagaaccggatcatcccgcggcacgtgctgctggcgatccgcaacgacgaggagctcgggaagctgctggccggcgtcaccatcgcgcacggcggggtgctgcccaacatcaacccggtgctgctccccaagaagaccggctccgccgcggccaaggaggccaaggagggtaagacccccaagtcgcccaagaaggccaccaccaagtcgccaaagaaggcggcggccgcttagggcacacgcaatgccggcttggtggtggtgtcccccgcttccctctccctcttgtctgaactgaaacgctcctatctgttgtcaatcgtcatcatcatcgtcttcgttgcatgctatatcatttgtcgtgaatcggttcggttgtttgtacgtaatttgtggtgttttctgaatagatggacagtcaagccaatcagtttgtacccgtgtaggttaacaccggtgtagggtcgaggagtgtggtctgggcagagggatgggggaactgtgaattgttagatgctgcctgtaataatattgttaagatttggataatttcgaaca

SEQ ID NO: 4106 - DNA, 611 bp, Gerbera hybrid cultivar
ttcggtaccggaaattttaccagtctagccgtcggagatcaaatggacgccggaacaaaggtgaagaagggtgccgccggcaggaaggctggtggtcccaagaagaaaccggtttcccggtccgttaaggccggtcttcagttccccgtcggcaggatcggccggtatctgaaaaaaggccggtacgcgcagcgcgtcggtaccggagctccggtataccttgcagccgttctcgagtaccttgctgctgaggtattggaattagctggaaacgctgcaagagacaacaagaagaacaggatcatacccagacatgttcttttggcagttaggaatgatgaagaacttggaaagcttcttgctggtgtgacaattgcccatggaggtgttattcccaatattaatccagttcttttgccaaagaaggctcatgataaagcaacaaaagagccagcaaaatctccatcaaaagcaacaaaatctcccaagaaaggttagccattgaagaacaggttctatgtggttctttctcaccctttcttgtatgtggtgacatcttaatttgatggtgattttagggtttaggatcattgttacctgatattttgaat

SEQ ID NO: 4107 - DNA, 795 bp, Camellia sinensis
atccgaaacgctccttttggacaatttctaggtcggagtggattgttaatattctgttttttcagggtcagaattgtctttttcgacctcggaatttacacagatggatgccgctaaagtaaagaagggtgccgcagggaggaagggcggcggtccgaagaagaagccggtttcccggtccgtcaaggccggtctgcagttcccggtcggaaggatcggccggtacttgaagaagggacgctactctcagcgggtcggaaccggcgctccggtctacctcgccgccgtgctcgaatacctagctgctgaagtacttgaattggcgggaaatgcagcccgtgataacaagaagaacagaatcatccctagacacgttcttctggcagtgaggaatgacgaagagctcggaaaattgctggctggtgtgacaattgcacatggtggtgttcttccaaacatcaaccctgttctcttgccaaagaagtctgacaaggccaccaaggaacccaaatctccatccagggccaccaagtcccccaagaaagctgcttgagctttatcctctcacccaaattcatttccctctgtatgtatatttgggcttagaacaacttgtttggctgatttttaggggaaattagtgaaaaagtgtgtcatggtttttactctgtttatgttaggatttcctattgattccatggatgaaatgaaaccactcgtttcttttgtttggttatttggtttgcccgtcaatcatagttcattttcattttcaatggtcacagctttcttgat

SEQ ID NO: 4108 - DNA, 826 bp, Cynara scolymus
cgggggctctctcttccttcagacaaagaatctccggaaaagctaataatttatccatttattccatagtctctttacaagtcgtcggccgttgaaatggagaccggtgggaagttgaaaaagggtgctgccggaaggaaggccggtggtcccaagaagaagccagttacccggtccgttaaggccggtctacagtttcccgtcggtaggatcggtcggtacctgaagaaaggtcggtattccaagcgtgtgggtaccggtgcaccggtttacctcgccgccgttctcgagtaccttgctgctgaggtgttggagttggctggaaatgctgctagagacaacaagaagaacagaatcatacccagacatgttttgttggctgtaagaaatgatgacgagcttggaaagcttcttgctggtgtgacaattgctcatggtggtgttcttccaaacatcaatccagttcttttgccaaagaagtctcatgataaagctacaaaggaacctgcaaaatctccttccaaatcaaccaagtccccaaagaaagcttagttgttgaagaacctctctatcatcctctcattgtatctatctattcacctttttttggtgatgtagggataatttaaatgttatggtgtttttaggggagatttagaagtcatgtactctgatctgtttatgtttaggaccttaggtgtgaagaagaagaagaatctctctttttctaaatggaagttgttatttttatgaatctttttagatgggtgttacatttgtataagaaaattgttaaagattcttggatattggtgacactgagaaa

SEQ ID NO: 4109 - DNA, 825 bp, Raphanus sativus
  misc_feature (63)..(63): n is a, c, g, or t
ggccttcgaaaaaagtgaaaaaacaatctaacgccaaagcttatctccactgttgcagattcnggcagatcagatcacaaacacatagtctcggagtaagcaggcatggattctggagccaaagtgaagaaaggagcgggtgcgggtggacgaagaggtggcggtccgaagaagaaacctgtttcccgctctgttaaagccggtttacagtttcctgtcggtaggatcggtcggtatctaaagaaaggtcgctactcgaagcgtgttggaaccggagctccggtgtatctcgccgcagtgctagagtatcttgccgctgaggttcttgagcttgctggtaacgctgcaagagataacaagaagaatcgtatcataccacgccatgttctgttagctgtgaggaacgacgacgagttaggaaagctgctcaaaggggtaacaattgcacacggaggagttttacctaacataaacccagttctcctcccaaagaagtctgagaaagcagcttcgactacaaagggaaccaagtcaccatcaaaggctaccaaatcccctaagaaggcatagttctcatcagcatcccgtctccttctttctcttactctctgtataacttgtaatctctctccatctctctgttgttgtgtgaagacagaacacctcttgccttttttcatcagttgtaaacaatgtgtaacgttaaaacaagtctggttagtcgatgtaattgatacaatgttcagtttgtaataagagatggtgcgttgtatatatacgatccatccttatatcagaagaaacgaattgcaaaaagaattgata

SEQ ID NO: 4110 - DNA, 821 bp, Carthamus tinctorius
tctttacgttcctctctctctctctcttctcttaccttcattcagacaaagaaagaatcccccaaaaagctaaccattttatccattttccattccttaagcttctctacaagtcgtcggccgttgaaatggagaccggtgggaagttgaaaaagggcgctgccggaaggaaggccggtggtcccaagaagaagccggttacccgctccgttaaggccggtttgcagtttccggtcggcaggatcggccgctacctgaagaaaggccggtattcgaagcgtgtgggcaccggtgctccggtctacctcgccgccgttctcgagtaccttgctgctgaggtgttggagttggctggaaatgctgctagagacaacaagaagaacaggatcataccaaggcatgttttgttggctgtgaggaatgatgatgagcttggaaagcttctttctggtgtgacaattgctcatggtggtgttctaccaaacatcaacccagttcttttgccaaagaagtcacatgaaaaggctacaaaggaacctgcaaaatctccatccaaatcaaccaagtccccaaagaaagcttagttgttgaacaacctcttcattctccttgtatctatctgttcacctttttttggtgatgtagggacaaattaaatgttatggtgtttttagggagatttagatgtgctgtcttttgatatgattatgtttaggagctaggttggtttaaagagaagaatctctctttttctgaatcttttttagatggtgtacatttgtataggaaaaatttgtaagatttgctcaatatgttgatgt

SEQ ID NO: 4111 - DNA, 666 bp, Helianthus annuus
  misc_feature (543)..(543): n is a, c, g, or t
  misc_feature (582)..(582): n is a, c, g, or t
  misc_feature (621)..(621): n is a, c, g, or t
  misc_feature (642)..(642): n is a, c, g, or t
aaaaataacttacaaactccagcagtttctcctttccatctgtgtattttcatcttccagagtttcaatggaggctaaaaagggtgccggtggtagaaaggctggtggtcctaagaagaaaccggtttcccggtctgtgaaagccggtctccagttccctgttggcaggctcggtcgttacctcaaaaaaggccgctatgcacagcgtgtaggcaccggtgctccggtctaccttgccgccgttctcgagtaccttgctgctgaagttttggagttggcgggaaatgcagcaagggacaacaagaagaacaggattattccgagacatgttttgttggcggtgaggaatgatgaagagcttggaaagcttctagcgggtgtgacgattgctcatggtggtgttcttcccaatattaacccggttcttttgccaaagaaggctgctgcaaaggaggctacaaaatctccagcaaaagtgactaaatcaccaaagaaagcctagtgtttgcgtgttttaggattttgtgtaattaggaaacacantttgatcgatgattttaggggaatttttattgttggctntaggtttgttaagaacatcttgtttgaaatgaaatgacngccaagcacatttatctcttncgaagaaaaatcacactctatgcg

SEQ ID NO: 4112 - DNA, 866 bp, Camellia sinensis
tatcggccattacggccggggacgccaatccgaaacgctccttttggacaatttctaggtcggagtggattgttaatattctgttttttcagggtcagaattgtctttttcgacctcggaatttacacagatggatgccgctaaagtaaagaagggtgccgcagggaggaagggcggcggtccgaagaagaagccggtttcccggtccgtcaaggccggtctgcagttcccggtcggaaggatcggccggtacttgaagaagggacgctactctcagcgggtcggaaccggcgctccggtctacctcgccgccgtgctcgaatacctagctgctgaagtacttgaattggcgggaaatgcagcccgtgataacaagaagaacagaatcatccctagacacgttcttctggcagtgaggaatgacgaagagctcggaaaattgctggctggtgtgacaattgcacatggtggtgttcttccaaacatcaaccctgttctcttgccaaagaagtctgacaaggccaccaaggaacccaaatctccatccagggccaccaagtcccccaagaaagctgcttgagctttatcctctcacccaaattcatttccctctgtatgtatatttgggcttagaacaacttgtttggctgatttttaggggaaattagtgaaaaagtgtgtcatggtttttactctgtttatgttaggatttcctattgattccatggatgaaatgaaaccactcgtttcttttgtttggttaaaaaaaaaaagaaaacaataaaacatgtcggccgcctcggtcacagctttcttgatgggttttgtgggttttgtttggattgttacacctaacaatttaagaa

SEQ ID NO: 4113 - DNA, 901 bp, Nicotiana tabacum
ggccattacggccggggaccatcacaaacacagcacttctcccaatttatttctcaaacatatctcttggggttgattttcttcacagctttagagttagaaatggagaagaagggtgctggaggaagaaaggggggtggtccaaagaagaaggccgtttcccgttccgttaaggcaggtttgcagtttccagtgggtagaattgggcgttacctgaaaaagggtcgatatgctcagcgtgttggaagtggtgctcctgtttatctttctgctgttcttgagtaccttgctgccgaggttttagaattggctggaaatgcagcgagagacaacaagaagaccaggataataccgaggcatgttttgttagctgtaaggaacgacgaagagcttggaaaacttctagctggtgtaaccattgcccatggaggcgtgcttcctaacatcaatccggttcttctgcctaagaaatctgacaaagtcggaaaagaacctgctaaatcgccatcgaaggctactaagtcacccaagaaggcctaatttgtgatgactcaaggctcgtgtgatggcactatgttacttgaacccatgttgtaaggacattgtattgtagctgtgcaattaggagctttaatggtggtcgtgaaataatctgtacttgtatgtagttttggtatctatggtttgcatgtaggcaaagtctgttgaaaactaggaatgtttgatttctgttatgatgtaaaactaatgaaattggttctagttgtcaaaatcattaatggtggttacattgtgtaagttacatatgagaaaagctttgcttgtcttatgagcttttaatttgaatcaaattagcaaatgtttctggcattgtataaagcaagatgtcaaattattgcaa

SEQ ID NO: 4114 - DNA, 867 bp, Nicotiana tabacum
ggccattacggccggggacagtaacactcaatacaatctcaaatcagttcttccaaagtcacaacacacaacaattctccctaattaattcgagttttttaaaggttagaaatggagaagaagggtgctggaggaagaaaggggggtggtccaaagaagaaagccgtttcccgttccgttaaggccggtttgcagtttccagttggtagaattgggcgttacttgaaaaaaggtcgatatgctcagcgtgttggaagtggtgctcctgtttatctatctgctgttcttgagtaccttgctgccgaggttttagagttggctggaaatgcagcgagagacaacaagaagaccaggataataccgaggcatgttttgttagctgtaaggaacgatgaagagctcggaaaactcctagctggtgtaaccattgctcatggaggtgttcttcccaacatcaatccagttcttctgcctaagaaatctgacaaagtcggaaaagaacctactaaatcgccaacgaaggcaaccaagtcacccaagaaggcctaatttgtgacgatgcaggctcgtgtgatggcacgatgttctacttgaatccatgttgtaaggacattgtattgtagctgtgcaattaggagctttaatggtggtcgtgaaataatctgtacttgtatgtagttttggtatctatggtttgcatgtaggcaatgtttgttgaaaactaggaatgtttgatttctgttatgatgtaaaacaaatgaaattggttctggtttctcaagctctttagtggtggttatatatgagaaaacctatgcttgtcttctgagcttttaatttgaattaaattggcaaatgtttgtggca

SEQ ID NO: 4115 - DNA, 2551 bp, Zea mays
gccgtcatcccagtccacgcccacgcccacgcccacgcccacgccgacccacccgcatccctccctcgcctccaccgcagcgatgtcgggctgggacgagggcgccgtgttctacagcgaccaggcgcagttcccccgcggcggccccggcggcgacccagccgccgacctcacccgccactccgcccttcgcaagttcaaggagttcctccgcggtttcaccggccccaccggcgacttcccttaccgcgagagcctagtacacaaccgcgaccatgtcaccgtcgccactgaggacctcgacgccttcgatgccgagctctctgacaagatccgcaagtcgcctgccgattatcttcctttgttcgagacggctgcgtccgaggttctcgcaagcctccgttcgaaagtcgccggcgagaccggggagatggaggagccagtcccaggagatgtccagatctttctctcctccaaggagaactgcctgtccatgagatctgtcggggcggattacatgtcgaagctggttaagattgcgggaatcacaattgctgcatcgagagtaaaagccaaagccactcatgtaactcttatatgcaagaattgccggagtgtgaggacagtgccttgcaggccaggcctcggcggggctatcgttccacgttcgtgtgaccatgttcctcagcctggagaagagccatgccccctggatccttggattgctgtcccggataagagcaagtatgtggatctccagaccctcaaattgcaagaaaatcctgaggatgttccaacaggtgagcttccaaggaatatgctgctttctgtagatagacacctagttcagactatcgttccagggaccagattaactgtcgttggcatctacagcgtgtaccaagcttccacaacccagaagggtgcagttggtgttaaacagccttacattagagttgtgggtttggagcaatctcgagacaataactcaaatggtccctcaaattttactctcgatgaggaaatggaattcaaagaatttgcacagaggccagatgcatatgccaagctctgctcaatgattggtccttcaatttatggtcattctgatgtcaagaaagctattgcatgcttgttatttggggggtctaagaagaggctacctgatggtgtacgtttgagaggggacattcatgtcttgcttctgggtgacccatccacagcaaaatcacagttcctcaaatttgtagagaagactgcccctattgcagtctatacatctggcaaaggatcatctgcagctggtcttacagcatctgtaactcgggatagtagctcgcgcgagttttatttggaaggaggagccatggttttggctgatggtggagtagtttgtattgatgaatttgacaagatgcgacctgaagacagagtggcgattcatgaggccatggagcagcagacaatatctattgccaaagctggcattacaacagtactcaattcaaggacttcagttcttgcagctgccaatccaattgcagggcgctatgacgatcttaagactgcacaagataatattgatctacagaccaccattctttctagatttgatctaatctttattgtcaaagatatcagaatgtatgaccaagataagcgaatagcaagccacattatcaaggtgcatgccagtggtgcagcagcgtcatcggcaaacacagagggaagtgaaggagagaattggcttaaaaggtacattcagtactgccgtgcaacatgcaaaccacggctttcagaaaaagcagctgagatgctgcagaacaaatacatcgagattagacagaaaatgaggcagcaagctcacgagacagggagggctgcagcaatacccatcactgtgaggcagcttgaagccatcatacgtttgagtgaatctcttgcaaagatgagattgacaagcgtggctacaccagagcatgtcgaagaggcattcagactgttcaatgtctccaccgtcgacgctgcgagatccggaatcaacgagcatttgaacctgtcgccggagatcgcaaatgaaatcaagcaagcggaagcacagataaagcgaagaatgggcattggaagccacatatctgagcgacggctgattgatggactaaacaggatgggaatgaacgaatccattgtgagaagagctcttctgattatgcatcaaagagacgaggtggagtacaagagagagcgccatgtgatcgtccggaaggcttgatgtggagagtccagtcagactcattcatggcatacaacgaacgttcatggcgtcctctcctcagacgcgtccataccttcactgagactgcacatctgtccgtcctgaggggacgagacacgccttagttggtctctgacatgactgactgttgtaatcagcaaacggcttgagcatgtaggctctgtttttgaagtgaccaaaggttctgattgaacctgtagtgtgccgtgtaactggtcaatcaattctgaaatgcaaaatttgtgttcttcgtca

SEQ ID NO: 4116 - DNA, 2778 bp, Zea mays
cgtcccatcgccgtcgtcccagtccacgtccacgtccacgccgacgcacccgcatccctctctcgcctgcgccgcagctatgtcgggctgggacgagggcgccgtgttctacagcgaccaggcgcaattcccccgcggcggccctggcggcgacccagccgccgacctcacccgccactccgccctccgcaaattcaaggagtttctccgcggcttcactggccccaccggcgacttcccctaccgtgagagcctagtacacaaccgcgaccatgtcaccgtcgctattgaggacctcgacgccttcgatgccgagctctctgacaagatccgcaagtcgccggccgattatcttcctttgtttgagacggctgcggccgaggttctcgcaagtctccgttcgaaagtcgccggcgagaccggagagatggaggagcccgtcactggagatgtccagattttcctctcctccaaggagaactgcctgtccatgagatctgttggggcggattacatgtcgaagctggttaagatagcgggaatagcaattgctgcatcgagagtaaaagctaaggccacccatgtaactcttatctgcaagaattgccggagtgtgaggacagtgccttgcagaccaggcctcggcggggctattgttccacgttcgtgtgaccatgttcctcagcctggagaggagccatgccctctggacccttggattgccgttccagataagagcaagtatgtggatctccagaccctcaaattgcaagagaatcctgaggatgttccaactggtgagcttccaaggaatgtgctgctttctgtagataggcacctagttcagactattgttccagggactagattaactgttgttggcatctacagcgtgtaccaagcatccacaacccagaagggtgctgttggtgttaagcagccttacattagagttgtgggtttagagcaatctcgagacaataactcaaatggcccctcaaacttcactcttgatgaggaaatggaattcaaagaatttgcacagaggccagatgcatatgccaagctatgctcaatgattggtccttcaatttatggtcattctgatgtcaagaaagctattgcatgcttgttatttgggggatctaagaaggcacagattcttatcaagcctctgatatgtaggctacctgatggtgtacgtttaagaggggacattcatgtcttgcttctcggtgatccctccacagcaaaatcacaggcaagtactttcctaaaatttgtagagaagactgcacctattgcagtatatacatctggcaaaggatcgtctgcagctggtcttacagcatctgtaactcgtgatagtagctcgcgtgagttttatttggaaggaggagccatggttttggctgatggtggagtagtttgtatcgatgaatttgacaagatgagacctgaagacagagttgcaattcatgaggccatggagcagcagacaatatctattgccaaagctggcattacaacagtactcaattcaaggacttcagttcttgcagctgccaatccaattgcaggacgctatgatgatcttaagaccgcacaagataatattgatctgcagacgaccattctttctagatttgatctaatctttatcgtcaaggatatcagaatgtatgatcaagataagagaatagcaagccacattatcaaggtgcatgccagtggtgctgcagcttcatccacaaacacagaggggagtgaaggagagaattggctgaaaaggtacattgagtactgccgcgccacatgcaaaccacggctttcagaaaaagcagctgagatgctgcagaacaaatatatcgagattagacagaaaatgaggcagcaagctcacgagacagggagggccgcagctatacccatcacggtgaggcagctagaagccatcatccgtttgagtgaatctcttgcaaagatgagattgacaagtgtggctacaccggagcatgtcgaagaggcattcagactgttcaatgtctccaccgttgatgctgcaagatccggaatcaatgagcatttgaacctgtcaccggagatcgcaaatgaaatcaagcaagcggaggcacaaataaagagaagaatgggcatcggcagccacatatccgagcgacggctgattgatgagctaaaccggatggggatgaatgaatccatcgtcagaagagcccttctgatcatgcatcaaagggacgaggtggagtacaagagagagcgccacgtgatcgtccgaaaggcttgaggtggagaggccagtcagattcacggcatacaacgtacactggaggcggtccttcctcttcggacgtgtgtataccttcactgaaactgcacctttgtctgtccagaggacgaggcatgccttagttgatctctgacatgactcttgtaatctgcacacgagtggatgcaaccttttgcttcgtgcaaatggagctttgtagctgtaccacagtagtctgttgctgcctgtgatcctaaaccatagtgttgtgagcatgaagacttcgtttttttggaagtaaccataggttctgaactgcattgtgctgtgtagctcgtcaatcaattctggaatgcgaactttgtttactgcatcaccaggagtaggacagacagtgtgtggagcttagttgtaataattataataatatatgctatgtgttggggaccttcggcatccgaaggtcctcaaaaacaggatttaacagt

SEQ ID NO: 4117 - DNA, 2669 bp, Oryza sativa
ctctattaccctcttcccgccacttctccggcgtcttcccccctttccccgccgcccgcgcacccacgcgtctctctccctctctctccgccgccgccgccgccgcagccagccagccatccagccatgtcgggttgggacgagggcgccgtcttctacagcgaccaggcgcagttcccgcgcggcggccccggcggcgacccctccgccgacctcacccgccactccgccctccgcaagttcaaggagttcctccgcggcttcaccggcccaaccggcgacttcccctaccgcgagagcctggtgcacaaccgcgaccatgtcaccgtcgccatcgaggacctcgacgccttcgacgccgagctgtccgacaagatccggaagtctcccgctgattacctaccgctgtttgagacggctgcgtccgaggtcctcgcgagccttcggtccaaggtcgctggagagaccggcgagatggaggagcccgccaccggcgacgtgcagatcttcttgtcctcaaaggagaactgcctgtccatgaggtctattggggcggattacatgtccaagctggtgaagattgccgggatcacaatcgccgcgtcgagggtgaaagctaaggccactcatgtcacgctgctctgcaagaactgcagaagtgtgaaaacggtgccgtgtaggcctggccttggtggggctattgtcccacgatcgtgcgaccatgttcctcagcctggagaagagccttgccccttggacccctggattgcagttccagataagagcaagtatgtggatctccagaccctcaaattgcaggaaaatcctgaggatgttccaactggtgagctcccgaggaatatgctgctgtccgtagacaggcatcttgttcagaccattgttcctggaactagattaactgtaattggtatctacagtgtctaccaagcatctgcaaaccaaaagggtgctgttggagtcaaacagccttacattagagttgtggggttggagcagtcccgagatgccaactcgaatggtccctcaaattttacacttgatgaggaaatggaattcaaagaatttgcacagaggccagatgcatatgtcaagatttgctcaatgattggcccttcaatttatggccattctgatgtcaagaaagctattgcatgcttgctgtttggtggctcaaagaagaggctaccggatggtgtccgtttgagaggggacattcatgtcttgctgctgggtgatccatcaacagcaaaatcacagttcctcaagtttgtggagaagacagcgccgattgctgtctatacatctgggaaaggttcatcagcagctggtctcacagcgtcagtaattcgggacggtagctctcgagagttttatttggaaggaggggccatggttttggctgatggtggagttgtttgtattgatgagtttgacaaaatgaggcctgaggaccgagttgcaattcacgaagcaatggaacagcagaccatctcgattgccaaagctggcattacaacagtactcaattcaaggacctcggtactagcagctgccaatccaattgcagggcgctacgatgatcttaagactgcacaagataacattgatctgcagacaaccatcctttctagatttgatctaatctttattgttaaagatgtcagaatgtatgatcaagacaagcgaattgcaagccacatcattaaggtgcatgccagtggtgctgctgcttcatccaagaatacagatgctagtgaaggagagaattggctaaaaaggtacattgagtattgccgtgttacttgtaaaccacgactctcagaaaaggcagcagagatgcttcagaacaaatatgtggagattagacagaaaatgagacaacaagctcatgaaacagggagggctgcagctatacccatcactgtgcggcagcttgaagccattatacgtttgagtgaatctcttgcaaagatgagattgacaagtgtggctacaccagagcatgttgaagaggcatttaggctgttcaatgtctccactgttgatgccgcaagatctggaatcaatgagcatttgaacctatcaccagatattgcaaatgagatcaagcaagctgaggcacaaataaagagaaggatgggaattggaagccacatatccgagcgacgcctgatcgatgaactaaataggatggggatgaatgaatccattgtgcgaagagcccttctgatcatgcaccaaagggatgaagtggagtacaagagagagcgccatgtcattgtccggaaggcttgaggtgaactgtggagtatttataaatcgaggacaacttctattcagactgtataaggctatgagttcactgaaactgtaatctctgggagaagacaaggacatgtttgagtttcggttgatcactgacatgaccattgtaatctgcaagagtagaagaaatgcactccgtccttgatgaaactgtagttaaactacagtattaaagatgtaactgtagtgaaaccatgtaaccagggttctgaaatggctaatgtattaaactacagtattaattcatggatataaatggctaatattctgcagtgcccagacaagaatttaaaggagcagaattcagctgagtaatcagggca

SEQ ID NO: 4118 - DNA, 2538 bp, Brachypodium distachyon
cgccgcagccgtagccatgtcaggttgggacgagggagccgtcttctacagcgaccaggcgcagttcccgcgcggcggcgacccgggcggcgcagaaatcacccgccactccgccctccgcaagttcaaggagttcctccgcggtttcaccggcccgaccggcgacttcccataccgtgagagcctcgtgcacaaccgcgaccatgtcaccgtcgctatcgaggacctcgacgcattcgatgccgagcttgctgacaagatccggaaggcgccagccgattacctgcccttgtttgagacggctgggtccgaggttctggccagtctccggtctaaggttgccggtgaaaccggggagatggaggagccagttaccggggatgtgcagatcttcttgtcctcgaaggagaactgcctttccatgagatctattggggcagattacatgtcaaaactggtgaagattgcgggcattgcgattgctgcatcgagggtgaaagccaaagccactcatgttacattgatatgcaagaactgcaggactgtgcggacggtgccgtgcaggccaggcctcggtggggctattgtcccccggtcgtgtgatcatctccctcagcctggagaagagccatgcccactggacccctggattgcagtccctgataagagcaagtatgtggatctacagactctcaaattgcaggaaaatcctgaggatgttccaactggtgagctccctaggaatgtgctgctttctgtagacagacaccttgttcagaccattgttccgggtacaaggttgactgtggttggcatctacagtgtcttccaagcatctggcactgccaaccataaaggtgctgttggagttaaacagccctacattagaattgtggggttggagcagtctcgagatgataactcaaatggcccctcaaatttcacactcgatgaggaaatggagttcaaagaatttgcgcagaggccagatgcatatgccaagatttgctcaatgattggcccttcaatttatggacattctgatgtcaagaaggctattgcatgcttgttgtttgggggatcaaagaagaggctaccggatggtgtccgtttgagaggagacattcatgccttgcttttgggtgatccatccacagcaaagtcccagtttctcaagtttgtagagaaaacagcaccaattgcagtttatacatcgggaaaaggttcatctgcagctggtcttacagcatctgtaactcgggatagtaactcgcgtgagttttatttggaaggaggggccatggtactggctgatggtggagtggtttgtattgatgaatttgacaaaatgagacctgaggacagagttgcaattcatgaagccatggagcagcagaccatatctattgccaaagctggcattacaacagtactcaattcgaggacctcagttcttgcagctgccaatccaatttcagggcggtatgatgaccttaagactgcacaagataatattgatctgcagacaacaattctttctcggtttgatttaatctttattgttaaagatgtcagaatgtatgagcaggataagcgaatagcaaaccacatcattaaggtgcacgctagtggtgcggcaactacatccaagaacatggagatggatgccaataccaatgaaggagagaattggttgaaaaggtacattgagtactgccgcaatacttgtagaccacggctctcagaaaaagcagcagagatgctccagaacaaatatgttgagatcagacagaaaatgagacaacaatctcatgagacagggagagctgcagctatacccatcactgtaaggcagcttgaagctattatacggttgagcgaatctcttgcgaagatgagattgacaagtgtggctacaccagagcacatcgaagaggcctttagactgttcaatgtctcgactgttgatgccgcaagatctggaatcaacgagcatctgaacttgtcaccggagattgcaaatgagatcaagcaagcggaagcacaaataaagagaagaatgggaattggaagtcacatatctgaacgacgactgctcgatgaactaaaccggatgggcatgaacgaatccatcgtgagaagagcccttgtgatcatgcaccagagggatgaggtcgagtacaagagggagcgccatgtgatcgtccgcaaggcttgagctgaagtgcaccgaacgggcggaattctcctctgttcagatcatctgatgtgtgtataaagttgctggaattgcaacctgggtggagcatagaagcgtaccggctggtcactgactgtggctgctgtaatctgcaagagaagagaagaaattccatgcatcattggaactgaatctgtaactgcacgcttgtactgtagtaaagctgtagccgtggcactagattatctcgtgccagcgcttgattgaaatgaaggtgtaccacacccacacatagttagtctactcatgaatgcaaaagatctgtgcccgaatttagc

SEQ ID NO: 4119 - DNA, 2508 bp, Triticum aestivum
tccccgccgcgtccgcacccacccgcccacgcacgcgcccgtgcccctctcctcgccgccgccgccgccatgtcgggctgggacgagggcgccgtcttctacagcgaccaggcgcagttcccgcagggcgaccccgccgccgccgacatcacccgccactccgccctccgcaagttcaaggagttcctccgcggcttcaccggccccaccggcgacttcccctaccgtgagagcctcgtgcacaaccgcgaccatgtcaccgtcgccatcgaggacctcgacgccttcgacgccgagctcgccgacaggatccgcaaggcgcccgcagactacctgccgctgttcgagacggccgggtccgaggttctcgccagccttaggtcgaaggtcgcgggcgagaccggggagatggaggagcctgtcaccggcgatgtgcagatcttcctgtcctccaaggagaattgcgtctccatgagatctattggggcggattacatgtccaaactggtgaagattgcgggtattgcaattgccgcatcgagggtgaaagccaaggcaactcacgtgacactgctctgcaagaactgcaggagtgtgaggactgtgccgtgcaggccaggcctaggtggggctattgtcccacgatcctgtgatcatgttcctcagcctggagaagagccttgccccctggacccctggattgcagtccctgacaagagcaagtatgtggatctacagactctcaaattgcaggaaaatcctgaggatgttccaactggtgagcttccaaggaatgtgctgctttctgtagacagacatcttgttcagacaattgttccagggactagattaactgtgattggcatctacagtgtattccaagcatccgggacgaacaaccagaaaggtgctgttggagttaaacagccctacattagaatcgtggggttagagcagtctcgagatgacaacacaaatggcccctcacatttcacacttgatgaggaaatggaattcaaagaatttgcacagaggccggatgcatatgccaagatttgttcaatgataggcccttcaatttacggtcatggtgatgtcaagaaagctattgcttgccttctgtttgggggatcaaaaaagaggctaccagatggcgtccgtttgagaggggacattcatgccttgcttttgggtgatccatccacagcaaaatcccagtttctgaagtttgtagagaagacagcaccaattgcagtctatacctctggaaaaggttcatctgcagctggtcttacagcatctgtaacccgggatagtaactcgcgtgagttttatttggaaggaggagccatggtattggctgatggtggagtagtttgtattgatgaatttgacaagatgaggcctgaagacagagttgcaattcatgaggccatggagcagcagaccatatctattgccaaggctggcattacaacagtactcaattcaaggacctcagttcttgcagctgccaatccaatttcggggcggtatgatgacctgaagaccgcacaagataacatagatctgcagacaacaatcctttctcggtttgatctaatcttcatagttaaagatgtcagaatgtatgagcaagataagcgaatagcaaaccacatcattaaggtgcatgccagtggtgctgcaactcaagcaaacaagaacacaaatgccaatgaaggagagaattggctgaaaagatacgtcgagtactgccgcaacacatgtagaccacgactctcagaaaaagcagcagagatgctgcagaataaatatgttgagatcagacagaaaatgagacaacaatcccatgagacaggaagagctgcagccatacccatcactgtgaggcagcttgaagctatcatacggttgagcgaatctcttgcaaagatgagactgactagtgtggctacgccagagcacattgaagaggcatttagactgttcaatgtctccactgtcgatgccgcaagatctggaatcaacgagcatctgaacttgtcaccggagattgcaaatgaaatcaagcaagccgaagcgcagataaagagaaggatgggaatcgggagccacatatctgagcgacggctgctcgacgaacttaatcggatggggatgaatgaatccattgtgagaagagcccttgtgatcatgcaccagagggacgaagtggagtacaagagggagcgccatgtgattgtccgcaaggcttgagctgaactgaaccgatggagctaccatggaaccctctggccatctgatgtgtgtgtataagtagtgctgacactgcagcccgtttcctgaggaaatttgttgggtcgttgaaattgagttgtagttgtactactttgagctgtagctgtagccctaaatcatattgtgtcgaactgaagatgtaccccagtaagttcattcatgaatgcaacattttggcgttctgcagctgagcagagtcaatgccta

SEQ ID NO: 4120 - DNA, 2253 bp, Brachypodium distachyon
ctccttctcgccgccgcagccgtagccatgtcaggttgggacgagggagccgtcttctacagcgaccaggcgcagttcccgcgcggcggcgacccgggcggcgcagaaatcacccgccactccgccctccgcaagttcaaggagttcctccgcggtttcaccggcccgaccggcgacttcccataccgtgagagcctcgtgcacaaccgcgaccatgtcaccgtcgctatcgaggacctcgacgcattcgatgccgagcttgctgacaagatccggaaggcgccagccgattacctgcccttgtttgagacggctgggtccgaggttctggccagtctccggtctaaggttgccggtgaaaccggggagatggaggagccagttaccggggatgtgcagatcttcttgtcctcgaaggagaactgcctttccatgagatctattggggcagattacatgtcaaaactggtgaagattgcgggcattgcgattgctgcatcgagggtgaaagccaaagccactcatgttacattgatatgcaagaactgcaggactgtgcggacggtgccgtgcaggccaggcctcggtggggctattgtcccccggtcgtgtgatcatctccctcagcctggagaagagccatgcccactggacccctggattgcagtccctgataagagcaagtatgtggatctacagactctcaaattgcaggaaaatcctgaggatgttccaactggtgagctccctaggaatgtgctgctttctgtagacagacaccttgttcagaccattgttccgggtacaaggttgactgtggttggcatctacagtgtcttccaagcatctggcactgccaaccataaaggtgctgttggagttaaacagccctacattagaattgtggggttggagcagtctcgagatgataactcaaatggcccctcaaatttcacactcgatgaggaaatggagttcaaagaatttgcgcagaggccagatgcatatgccaagatttgctcaatgattggcccttcaatttatggacattctgatgtcaagaaggctattgcatgcttgttgtttgggggatcaaagaagaggctaccggatggtgtccgtttgagaggagacattcatgccttgcttttgggtgatccatccacagcaaagtcccaggcaagtatttttctcaagtttgtagagaaaacagcaccaattgcagtttatacatcgggaaaaggttcatctgcagctggtcttacagcatctgtaactcgggatagtaactcgcgtgagttttatttggaaggaggggccatggtactggctgatggtggagtggtttgtattgatgaatttgacaaaatgagacctgaggacagagttgcaattcatgaagccatggagcagcagaccatatctattgccaaagctggcattacaacagtactcaattcgaggacctcagttcttgcagctgccaatccaatttcagggcggtatgatgaccttaagactgcacaagataatattgatctgcagacaacaattctttctcggtttgatttaatctttattgttaaagatgtcagaatgtatgagcaggataagcgaatagcaaaccacatcattaaggtgcacgctagtggtgcggcaactacatccaagaacatggagatggatgccaataccaatgaaggagagaattggttgaaaaggtacattgagtactgccgcaatacttgtagaccacggctctcagaaaaagcagcagagatgctccagaacaaatatgttgagatcagacagaaaatgagacaacaatctcatgagacagggagagctgcagctatacccatcactgtaaggcagcttgaagctattatacggttgagcgaatctcttgcgaagatgagattgacaagtgtggctacaccagagcacatcgaagaggcctttagactgttcaatgtctcgactgttgatgccgcaagatctggaatcaacgagcatctgaacttgtcaccggagattgcaaatgagatcaagcaagcggaagcacaaataaagagaagaatgggaattggaagtcacatatctgaacgacgactgctcgatgaactaaaccggatgggcatgaacgaatccatcgtgagaagagcccttgtgatcatgcaccagagggatgaggtcgagtacaagagggagcgccatgtgatcgtccgcaaggcttgagctgaagtgcaccga

SEQ ID NO: 4121 - DNA, 2602 bp, Hordeum vulgare
ccgtcctcttcccccctccgcgtccgcaccccgccccccgcgcccgcgcgtcctcctcctcgccgccgccgccgccatgtcgggctgggacgagggcgccgtcttctacagcgaccaggcgcagttcccgcagggcgaccccgccgccgccgacatcacccgccactccgccctccgcaagttcaaggagttcctccgcggcttcaccggccccaccggcgacttcccctaccgcgagagcctcgtgcacaaccgcgaccatgtcaccgtcgccatcgaggacctcgacgccttcgacgccgagctcgccgacaggatccgcaaggcgcccgcggactacctgccgctgtttgagacggctgggtccgaggttctcgccagccttaggtcgaaggtcgccggcgagactggggaaatggaggagcctgtcaccggcgatgtgcagatcttcctctcctccaaggagaattgcgtctccatgagatctattggggcagattacatgtcgaaattggtgaagattgcgggtattgcaattgccgcttcgagggtgaaagccaaggccactcatgtgactctgctctgcaagaactgcaggagtgtgaggactgtgccgtgcaggccaggcctaggtggcgctattgtcccacggtcctgtgatcatgttcctcagcctggagaagagccttgccccctggacccctggattgcagtccctgacaagagcaagtatgtggatctacagactctcaaattgcaggaaaatcccgaggatgttccaaccggtgagcttccacggaatgtgctgctttctgtagacagacatcttgttcagacaattgttccaggaactagattaactgtggttggcatctacagtgtattccaagcatctgggacaaacaaccagaaaggtgctgttggagttaaacagccctacattagaattgtggggttagagcagtctcgagatgacaacacaaatggaccctcacatttcacactcgatgaggaaatggaattcaaagaatttgcgcagaggccagatgcatattccaagatttgttcaatgattggcccttcaatttatggtcatggtgatgtcaagaaagctattgcgtgccttttgtttgggggatcaaagaagaggctaccagatggtgcccgtttgagaggggacattcatgccttgctcttgggtgatccatccacagcaaaatcccagtttctcaagtttgtagagaagacggcaccaattgcagtctatacctctggaaaaggttcatctgcagctggtcttacagcatctgtaacccgggatagtaactcgcgtgagttttatttggaaggaggggccatggtattggctgatggtggagtggtttgtattgatgaatttgacaaaatgaggcctgaagacagggttgcaattcatgaggccatggagcagcagaccatatctattgccaaggctggcattacaacagtactcaattcgaggacctcagttcttgcagctgccaatccaatttcgggccggtatgatgatctgaagaccgcacaagataatatagatctgcagacaacaatcctttctcggtttgatctaatcttcatagttaaagatgtcagaatgtatgagcaagataagcgaatagcaaatcacatcattaaggtgcatgccagtggtgctgcaactcaagcaaacaagaatgcagatgtcaatgaaggagagaattggctgaaaaggtatgtcgagtactgccgcaacacatgtagaccacgactctcagaaaaagcagcagagatgctgcagaacaaatatgttgagatcagacagaaaatgagacaacaatcccacgagacaggaagagctgcagccatacccatcactgtgaggcagcttgaagctattatacggttgagcgaatctcttgcaaagatgagattgactagtgtggctacgccagagcacatcgaagaggcatttagactgttcaatgtctccaccgttgatgccgcaagatctggaatcaacgagcatcttaacttgtcaccggagattgcaaatgaaatcaagcaagccgaagcgcagataaaaagaaggatgggaattgggagccacatatctgagcgacggctgctcgatgaactgaatcggatggggatgaacgaatccattgtgagaagagcccttgtgattatgcaccagagggatgaagtggagtacaagagggagcgccatgtgattgtccgcaaggcttgagctgaaccgaaccatggaactatctgatgtgtgtgtataagtagtgctgacactgcagcctgtttcatgaggaaatttgttgcatcgttgaaattgagttgtagtagttgtactactttaagctgtaactgtagccctaaattatcttgtgtcgaactgaagatgtaccacagtaagttcattcatgagtgcaacatttgggcgttctgcagctgagcagagtctatgcctgggaaactcaaacttgctctttgccctgcattgttttgccgtcagatttcgcctgtctttgtcctgtgaatgtgatttgcagaaggaaagacataagttagctga

SEQ ID NO: 4122 - DNA, 2368 bp, Hordeum vulgare
cgagagcctcgtgcacaaccgcgaccatgtcaccgtcgccatcgaggaccttcgacgccgagctcgccgacaggatccgcaaggcgcccgcagactacctgccgctgtttgagacggccgggtccgaggttctcgccagccttaggtcgaaggtcgccggcgagactggggaaatggaggagcctgtcaccggcgatgtgcagatcttcctatcctccaaggagaattgcgtctccatgagatctattggggcagattacatgtcgaaattggtgaagattgcgggtattgcaattgccgcttcgagggtgaaagccaaggccactcatgtgactctgctctgcaagaactgcaggagtgtgaggactgtgccgtgcaggccaggcctaggtggcgctattgtcccacggtcctgtgatcatgttcctcagcctggagaagagccttgccccctggacccctggattgcagtccctgacaagagcaagtatgtggatctacagactctcaaattgcaggaaaatcccgaggatgttccaaccggtgagcttccacggaatgtgctgctttctgtagacagacatcttgttcagacaattgttccaggaactagattaactgtggttggcatctacagtgtattccaagcatctgggacaaacaaccagaaaggtgctgttggagttaaacagccctacattagaattgtggggttagagcagtctcgagatgacaacacaaatggaccctcacatttcacactcgatgaggaaatggaattcaaagaatttgcgcagaggccagatgcatattccaagatttgttcaatgattggcccttcaatttatggtcatggtgatgtcaagaaagctattgcgtgccttttgtttgggggatcaaagaagaggctaccagatggtgcccgtttgagaggggacattcatgccttgctcttgggtgatccatccacagcaaaatcccagtttctcaagtttgtagagaagacggcaccaattgcagtctatacctctggaaaaggttcatctgcagctggtcttacagcatctgtaacccgggatagtaactcgcgtgagttttatttggaaggaggggccatggtattggctgatggtggagtggtttgtattgatgaatttgacaaaatgaggcctgaagacagggttgcaattcatgaggccatggagcagcagaccatatctattgccaaggctggcattacaacagtactcaattcgaggacctcagttcttgcagctgccaatccaatttcgggccggtatgatgatctgaagaccgcacaagataatatagatctgcagacaacaatcctttctcggtttgatctaatcttcatagttaaagatgtcagaatgtatgagcaagataagcgaatagcaaatcacatcattaaggtgcatgccagtggtgctgcaactcaagcaaacaagaatgcagatgtcaatgaaggagagaattggctgaaaaggtatgtcgagtactgccgcaacacatgtagaccacgactctcagaaaaagcagcagagatgctgcagaacaaatatgttgagatcagacagaaaatgagacaacaatcccacgagacaggaagagctgcagccatacccatcactgtgaggcagcttgaagctattatacggttgagcgaatctcttgcaaagatgagattgactagtgtggctacgccagagcacatcgaagaggcatttagactgttcaatgtctccaccgttgatgccgcaagatctggaatcaacgagcatcttaacttgtcaccggagattgcaaatgaaatcaagcaagccgaagcgcagataaaaagaaggatgggaattgggagccacatatctgagcgacggctgctcgatgaactgaatcggatggggatgaacgaatccattgtgagaagagcccttgtgattatgcaccagagggatgaagtggagtacaagagggagcgccatgtgattgtccgcaaggcttgagctgaaccgaaccatggaactatctgatgtgtgtgtataagtagtgctgacactgcagcctgtttcatgaggaaatttgttgcatcgttgaaattgagttgtagtagttgtactactttaagctgtaactgtagccctaaattatcttgtgtcgaactgaagatgtaccacagtaagttcattcatgagtgcaacatttgggcgttctgcagctgagcagagtctatgcctgggaaactcaaacttgctctttgccctgcattgttttgccgtcagatttcgcctgtctttgtcctgtgaatgtgatttgcagaaggaaagacataagttagctgattttttca

SEQ ID NO: 4123 - DNA, 1577 bp, Panicum virgatum
cctcttcctaccattagcagaagagaagaagacagaggctctgcgcagagcagcagcaacagctgagcgcgatcgatcgagagagagagacagacacgatgagcggcggcggtcaggacctgcatctgccgccggggttccggttccacccgacggacgaggagctggtgatgcactacctctgccgccggtgcgctgggctccccatcgccgtccccatcatcgccgagatcgacctctacaagttcgacccatggcagctccccagaatggcgcagtacggcgagaaggagtggtacttcttctccccgcgggaccgcaagtacccgaacgggtcgcggccgaaccgcaccgccgggtccgggtactggaaggccaccggagccgacaagcccgtgggcacgcccaagcccctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggctggatgactgggtcctgtgccgcatctacaagaagaagggcgggctggagaagccgccggtgggcgccggcgaccgcaagccggcgctcgccgcggcggcgggctccccgccggagcagaagccgttcgtggcggcgcccgggcgggctgccccccgcgttcgcggacctggcggcgtactacgaccggccgtcggactcgatgccgcggctgcacgcggactcgagctgctcggagcaggtgctgtccccggagcagcagttcgcctgcgaccgggaggtgcagagccagcccaagatcagcgagtgggagcgcaccttctcctccgaccccgtgaaccccgccggctccatgctcgaccccggcgccggcgacccgctgctgcaggacatcctcatgtactggggcaagccgttctagaggtcacgtacgcgcgcgaaccaagggaacggcagagcgttgcgcagccccatcctggggtgcggttggttggcctgcctctctctcggcggcgcaaccgccgcggcgtgggcttgactcaggcgagccgccatagctgactagtactaagagctttaaaaaatggatggattggacggagatgtcatcgtcatcatcccatcataaactaaaacaagatgatggactgggattcgaggcggcaatgagacccgtgtggccccgccgggagctagggagatcgcgatattgcattggtggtcgatccgatcgtgcgtggcatgtgtgtgtacttgtacatatacatacacatacatggttggttggttcggtgcagggtttctgttccttcattggttaattagttatactagtactagtatactgtatgtaagggctttgtagcgcattggtctggtccagtggtagctccagtgtaagccattagtcaattgaaagggtcataaggaaaagccctccatattactatagtacatgttgccatgcattggatctttctcaaaggacacccttataaaaatggagaaaatcgagttgcattgcactgttttttt

SEQ ID NO: 4124 - DNA, 1517 bp, Panicum virgatum
cccctcttcctaccattagcagaagagaagaagagcagagacagacaggctgcagagagcagagcagcagcagggaagcgcggtcgagagagaggcacgatgagcggcggcggccaggacctgcatctgccgccggggttccggttccacccgacggacgaggagctggtgatgcactacctctgccgccgctgcgccgggctgcccatcgccgtccccatcgtcgccgagatcgacctctacaagttcgacccatggcagctccccagaatggcgctgtacggcgagaaggagtggtacttcttctccccgcgggaccgcaagtacccgaacgggtcgcggccgaaccgcgccgccgggtccgggtactggaaggccaccggcgccgacaagcccgtgggcacgcccaagcccctcgccatcaagaaggcgctcgtcttctacgccggcaaggcgcccaagggcgagaagaccaactggatcatgcacgagtaccgcctcgccgacgtcgaccgcaccgcccgcaagaagaacagcctcaggctggatgactgggtcctgtgccgcatctacaacaagaagggcgggctggagaagccgccagtggccgccggcgaccgcaagccggcgctcgccgcggcggcgggctccccgccggagcagaagccgttcgtggcggcgccgggcgggctcccccccgcgttcgcggacctggcggcgtactacgaccggccgtcggactcgatgccgcggctgcacgcggactcgagctgctcggagctggtgctgtccccggagcagcagctggcgtgcgaccgggaggtgcagagccagcccaagatcaacgagtgggagcgcaccttcgcctccgaccccgtgaaccccgccggccacggcggcgccggcgcgggcctcggcggcgacccgctgctgcaggacatcctcatgtactggggcaagccgttctagacggtctcgtgcgcgaaccaagggaacggcagagcggttggctggcctgcctctctcggcagcgcaaccgccgcggcgtgggcttgactcaggcgagccgccatagctgactactagtaagagctctaaagatgggatggattattagacggagatgtcatcatcatcataaactaaaaacaagaagatgatggactgggattattcgaggcggcaatgagacccgtgtggccccgccgggagctagggagagatcgcgatgcattggtggtcgatcgtgcgtggcatgtgtgtgtacttgtacatatacatacatggttggttgattcggtgcagggcttctgttccttcattggttaattagttatatatataagggctttgcagcgtattggtctggtccaggggtagctctagtgtatgccattaaggagttagttgcaaggatcataaagaaaagccctccataatattgtagttgttgcaattgcattggctctttttcaaaggagccccttatataaaggaggagaaaatctagttgcatt

SEQ ID NO: 4125 - DNA, 1220 bp, Pseudoroegneria spicata
gattcgagtagctagcttagctctatatatcgagcgactaatcggtgacgggagatgagcggcggcggaggaggatcggcggcgacgcaggggcagcaggatctgcagctgccgccggggttcaggttccacccgacggacgaggagctggtgatgcactacctctgccggcggtgcgccggcctgcccatctccgtgcccatcatcgccgaggtagacctctacaagttcgacccatggcagctcccaagaatggcgctgtacggcgagaaagagtggtacttcttctccccgcgagaccgcaagtacccgaacgggtcgcggccgaaccggtcggccggcacagggtactggaaggccaccggcgccgacaagccggtgggcacgcccaagcccctggccatcaagaaggcgctcgtcttctacgccggcaaggcgcccaagggcgacaagaccaactggatcatgcacgagtaccgcctcgccgacgtcgaccgctccgcccgcaagaagaacagtctcaggttggatgactgggtgctgtgccggatctacaacaagaaaggcgcctcggagaggccgagcaccggtgaccggaccgccaggtcgagccccgggcacgcggccgtcggctcgccgccggagcagaaaccggccctgctgccgccatacgcgccgcagccgttctcggacctggcggcgtactacgaggtgaggccgtcggactcgatgccgcgggcgcacgcggactcgagctgctcggagcacgtgctgacggcgtcgtgcgagcggccggaggtgcagagccagcccaagatctccgagtgggagcgcacgttcgcctccgccacaccgggcgtcaacccggccggctcgatgctcgacccgtcggccgggctccccgccggcgacccgctcctccaggacatcctcatgtactggggcaagccgttctgagaatccggctccgtggctgtacgtgtggtttggggctgggaggaaatcgatcggggtgactcgggcgagccgccggccggaatctatcggcaggagatactcgtagccgttggatggaggttatcaatagtgtacaaggagtcacgaacggcggcgatgagacgcgggagccccggtgtgttcgagaagggacgcgcagggtactgtacttggtcttggtgtatacggatttgaactaagctgtgtatatgcgattgattgga

SEQ ID NO: 4126 - DNA, 1571 bp, Leymus cinereus x Leymus triticoides
  misc_feature (4)..(6): n is a, c, g, or t
  misc_feature (27)..(27): n is a, c, g, or t
ccgnnnctgtcgtctcctcctacctanagcacaagaagagaagaaaaattcactagcagtagaattcagagcagcagtagcagcgagcgagagaattacagtgaggtttgttggatcgaggaggttcgcgtgaaagaagccgaccgatcgaccggagatgagcggcggacaggagctgcatctgccgccgggcttccggttccacccgacggacgaggagctggtcatgcactacctctgccgccgctgcgccggcgcgcccatcgccgtccccatcatcgccgagatcgacctctacaagttcgacccctggcagctcccaaagatggcgctgtacggcgagaaggagtggtatttcttctccccgcgggaccgcaagtacccgaacgggtccaggcccaacagggccgcgggctccgggtactggaaggccacgggggctgacaagcccgtgggcacccccaagccgctggccatcaagaaggcgctcgtcttctacgccggcaaggctcccaaaggcgagaagaccaactggatcatgcacgagtaccgcctcgccgacgtcgaccgatccgcatccgcccgcaagaagaacagcctcaggttggatgattgggtgctgtgccgcatctacaacaagaagggcggcatggagaagccggcgtccgcggaccggaagccggcgaccgtgggcggctacgggggtggccctggggccatggtcagctccccgccggagcagaagcccgtcatggggatgaacaccaacggcggcggcggcgggcagccgttcccggacttcgcggcgtactacgaccggccgtccgactcgatgccgcggctgcacgcggactcgagctgctcggagcaggtgctgtcgccggactacccgggcgagcgcggcggcggggaggtgcagagccagcccaagatcagcgagtgggagcgctcattcgccaccggcggcgaccctgtgaacccggccgccggctccatcctcgagccccacggcggcttcggcggcgacacgctcctccaggacatgctcatgtactggggcaagccgttctaagcagcagcaaagaaaccgatcgaccgaagcgagtacctcctatccttggcgtttgtggtggccgtggccttggggcgatgacgcgggcgagctgccattgttgacctgatgaaggggagataatttaagaagatattagatttgagataagacaaaatcaggtgcttgatgacgacgacgacgacgacgaagattggaaggtggcgatgataccgtgggtccccgggctctcaccagcatgacatgacgccaagttgcttcaaagcgttcgccgcattgcattgtcgggcggctgtgcgcaagcattcctgtgtgtgtatatgggtgtacatacatggaaaacatgatctattcggtgcaggggttgctgtttcttgattggtttgttgtaagggtttattggtaagttcatagcagagctagcagccgtgcatggtgctagctagctgtggtccgatggtagtgtaagccattcatcaaatgaaactgaataatatta

SEQ ID NO: 4127 - DNA, 2208 bp, Zea mays
cccatcatcagtcagtcagtcagcagccgcaacctcgtacaatcacgaaagcagcacacgagtccacaacagcaccccgcctctttttcttcacgtgcgttgcgtgccctgcccccatggagaccctcctggctggcaaccccgccaacggcgtggcgaagccgacgtgcaatggcgtcggcgccctgcccgtggccaactcccacgccatcatcgccacgccgccggctgcggcgacgctggccccggctggcgccacgctcggccggcacctggcgcgccgcctcgtgcagatcggcgcctccgacgtcttcgccgtcccgggggacttcaacctcaccctgctcgactacctcatcgccgagccgggcctgaccctcgtcggctgctgcaacgagctcaacgccgggtacgccgccgacgggtacgcgcggtcgcggggcgtcggcgcctgcgccgtcacgttcaccgtcggtgggctcagcgtgctcaacgccatcgccggcgcgtacagcgagaacctccccgtcgtctgcatcgtgggcgggcccaactccaacgactacggcaccaaccgcatcctgcaccacaccatcggcctccctgacttctcccaggagctccgctgcttccagacgatcacctgctaccaggccatcatcaacaacctggacgacgcgcatgagcagatcgacacggccatcgcgacggcgctgagggagagcaagcccgtgtacatcagcgtcagctgcaacctggccggcctctcccacccgaccttcagccgggatccggtgcccatgttcatctcgccgaggctgagcaacaaggccaacctggagtacgccgtggaggcggcggccgacttcctcaacaaggcggtgaagccggtgatggtgggcgggcccaagatccgggtggccaaggccagggaggcgttcgccgccgtcgcggacgccagcgggtaccctttcgccgtcatgccggccgccaagggcctggtgccggagcaccacccgcgcttcatcggcacctactggggcgccgtcagcaccaccttctgcgccgagatcgtggagtccgccgacgcctacctcttcgccgggcccatcttcaacgactacagctccgtcggctactccctcctgctcaagcgggagaaggccgtcatcgtgcagcccgaccgcatggtggtcggcgacggcccggcgttcggctgcatcctcatgcccgagttcctccgcgcgctcgccaagcgcctcaggcgcaacaccacggcgtacgacaactaccgccgcatcttcgtccccgaccgcgagccgcccaacggcaagcccaacgagccgcttagggtcaacgtcctcttcaagcacatcaagggcatgctgtccggcgactccgcggtcgtcgccgagaccggcgactcgtggttcaactgccagaagctcaggctccccgagggctgcggctacgagttccagatgcagtacggctccatcgggtggtcggtcggcgcgacgctcgggtacgcccaggcggccaaggacaagcgtgtcatcgcgtgcatcggcgacggaagcttccaggtgacggcgcaggacgtgtccacgatgctccggtgcgggcagaagagcatcatcttcctcatcaacaacggcggctacaccatcgaggtggagatccacgacggcccgtacaacgtgatcaagaactgggactacacgggcctggtcaacgccatccataactccgagggcaactgctggaccatgaaggttcggacggaggagcagctcaaggaggcgatcgccacggcgacgggcgccaagaaagactgcctctgcttcatcgaggtaatcgtgcacaaggacgacacgagcaaggagctcctcgagtgggggtccagggtctccgccgccaacagcaggccgcccaacccccagtgatgagcccgtcgatcggtctcgagcgttcctgcaatggcgcctgcgcctgcgtctgtctgccctgaaattttttcgggtcgtttactcgttttcagtcagttactcagtttgtccgtcttcgtcgagcagaactacatccctgctgagggaagctgccaatctttatcctacgatgataatgtttgcaatttcacttgcttccaattgagttctgttataaatttttgcaacattttttctcttatcaataaaattcgttcgc

SEQ ID NO: 4128 - DNA, 2215 bp, Oryza sativa
gtcacaactcacagccaaaacctcgtacattttcagctagccacaagcaacacaagtccaagacaagtcaagcgttcgcaccaagtcaaaccgcgcctcactgccaccttcgtttgcgcaccatggagcttgccctggttggcaacccttcgaatggcgtggcgaagccgtcgtgcaactccgtcggctcgctgcccgtcgtcagctccaacgccgtcatcaacccgccggtgaccagcgcggcgggcgccacgctcggcaggcacctcgcgaggcgcctcgtgcagatcggcgccaccgacgtgttcgccgtccccggggacttcaacctcaccctgctcgactacctcatcgccgagcccgggctcaagctcatcggctgctgcaatgagctcaacgccgggtacgcggccgacggctacgcccgcgcccgcggcgtcggcgcctgcgccgtcacgttcaccgtcggtggcctcagcgtgctcaacgctatcgccggcgcctacagcgagaacctccccgtgatctgcatcgtcggcgggcccaactccaacgactacggcaccaaccgcatcctgcaccacaccatcggcctcccggacttctcacaggagctccgctgcttccagaccatcacctgctaccaggccgtcattaacaacctcgacgacgcgcacgagcagatcgacaccgccatcgcgacggcgctaagggagagcaagcccgtctacatcagcgtgggctgcaacctggcaggcctctcccacccaacgttcagtcgcgagccagtgccactattcatctcgccaaggctgagcaacaaggcgaacttggagtacgccgtcgaagccgcggcggacttcctgaacaaggcggtgaagccggtgatggtcggtgggccaaagatccgggtggccaaggcgaagaaggcgttcgccggcatcgcggagtcgagcgggtacccgttcgcggtgatgccgtccgcaaagggcctcgtgccggagcaccacccgcggttcatcggcacgtactggggcgccgtgagcaccaccttctgcgccgagatcgtcgagtccgccgacgcctacctcttcgccggcccaatcttcaacgactacagctccgtcggctactccctgctgctgaagcgggagaaggccgtcatcgtgcagcctgaccgcgtggtggtcggcaacggcccggcgttcggctgcatcctcatgacggagttcctcgacgcgctcgccaagcgcctcgaccgcaacacgacggcatacgacaactaccgccgcatcttcatccccgaccgcgagccgcccaatggccagcccgacgagccactcagggtcaacatcctcttcaagcacatcaaggagatgctgtctggcgacaccgccgtcatcgccgagaccggcgactcgtggttcaactgccagaagctcaggctccccgagggctgcgggtacgagttccagatgcagtacggctcaatcggttggtccgtcggcgccacgctcggatacgcccaggcggccaaggacaagcgcgtcatctcctgcatcggcgacggaagcttccagatgacggcgcaggacgtgtcgacgatgctgcggtgcgggcagaagagcatcatcttcctcatcaacaacggcgggtacaccatcgaggtggagatccacgacgggccgtacaacgtcatcaagaactgggactacaccggcctcatcgacgccatccacaactctgacggcaactgctggacaaagaaggtccggactgaggaggagctgatagaggcgatcgcgacggcgacgggcgccaagaaagactgcctctgcttcatcgagatcatcgtgcacaaagatgacacgagcaaagagcttctcgagtggggatccagggtctcggctgccaacagcaggccgcctaatccccagtgatcttgctgctcgtcttctcaggacgcacactcgaaattgctgggctgccaatgtctaagatgtgctgcttatcatcgtctgtgaattaattgtttaacgcttctgtttctgtatccattcaaaattttcttagagaagaggttgaattagtacatgtcgatgggtgttacctatcctatgataatgtatgtaattcaaatgcttggaattaatgttttgtaaacctacactatattgcgatgcaataacatggacgatttgaaggagaagagatc

SEQ ID NO: 4129 - DNA, 2121 bp, Medicago truncatula
ctcttaacaactcataccccttttagtatataataacccttcttagatcacaaaaccatactttaaatatccatcaaaactatacttcaaaatattcatttcatttcattacacaacaaaatggaaacaatgttaggatctttagatatagcaaaaccaacaagcaacgacgtcgtttcatgcaaacaacaaaacagcacagcaacgatccaaccatccaccgcgatcgccacctccgacgctaccctcggccgccacctagcacggaggctagttcaggtcggagtcaccgatgtattctccgttcccggcgacttcaatctcacacttctcgatcatctcatcaatgaaccggagctgaacctcatcggttgctgtaacgagctaaatgctggttatgcggctgatggttatgctcggtcacgtggcgtcggtgcttgtgttgttactttcactgttggtgggttgagtgttcttaatgctatagctggtgcttatagtgagaatttgccgcttatttgtattgttggtggacccaattctaatgattatgggactagtaggattcttcatcatactattggtgttcctgattttagtcaggagttgaggtgttttcaaactgttacttgctttcaggctgtggtgaataacttggaagatgctcatgagttgattgatactgcgatttcaactgcgctgaaagagagcaagcccgtttatataagcattggctgtaacttgcctggtattcctcatcccactttcagccgtgatcctgtccccttttcactcgctcccaaattgagtaaccacatggggttggaggcagcagttgaggcagcagcagagtttcttaacaaagcagtaaaacctgtactagtaggtggtcctaaactgagggtggcaaaagcatctgatgcctttgtcgaactagctgatgcgagtggttacgcacttgccgtgatgccatcagctaaagggatggtccctgagcaccatcctcatttcattggaacttattggggtgctgtgagtacggcattctgtgctgagattgtagaatctgctgatgcatacttgtttgccggtcccatttttaatgactacagctctgttgggtattcacttcttctcaagaaagagaaggcaatcattgtgcagcccgatcgggttgtggttgctaatggacctgcatttggatgcattttgatgaaggatttcctaaaggcacttgcaaagcgtctcaaacacaacaatgctgcatatgaaaattaccataggatatttgtcccagatgggaaacctttgaagtcagcaccaaaagaacctttgagagttaatgttatgttccaacatatacaacagatgttgtcgagggaaactgctgtgattgctgagacaggggactcatggtttaactgtcaaaaattgaaattgcccgagggatgtgggtatgagtttcaaatgcaatatggttcaattggatggtctgttggtgcaactcttggctatgcacaagctgtccccgagaagcgagtgattgcttgcattggtgatggaagctttcaggtaactgcacaggatgtgtcgacaatgctgaggtgtggtcagaaaaccatcatcttcctgataaacaatggaggatacacaattgaggttgaaattcatgatggaccatacaatgttatcaagaactggaattacactggattgattgatgcaattcacaatggtgaaggaaaatgttggactaccaaggtattctgtgaagaggaattagttgaagcaattgcaacagcaacaggaccaaagaaagatagcttatgtttcattgaagtgattgttcacaaggatgacacaagcaaagagttgcttgagtggggctccagagtctctgctgccaatagccgtcctccaaatcctcagtaaacttcagagtcagtctattgttgttacattgctggagttgccatttgattctaaaaattgagaacctttttttagatgattttacttttattgatggcttacttacttgtttatgtaactgagtcgctacttgtttgtataaattcagtcacttgatataaatggcatgcatcactctttttattttgc

SEQ ID NO: 4130 - DNA, 2132 bp, Medicago truncatula
ctcttaacaactcataccccttttagtatataataacccttcttagatcacaaaaccatactttaaatatccatcaaaactatacttcaaaatattcatttcatttcattacacaacaaaatggaaacaatgttaggatctttagatatagcaaaaccaacaagcaacgacgtcgtttcatgcaaacaacaaaacagcacagcaacgatccaaccatccaccgcgatcgccacctccgacgctaccctcggccgccacctagcacggaggctagttcaggtcggagtcaccgatgtattctccgttcccggcgacttcaatctcacacttctcgatcatctcatcaatgaaccggagctgaacctcatcggttgctgtaacgagctaaatgctggttatgcggctgatggttatgctcggtcacgtggcgtcggtgcttgtgttgttactttcactgttggtgggttgagtgttcttaatgctatagctggtgcttatagtgagaatttgccgcttatttgtattgttggtggacccaattctaatgattatgggactagtaggattcttcatcatactattggtgttcctgattttagtcaggagttgaggtgttttcaaactgttacttgctttcaggctgtggtgaataacttggaagatgctcatgagttgattgatactgcgatttcaactgcgctgaaagagagcaagcccgtttatataagcattggctgtaacttgcctggtattcctcatcccactttcagccgtgatcctgtccccttttcactcgctcccaaattgagtaaccacatggggttggaggcagcagttgaggcagcagcagagtttcttaacaaagcagtaaaacctgtactagtaggtggtcctaaactgagggtggcaaaagcatctgatgcctttgtcgaactagctgatgcgagtggttacgcacttgccgtgatgccatcagctaaagggatggtccctgagcaccatcctcatttcattggaacttattggggtgctgtgagtacggcattctgtgctgagattgtagaatctgctgatgcatacttgtttgccggtcccatttttaatgactacagctctgttgggtattcacttcttctcaagaaagagaaggcaatcattgtgcagcccgatcgggttgtggttgctaatggacctgcatttggatgcattttgatgaaggatttcctaaaggcacttgcaaagcgtctcaaacacaacaatgctgcatatgaaaattaccataggatatttgtcccagatgggaaacctttgaagtcagcaccaaaagaacctttgagagttaatgttatgttccaacatatacaacagatgttgtcgagggaaactgctgtgattgctgagacaggggactcatggtttaactgtcaaaaattgaaattgcccgagggatgtgggtatgagtttcaaatgcaatatggttcaattggatggtctgttggtgcaactcttggctatgcacaagctgtccccgagaagcgagtgattgcttgcattggtgatggaagctttcaggtaactgcacaggatgtgtcgacaatgctgaggtgtggtcagaaaaccatcatcttcctgataaacaatggaggatacacaattgaggttgaaattcatgatggaccatacaatgttatcaagaactggaattacactggattgattgatgcaattcacaatggtgaaggaaaatgttggactaccaaggtattctgtgaagaggaattagttgaagcaattgcaacagcaacaggaccaaagaaagatagcttatgtttcattgaagtgattgttcacaaggatgacacaagcaaagagttgcttgagtggggctccagagtctctgctgccaatagccgtcctccaaatcctcagtaaacttcagagtcagtctattgttgttacattgctggagttgccatttgattctaaaaattgagaacctttttttagatgattttacttttattgatggcttacttacttgtttatgtaactgagtcgctacttgtttgtataaattcagtcacttgatataaatggcatgcatcactctttttattttgcaaaaaaaaaaa

SEQ ID NO: 4131 - DNA, 2090 bp, Mimulus guttatus
accattctaatttctacatatctattcctccaatttactattctaaaatatcaccaattttactgttttttctgcttcgtcgttttctcacgcaacaatggacacgaagataggctcgttggacacttgtgcgtcccccacgtgtaccgaagtcggcagcctcccttccaatggcgccgtttccaccatccagtgctccgccgtggcgatcaactccgccgaggccactctcggccgccacctggcccgccgcctagtgcagatcggcgtcagcgacgtcttctccgtccccggtgacttcaacttgacgcttctcgaccacctcattgccgagccggggctcaacttgatcggctgctgcaacgagctcaacgccggctacgccgccgacggttacgccaggtctcgaggtgtcggcgcatgcgtcgtcacgttcactgtcggtggtttgagtgtcatcaacgcgatcgccggcgcctacagcgagaatcttccggtgatctgtattgtcggaggtccgaattcgaacgactacggtacgaaccggatcctgcaccacactatcgggttacccgatttcagccaggagctacgctgcttccagaccgtcacttgctatcaggcggtggtgaataacttggaggatgcacatgaattgatagatacagcgatttcaacagcgttaaaagagagtaaaccagtgtacattagcatcggctgtaatttgccggcgattccgcatccaacttttagtcgtgagcctgtcccctttgccctctccccaaaattgaccaataaaatgggcctggaagcagcagtggaggcaacagtcgagttcctgaacaaggccgtgaaaccagtgttggtcggaggaccgaaactgcgtgttgcaaaagcgtgcaatgcctttgtcgaactggccgatgcttgtggctatgcacttgcagttatgccatcagccaagggactagtccccgagcaccacccccgtttcataggtacctactggggggctgtaagcactgccttctgtgcagaaattgtggaatctgctgatgcttatctctttgctggacccatattcaacgactatagctcggttgggtactctctgcttctcaagaaagagaaggccattatcgtgcagcctgatcgtgtgattattggcaatgggccggcttttggatgtattctcatgaaggatttcttaactgctcttgcgaaacggctcaatcgtaatacaactgcttacgagaattatcataggatttatgttcctgaagggcatcctctgaaaagcgagccgaaagaggcgttgagggtgaatgttctgtttcagcacattcagaagatgttgtctgctgagacagctgtcatcgccgagactggagactcgtggtttaattgccagaagctgaaattgccacagggatgcgggtatgagttccagatgcaatatggatcaattggttggtcagttggtgcaactctgggttatgcacaggctgtaccagagaagcgagtgattgcttgcattggagacggcagctttcaggttacagttcaagatgtgtcgactatgcttcgatgtgggcagaaaactatcatcttcttgataaacaactgtggttacacgatcgaggtggagattcacgatgggccttacaacgtgatcaagaactggaactatactgcattggttgatgcaattcataacggtgaaggcaattgctggaccactaaggtccgatgtgaagaagagcttatcgaagcaatcgagactgctacaggagccaagaaagactgcttgtgtttcatagaagtgattgttcacaaagacgacacgagcaaagaactgcttgaatggggatccagggtttctgctgctaacggccgtccaccaaaccctcagtagattctgttaaatatgctgaaagtgtattaaaatttgtcccattaaaacttgtttggtaataagctgtatttccttcaaacagtgtttcattaattagagagtttcttgtgtttgaaaaaaatattttgtcacactttaatttttggcattagcggtaacaataattggtcgtccg

SEQ ID NO: 4132 - DNA, 2145 bp, Glycine max
aaataccattcaactcttgtcatttttttcactttctctttttcaaaatactcttagtctctctctaaccttcttccagttgtctctaaacctcttgaaatccgtgatggacaccaggataggttcactcgacgcggccaagcccgcctgcaacgacgtcgtatcgtgcaaccacaccaccagcgccgccatccagccctgcgtgccggcgacggtgatcaacggcgccggcggagactccactttaggcggccacctggcacgccggctggtcgaaatcggcgtcaccgacgtgttctccgttcccggggacttcaacctgacgctgctggaccacctgatcgcagagccggcgctgaacctggtcgggtgctgcaatgagctcaacgccgggtacgccgccgatggctacgcgcgcgccaggggagtcggcgcgtgcgtggtgactttcaccgtcggcgggcttagcgtgctcaacgccatcgccggagcgtacagcgagaatttgccgctgatttgcatcgtcggtgggcccaactccaacgactacggcaccagtcggatcctccaccacaccatcgggttacccgatttcagccaggagttgaggtgcttccagaccattacttgcttccaggctgtggtgaataacttggaagatgctcatgagttgattgatacagcaatctcaactgcactgaaagaaagcaagccggtgtatataagcattagctgtaacttgcctgggattcctcaccccactttcagtcgtgatcctgttcctttttcgttatctccaagattgagtaacaagatggggttggaggctgcagtggaggcagcggcagaattccttaacaaggcagtgaaaccagtgctggtgggtggtcctaaactgagggtggcaacggcatctgatgcctttgttgaactggctgatgcgtgtggttatgcgcttgctgtgatgccatcggctaaagggcaggttccagagcaccatccccatttcatcggaacttattggggtgctgtgagcactgccttctgtgctgagattgtggagtctgcggatgcgtacttgtttgctggtcccatttttaatgactacagctctgtggggtattcgctccttctcaagaaggagaaggcgatcattgtgcagcctgatcgggtggtgatcgcaaatggacctgcatttggttgtgtgctgatgaaggatttccttaaggcacttgcaaagcgcctcaagcacaacaatactgcatatgaaaattaccacaggatatttgtccctgaaggacatcctttgaaggctacacccagagagcctttgagggttaatgttcttttccaacatatacagaagatgctgtctggtgaaactgctgtaattgctgagacaggggattcctggtttaactgccaaaagctgaaattgccaaagggatgtgggtatgagttccaaatgcaatatggttcaattggatggtctgttggtgctactcttggttatgctcaggctgttcctgagaagcgagtgattgcctgcattggtgatggaagttttcaggtgactgcccaagatgtatcaacaatgttgcggtgtgggcaaaagaccatcatctttctggtcaacaatggcggatacaccattgaggttgaaattcatgatgggccatacaatgtgattaagaactggaactacactgggttgattgatgcaatccacaatggtgaagggaaatgctggactgccaaggtgttctgtgaagaggagctagttgaagcaattgccacagccacaggacacaagagagactccttatgcttcattgaggtgattgttcacaaggatgacaccagcaaagaattgcttgaatggggctcacgagtctctgctgccaatagccgtccccccaatcctcagtaaacttcagatgtcggcctatgattaaattgctgcaattgccctttagctctatgaaattgagaatcatttgagatgttgtccttgtaggaaatttacctttgttaatggcttgaaatatttatgcaaaactgagtccccacttgtttgtgtaaattctttcacttgagataaaaatatatccatcacctttgttcttatgtaaagcatcgtttttt

SEQ ID NO: 4133 - DNA, 2122 bp, Manihot esculenta
cacattacacacaaacaaacaaagcctatttcttttctttattctcctctgcttcctgtctcctgcctttcctctaaactagacaaattcagtgaaaaaagaaaaaaaaaaacatcttccccatggattccaagattggatctattgacacctgcaagcccaccaacggcgacatgtgcagccctgcaaacggtaccgtctccaccattcaaacttcagttccccccgccgtgatcaactctcatgaatccactctcggtcgtcatcttgctcgccggcttgtccaaattggcataagtgatgttttctctgttcccggggacttcaaccttactcttttggaccatctgattgctgagcctgggcttaacctcattggctgttgtaatgagctcaatgcagggtatgctgccgatggttacgcacgatcgcgtggagttggggcttgtgttgttacgtttactgtgggtggacttagtgttctcaatgcaatcgctggtgcttacagtgaaaatctgcctttgatatgcattgttggtgggcctaactccaatgactatgggactaacaggattctgcaccataccattgggttgcctgatttcagccaggagctaaggtgtttccagactgttacttgtttccaggctgtggtgaataacttggaagatgctcatgagcagatcgatactgctatatcgactgctctgaaagaaagcaagcctgtgtatctcagcattagctgtaacttgcctgcgatccctcatcctaccttcagccgggatcctgttccattctcaatctctcccagatcgagcaaccaaatgggtctggaggctgcagttgaagcagcagcagagtttttgaacaaagcagtgaaaccggttctggtgggtgggcctaaactgagggttgcaaaggcatgcaattcctttgttgaattagctgatgctactggttatgccctagctgttatgccatcagctaaagggcttgtgccagaattccatccccatttcattggaacttactggggtgctgtgagcactgccttctgtgctgagattgtggaatctgctgatgcttacttgtttgctggacctatattcaatgactatagctctgttggatactctctccttctcaagaaagagaaggcaatcattgtgcagcctgatcgagtggtgattggaaacggacctgcttttggatgtgttcaaatgaaagattttctccacgcccttgccaagaggctgaagcccaatactactgcacatgaaaactaccgcagaatttttgttcctgagggacatcctttaaaaagtgaacctaaagaaccattgagggttaatattctcttcccacatatacagaatttgctgtctggtgaaactgctgtgattgctgagacaggggactcatggtttaactgccagaagctgaaattgccaaaaggatgcgggtatgagttccaaatgcaatacggatcaatcggttggtctgttggggcaactcttggatatgcacaggctgtgcccgagaaacgagtgattgcttgcattggtgatggtagctttcaggtgactgctcaagatgtgtcgacaatgctgcgatgcggacagaagtccatcattttcctgatcaacaatggtggatacaccattgaagttgagatccatgatggtccatacaatgtgatcaagaactggaactacactggcttgattgacgcaatccacaacggagaaggcaagtgctggacagccaaggtccattgtgaggaagagctaattgaagcaattgatgctgcaactggaccaaagaaagattgcttgtgcttcatagaggtcattgttcacaaggatgatactagcaaagaactcctggaatggggctccagggtctctgctgccaacagccgaccaccaaatcctcagtagaatttaaaatgtgaagatcgttaattccaagttcacagtctaccgctattgttcctttagtaccagatttttttttgtggtttttgatgagtctgcatattctgacatatctgtttcaagtttaaagcttattttctgatgtggaagagatattctcctgtgattggatcaactttattaca

SEQ ID NO: 4134 - DNA, 2256 bp, Malus domestica
gcaacccactgccttgaccatgaaaaaccgcccctagtatcttccacccactgccgaccacctataaaaaccctcctccttccaaaccaatttcccaaaccaaattccaaaaaccccaaaaaacccaaatcccatcacaaagttcccatcttttctcttttccgagttgttttcaaaaacggtttttgagtacgatcataacccagtaccctccatggacacaaagatcggatccctcgatgtctgcaaaccggcgtgcaccgatgtcgggagcctcccgaacggtgccgcttcggcaatccagagctctgccccctctaccgtgatcaactcctgcgacgccactcttggtcgccacctcgcgcgccgactcgtccaaatcggcgtcaccgacgtgtttactgtccccggtgactttaacttgactctgctcgaccacctcatcgccgagcccgggctcaccaacatcggctgctgcaacgaactcaacgccgggtacgctgctgacggctacgcgcggtcgcggggagtcggcgcatgtgttgttactttcactgtgggtgggctcagtgttctcaatgcgattgccggagcttacagtgagaatcttccattgatttgtatagttggagggccgaactcgaacgattacgggacgaacaggattcttcaccacactattgggttgccggactttagccaagagctgagatgctttcagactgtaacttgctatcaggctgtggtgaataatctggaagatgcgcatgaaatgatcgataccgcaatttcaactgctttgaaagaaagcaagcctgtttatatcagcataagctgcaacttggctggaattcctcatcctacatttagccgggatcctgttccattttctttatctccaaaattgagcaataatttgggcttagaggctgcggtggaggcggctgcagagttcttgaacaaggcagtgaagccggttatggttggtgggcctaaacttcgagttgcacatgccggcgatgcctttgttgaacttgctgatgctagtggttatgctctggctgtcatgccatctgcaaaggggtttgtaccagagcaccacccccattttattggaacatactggggtgctgtgagcactgccttttgcgccgagatagtggagtccgcagatgcatacttgtttgctggaccgattttcaatgactacagctctgttggatactctttgcttatcaagaaggagaaggccattgtggtgcagcctgatcgcgtgaccatagcaaatggcccttcatttggttgtgttcttatgaaggatttcctcagagctcttgcaaagaagctcaggcacaacaacactgctcatgagaactaccgcaggatctttgttcccgatggacaccctctaaagtctgcaccgaaagaacctttgagggttaacgttctgttccaccacatccagaatatgctgtcaagtgaaactgctgtgattgctgagacaggggactcatggtttaactgccagaaactgaaattgccggctgattgcgggtatgagttccaaatgcaatatggatcaatcggttggtcagttggagcaactcttgggtatgctcaggctgttcctcagaagcgtgtgattgctttcatcggtgacgggagtttccaggtgactgctcaagatgtgtccaccatgatccgaaatgggcagaagaccatcatcttcctgataaacaacggcgggtacacaattgaggtggagatccatgacggaccctacaatgtgatcaagaactggaactacactggactggttgatgccatccacaatggggagggcaagtgctggacaaccaaggtccgttgcgaagaggagctgatcgaagcgattgagaccgcaaccggggcaaagaaggatagcttgtgcttcatagaggtgatagtccacaaggatgataccagcaaagagttgcttgagtgggggtctagggtttctgctgccaacagccgcccgcccaaccctcagtaaaattttccatgtcatttcctttcatctacgcagcgtcattccttctcgttaagggtttcctatatatgtttcaattcaacacatttccctgcggtctgtgttttcagttggaatttttgctggtttttatgtacattcccctttgaattacgagtatattctcgtcgattaattagtttatgtgatctgaacgattattcgactcaaaattaatttgcgtatta

SEQ ID NO: 4135 - DNA, 2042 bp, Actinidia deliciosa
ctcaaaacaaaacatccaaacatccctttctgtctcctctctctctctctctctctctctctctgtgaagggttgtactcatcattatagcgatggacagtaagatcggagcacttgacgtgtgcaagccaccgtgcaacgacgtgggcagcatcccgcacaacgacgtcgtttcgacgctccagagctcgccagcatccaccgcgctcaactcggccgagtcgactctgggccgccatctcgcgcgccggctggtccagatcggcgccaccgacgtcttctccgtacccggcgacttcaacctgacgctccttgaccacctcatcgccgagccggggctcaacctcatcggctgttgcaacgagctcaacgccggctacgccgccgacggtttcgcccgctcccgtggcgtcggcgcctgcgtcgtcaccttcaccgtcggcggcctcagcgtcctcaacgccgtcgcaggcgcctacagcgagaacctccccgtcatctgcatcgttggcggcccgaattccaacgattacggcactaacagaatccttcaccacaccatcggactgcctgattttagtcaagagcttcgctgctttcaaactgttacttgctttcaggctgttgtaaacaacttggaagatgcacacgaactgatcgatactgcaatatcgacggccctaaaagaatgcaagcccgtttacatcagcattagctgtaatttaccagggcttccacaccccactttttgccgcgagccagttccatttgttatctctcccagactgagtaatcatatgggtttagaagccgcagttgaggcagcggctgagtttcttaacaaggcagtgaagccggtgatggtgggcgggccgaaactgcgagtggccaatgcttctgaagccttcgtcgaattggccgatgcatgtggttatgcgctggcagtaatgccctcggccaaagggctcgtgccggagaaccacccccacttcatcgggacctattggggtgcggtgagcaccggcttctgcgcggaaattgttgaatccgcagatgcatacttgtttgctgggcccattttcaatgactacagttcagttgggtactcactacttttaaagaaagataaggcaattatagtgcagcccgatcgcgtgatgattgcgaacggccctgcatttgggtgtgttctgatgagggatttcttgggagctttggtgaagcggctgaagcaaaacacgacggcctacgagaattaccacaggatctatgttcctgaggggcaccctctcaagtgtgagcctaaagaggccttgagggtcaatgttctgttccagcacattcagaagatgctgtcgagtgagactgcggtgattgctgagacaggggactcttggttcaattgtcagaaactgaaattgcccccgggatgtgggtacgagttccagatgcagtatgggtcaattggttggtcagtaggtgcaactctcggatatgcgcaggctgcgaagaataagcgagtgattgcttgcattggtgatggcagcttccaggtgactgcacaagatgtgtcaacaatgctgcgatgcgggcagaagaccatcatcttcctgattaacaatggaggatacaccatagaagttgagattcacgatgggccttacaacgtgatcaagaactggaactacaccggattggtcgacgccatccacaatggcgaaggcaagtgctggacgactaaggtgcactgcgaggaagagctcattgaagcaattggcacagcaacaggtgccaagaaagactgcttgtgcttcatagaagtgatagttcacaaggatgacactagcaaagagctgcttgaatggggctcacgggtcgctgccgctaatggtcgcccaccgaacccccagtaaaaatccttctcgctgctgctacgaaacagttactgctgcttgtgtgtacggatactaagttgtagtttgtgttgagccacttgtttatatatgttgccttagtaactactgattctatctgtatattgc

SEQ ID NO: 4136 - DNA, 2327 bp, Glycine max
taccacttaccactttcccaagccatccattctcacacacaaaactttccaccacatactatataaacatcccattcatttccacactcttctcattcaagtcctaaaataccaaaaacccattcacttttccacaagccttagttcttctcatttattctctttttcaaaatactttcactctctctaaccttccagttctcactaaacctcgtgaagctcgtgatggacaccaagataggttcactagacgcgcccaagcccaacagcaacgacgtcgtatcatgcaacctcaccagcagcgccgccatccagccctgcttgccggcgacggtgatcaacggcgccggctgtagtgactccaccttgggcggccacctggcccgccggctggtggaaatcggcgtcaccgacgtgttctccgttcccggggacttcaacctgacgctgctggaccacctcatcgcggagccggcgctgcacctggtcgggtgctgcaacgagctcaacgccgggtacgccgccgacggctacgcgcgcgccaggggagtcggcgcgtgcgtggtgacgttcaccgtcggcggcctcagcgtgctcaacgccatcgccggagcgtacagcgagaacttgccgctaatttgcatcgtcggtgggcccaactccaacgactacggcaccagtcggatcctccatcacaccatcgggttacccgatttcagccaggagctaaggtgctttcagaccattacttgcttccaggctgtggtgaataacttggaagatgctcatgagttgattgatacagcaatctcaactgcgctgaaagaaagcaaacctgtgtatataagcattagctgtaacttgcctgggattcctcaccccactttcagtcgtgaccctgttcgtttttcattgtctccaagattgagtaataagatggggttggaggccgcagtggaggcagcggcggaattccttaacaaggcagtgaaaccagtgctggtaggtggtcctaaactgagggtggcaacagcatctgatgcctttgtcgaactggctgatgcgtgtggttatgcgcttgctgtgatgccgtcggctaaagggcaggttccagagcaccatccccattttatcggaacttattggggtgctgtgagcactgccttctgtgctgagattgtggagtctgcggatgcatacttgtttgctggtccaatttttaatgactacagctctgtggggtattcacttcttctcaagaaggagaaggcgatcattgtgcagcctgatcgggttgtgatcgcgaatggacctgcttttgggtgtgtgctgatgaaggatttcctcaaggcactcgcaaagcgcctcaagcacaacaatactgcatatgaaaattaccacaggatatttgtccctgatgggcatcctttgaaggctgcacccagagagcctttgagggttaatgttctgttccaacatatacaaaatatgctgtctggtgaaactgctgtaattgctgagacaggggactcctggtttaattgccaaaagctgaaattgccaaaggcatgtgggtatgagttccaaatgcaatatggttcaattggatggtctgttggtgctactctgggttatgctcaagccgttcctgagaagcgagtgattgcctgcattggtgatggaagttttcaggtgactgcccaagatgtatcgacaatgttacggtgcgggcaaaaaaccatcatctttctgatcaacaatggtggatacaccatcgaggttgaaattcatgatgggccgtacaatgtgattaagaactggaattacactgggttgattgatgcaatccacaatggtgaagggaaatgctggactgccaaggtgttctgtgaagaggagctagttgaagcaattgccacagccacaggacccaagaaagactccttatgcttcattgaggtgattgttcataaggatgacaccagtaaagaattgcttgaatggggctcaagggtttctgctgccaatagccgtcctcccaatcctcagtaaacttcagaatttatcctatgactaaattgctgcagttgccctttagctctatgaaagtgagaatcatttgagatgatgcccttgtagggaatttacctttgttaatggcttgaaacatttatgctaaactgactccccacttgtttgtgtaaattctttcacttttgttcacctttgtttatcacctttgttcatttcgattattcttaagtaaagcatcgttctttttatccttttctgtttgctacattttgttaaacaggaaccgatttcat

SEQ ID NO: 4137 - DNA, 2217 bp, Nicotiana tabacum
ggcgcgggggttggctgttgaagtataaccgacatcaacaaatacaataacccaaaaccgacccctgtttctcctaaacattttccccttataaaactccagaaattactcaaacaagattcacatttatttctaaaaactttctaaaaagctcctattgatatattcccctgcttcttgaatcgccatggacgcgaagatcggagcaattgacacgtgtaaaccggcgaacaacgacgtgggaagcttaccaacaaccaacagcgttaccattcacacacctaccgttccgttcaactcaccggactccacactaggccgtcatttagcacgccgtttagtccaagtcggcgtcaccgacgtttttggcgttcccggcgactttaatcttacacttttagaccacttaatagctgaacctgggctcaaattcattggctgttgtaacgagctaaatgctgggtatgctgctgatgggtacgctagagctcgtggtgttggagcttgtgttgtgacttttactgttggtggacttagtgttcttaatgctattgctggtgcttatagtgagaatcttcctttgatatgtattgttggtgggcctaattctaatgattatggaactaacagaatccttcatcatactattggattgcctgattttagtcaagaacttcgttgctttcaaactgttacttgttaccaggctgtggtgaataacttagaggatgcacatgaactgatcgatacagcgatatctacggcgttgaaagagagtaagccggtttatataagcataggttgtaacttgccggggattccacaccccacttttagccgtgaaccggtaccattttgcctctctcctagattgagtaatcagatgggtttggaagcagcagtggaggcagctgcagagttcttaaacaaagctgtgaaaccagttgttgtgggagggccaaaattgcgcgttgcaaaggcatctgaggcatttgttgaattggcggatgccagtggatatgctgttgcagtgatgccatcggctaaggggctggttccagaacaccatcctcatttcattggaacttattggggtgcagtgagcacggctttctgcgctgaaattgtggaatctgctgatgcttacttgtttgctgggcctatttttaacgactatagctctgttgggtattctctgcttcttaagaaagagaaagcaatcattgtccagccggatcgtgtgactattgcgaatggacctgcatttggttgtgttctaatgaaggatttccttgccgctttggccaagaggctaaagcacaacccgactgcatacgaaaattatcgtaggatttatgttccagaaggacatcctcttaagtgcgagcctaaggaggcattaagggttaatgttctctttgagcacattcagaggatgttgtctggtgacactgctgtgattgctgagacaggggattcatggttcaattgccagaagcttaaactgcccaagggatgcgggtatgagttccagatgcagtatggatctatcggttggtctgttggcgcaactcttggttatgcgcaagcagcacgagaaaagagggtgattgctttcattggtgatggtagcttccaggtgactgctcaggatatatcaacaatgctgcgatgcgggcagaggactatcatcttcttgataaacaatggtggttatacaattgaagttgagatccacgacggaccttacaatgtgattaagaactggaattacactggactagttgatgcaatccataacggggaaggaaaatgttggacaacaaaggttcattgtgaagaggagcttgtggaagcaattgaaactgcaactgaagccaagaaagattgcttgtgtttcattgaagtgattgttcacaaggatgacaccagcaaagagctgcttgaatggggttctagagtttctgccgctaatagtcgcccaccaaatcctcagtaaaatttctgaatgatcatagcaagttcagataactgaaaataactgttttccaagttggaagttcccgcgttatatctcgtgtttaatttctggggttcatatcccatgagggtattctgctagttatggcttgttcataagattgtctatattgggaatgttgtctcttcatttgagaaagtttcgtttacatgttgtctcgtttatgaaactttgga

SEQ ID NO: 4138 - DNA, 2157 bp, Tropaeolum majus
aaccaacttaaacacactaaaatccaaattcacctccaaaacacaaatttgcttctctaatttcaagcttcatctctgtttcctatttttcctgcaattcaatcttccatactctcaaaccaagaaatcattaccatggacaccaagattggatcatttgacgtatgtaagcccaccagcaacgatgttggaagcatacccaacggaaccgtttccaccgttcaggactcctctgtttctcccaccgccatcagctcgtctgagtcaactctgggtcgtcacctcgctcgcaggctcactcagataggcgtaactgacattttcactgtgcctggtgacttcaacttgacactgcttgaccatcttatagctgagccagggctaaccaatgttggttgctgtaacgaactcaacgctggatacgctgctgatggctacgctcgctcccgtggggttggggcctgtgtggtcaccttcacagttggaggtctcagtgtacttaacgccatcgccggtgcttatagtgagaatctccctctaatttgcatagttggtggccctaactctaatgactatggaaccaacagaattcttcaccacactattggtttgcctgattttagtcaagagctaagatgttttcagaccgtcacttgctatcaggctgtggttaataacctagaggatgctcatgaatcgatcgatactgcgatatcaactgctttgaaagaaagcaaacctgtttatattagcattagctgcaacttgcctggaattcctcatcccacttttagccaggaacccgtcccgttcaatctctcgcctaaattgagtaataaaatgggtttagaggtagcggtggaagcagctgcagatttcttgaacaaagcagtgaaaccagtaatggtcggtgggtctaaacttcgagtcgcaaaagcagccgatgcttttgttgagctagctgacgctagcggctatcccgttgcagtaatgccagctgcgaaagggatggtcccagagcaccatcctcatttcatcgggacttactggggagcagtgagcactgcattttgtgctgagattgttgaatctgctgacgcttacttgtttgcagggcctattttcaatgattacagctctgttgggtactctcttcttttgaagaaggagaaagcaatcgttgtgcagcctgatcgagtggtgattggtaatggaccaacgtttggttgtattttgatgaaggatttccttagagcattatcgaaaaggcttaagagaaacacaactgcttatgataattaccatagaatctatgtacccgaggggaaacctttgaaatgtgaacctaaagagcctttgagggttaatgttatgtttcaacacatacaaaacatgctctctagtaatagtgctgtcattgctgagacaggggattcttggtttaactgccagaagcttaaattgccaaagggttgtgggtatgaattccagatgcaatatggatcaatcggttggtcagttggtgctactcttgggtatgctcaagccgtgccggagaaacgtgtcattgcttgtattggtgatggtagcttccaggtgactgcacaagatgtttcgaccatgctgcgatgtgggcagaaaaccatcattttcctcatcaacaatggtggatacaccattgaagttgagatccatgatgggccatacaatgtgatcaagaactggaactacactgctttggtggaggcaatccacaatggaaatgggaactgctggactgccaaggttttctgtgaagaagagctgattgaagcaatagctacggcaacaggtccgaagaaggacagtttgtgtttcatcgaggttattgttcacaaggatgacactagtaaagagttgctggaatggggttctagggtctctgctgccaatagccgcccaccaaatcctcagtagatttccagatggcggtagagttttttgagcaactttttcttagtttgtatgtcttcaactgaattatcaatgatgttaatctttgtatatcttgtttgaatttccaagtaagctgttaaaaagaaagatttagagtcttttgattttgtttctacctttgtatgtttgattatgatgtctaattgaagatttatcacatta

SEQ ID NO: 4139 - DNA, 1859 bp, Saccharum officinarum
catcgctcgctctcctttcactgggaagaacatctatcagcttgctcattggccatcttcgtcttccatggagaggctcctcgccggcctacttggcttcctattgattgcgtcagttggaagccatgcagctcgtgctccggatcaatactggaagtctgctcttcccgacactcccatgccgacctccctctcccaactcctcaacaccccagccggagggggcacgaccgtcaacgtcggctggggcggtgtccacgtcgatgcggggcacggtaagcccgggggtacgacggttgacgtaggccacggcggcgtcggcgtcaatgttaaccctggcagcagcggcaagaagcccggcggcaccacggtcgacgttgggggcaaagggggagtcggcgttaaggttaatcctggctatggcaagcccggtggcacgacggttggcgtcgggaagggcggagttggtgttaacgtcaaccccggctacgggaagcccggtggcaccactgttggcgtcgggaagggtggcgttggcgttaacgtcaaccctggcaagcccggcggcagtggcaccacggtcggcgttggcaagggcggcgttggcgtcaacgtcaatcctggctacggcaagcccggtggcactacggtcggcgtcggcaatggcggagtgggcgtcaacgtcaatcctggcaagccgggtggtaccggcacaaccgttggcgttggcaaaggcggcgtgggcgtcggcgtcaatcccgggtacggcaagccgggcggcaccacggtcggcgttggcaacggcggggtcggcgtccacgtgaacaacccgcgcaagaagcccgtcaacgtcaacgtctcccctttcctctacaattacgtcgcatcagagacgcagctgcacgacgaccccagcgtggcgctcttcttccaggagaaggacctcctccagcccggtaagaaggtgaccgtccagttcgccgacaccgcgaccaccggcgccaagttcctcccgcgaagcgaggccgaggccatcccgttctcctccgagaaggtccccgagatcctcgcccgcttctcggtggacccggactccgtcgaggcggcggagatggcgcagacgctgcgcgactgcgaggcgcccgcggccaagggcgagaagaaggcgtgcgccacgtcgctggagtccatggtggacttcgccaccgccagcctcgggaccagccacgtgagggccgtctcgaccgtcgtggccaaggagggctcgccgaagcaggagtacaccgtgaccggcgtgaagcgcgcggccggcaccgacggcgacggccgcctggtggcctgccacgcggagccgtacgcgtacgccgtgttcgcgtgccacctgacgcagcagacgcgggcgtactcggtgtcgatgctcggcagggacggcacagccgtggacgctgtcgcggtgtgccacgccgacacgtccggctggaaccccaagcacgtcgccttccaggtcctcaatgtaaagcccggcacggtgccggtctgccacttcctgccgcaggaccacgtcgtctggacccgcagcggctgaggctgctgctggatggaggccgtttgcattggtcacgacgcctgatggagtgatggtttcgtttcattgtgttctagtagcctctaggcatactgtcatatattataaggaggtatcgtgagtttgcatatgtttccagtacagtgtttgatgcttgtatggatggtgttgccagccatcgaccacctgcttagattctgttgtatagttttaaataaacagacatctctctatggttactgctgtcagcctgaacaaacttctgttgatcttc

SEQ ID NO: 4140 - DNA, 1709 bp, Panicum virgatum
caaggccatctcgtctgcatcgccctcctttacaccgggatcatctcagcttgctcattggccatcttcgtcgtccatggacaggctcctcgccggcctgcttggcttcctattgcttgcgtcagtaggaagccatgcagctcgagctccggatcagtactggaagtccgctctccccgacacgcccatgccaagctccctctcccaactcctaaacaccccagccggcggcacgaccgtgaacgtcggctggggcggtgtccatgtcgacgccgggcatggcaagcccgggggcacgaccgtcgatgtaggcaagggcggcgtcggcgtcaacgtcaaccctggcagcggcaagcccggcggcaccaccgtcggtgttgggaaaggtggagtcggcgttaacgtcaagcctggttatggcaagcccggcggcaccaccgtcggcgtcgggaagggtggagtcggcgttaacgtcaagcctggttatggcaagcccggcggcaccaccgtcggcgtcggcaagggcggggtcggcgtcaacgtcaaaccagggagcggcgggaagcccggcggcaccacggtcggcgtcgggaagggaggtgttggcgtcaacgtcaatcctggcaagccgggtggcaccaccgtcggcgtcggcaaaggtggcgtcggcgtcggcgtcaatcccggatacggcaagcccggcggcaccacggtgggcgtcgggaagggtggggttggcgtcaacgtgaagccccgcgggaagcccgtccacgtcaacgtctctcctttcgtatacaactacgccgcgacggagacgcagctgcacgacgaccccagcgtcgcgctcttcttccaggagaaggagctccgccccggcaagaagatgaccgtccagttcaccaacaccgtgcccggtaccaagttcctcccccggagcgaggccgatgccatcccgttctcctccgagaaggtgcccgagatcctcggccgcttctcgctgagcccggactccgtcgaggcggcggagatggcgcagacgctgcgcgactgcgaggcgcccgcggccaagggcgagaagaagtcctgcgccacgtcgctggagtccatggtcgacttcgccacggccggcctcgggaccagccacgtgagggccgtctccaccgtcgtggcgaggccggactcgccgaagcaggagtacaccatcaccggcgttaagcgcgcgggcgcgggcgccgacgacggcggccggctcgtcgcctgccacgcggagccgtacgcgtacgccgtgttcgcgtgccaccagacgcggcggacgcgggcgtactcggtgtcgatgctcggcagggacggcacggccgtggacgccgtcgcggtgtgccacgccgacacgtccgggtggaaccccaagcacgtcgccttccaggtgctcaacgtgaagcccggcaccgtgccggtctgccacttcctgccgcaggaccacgtcgtctggacccgcagcggctgacccttgggtggccgccgccgttgtatgttcttgctgcgctgatggttttcatctacgttctagtagcctctgagcatactgtcgtatggtatcatgatgcgtttgcttatgttttcagtattgtatggatggtgttgccagccagtatcgatcacctgctaggatctgttgtacatttctgaataaacagacatctctttatctt

SEQ ID NO: 4141 - DNA, 1824 bp, Brachypodium distachyon
atctcatctgcatcgtcccaacagcagctcatcttggcctctcctgtgatgagctcagtttgctcgttggtgcccgcaatggataggctcctcgccggcttccttggctttctactgattgcgtcggtaggaagccatgcagctcgggctccggagcaatactggaagtctgctcttcccaacactcccatgccaagctccctctcgcagctcctgaacactccagcgggaggcacgtcagtgaacgtcggctggggaggtgtccatgtcgacgctggtcatgggaagcccgggggcacgacggttgatgttggcaagggtggcgtcggcgtcaacaccaagcccggcgggagtcaagcccgggggcaccacggtcggcgttggcaagggcggcgtcggtgtcaacgttaacccaggccacggcaagcccggtggaaccaccgttggtgttgggaagggcggcgtgggcgtcaacgtcaaccccagcagcggcaagcccggaggcaccacagtcgacgttggcaaaggtggtgtaggcgttaacgtgaaacccgcatatggtaagcctggtggcagtggcaccacggttggagttgggaaaggcggcgtcgacgtgaacgtcaagcccggcagcggcaagcccggcggcaccacggtcggcgtcgggaaaggcggcgtgggcgttaacgtgaaacccgcatacggtaagcctggtggcagcggcaccacggttggagtcgggaagggcggcgtcggcgtgaacgtcaagcctggctacggcaagccaggcggcaccacggtgggcgttggcaagggcggagtgggcgtccacgtgagaccccgcgggaagcccgtcaacgtcaacgtctcgcctttcatatacaactacgccgcgacagagacacaggtgcacgacgaccccagcgccgcgctcttcttcctggagaaggacctccacgccgggaagaagctggccgttcacttcatggccacgacgggcgccggagagaagttcctgccgcggagcgaggccgacgccatccccttctcctccgagaaggtccctgagatcctcagccgcttctccgtgaagccagactccacggaggcggcccagatgacgcagacgctgcacgactgcgaggaggcggcagcgaaaggggagaagaagtcgtgcgccacgtcgctggagtccatggtggacttcgccacgtccagcctcgggaccagccacgtcagggccgtctccacggtggtcgggaaggaggggtcgccgaagcaggagtacgccatgaccagcgtgaagcgcacggccggcgccgaccggctcgtggcctgccacgcggagccgtacccgtacgccgtgttcgcgtgccacctgacgcaggccacgagggcgtacacggtgtcgatggtcggcagcacggacggcacggccgtggaggccgtcgcggtttgccatgccgacacggccggatggaacccgaggcacgtggctttccaggtgctcaaggtgaagcccggcacggtgccggtctgccacttcttgccgcaggaccacgtcgtctggacccgcagcggctgaagcccggacatgcgccgttcgttcgtgcgcgccactatacagtctagtgctttgctatttgaatgcgtgtctttgtgcagatactatcactacggtatcttggatcgtcgcatacggttcgcttgttgctatttgtattggattgtgttgccagtatcgcccggtcgtcggcttgggctatttgctgtatagtttagcacgttaatgcaataaacagactggtacttacctctctacta

SEQ ID NO: 4142 - DNA, 1886 bp, Zea mays
gtctcgctacggctctctactgcccataccgctaccactgtacgtgcctgctgaccgccgagcgccgagcaatccttggagccggccgatcccggcgtggttcggtggtggcactctattaccgcaactgctgtctgtacctcagagctgagcagcagcgtggcaagtgccacctgctgcacggccatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccaacactcccatgccgacctccctctcccaactcctcgacgccgctccagccggcggcggcacgaccgtcaacgtcggctggggcggtgttcacgtcgatgctgggcacggtaagcccgggggtacgacggttgacgtaggcaagggcggcgtcggcgtcaacgttaaccctggcaggagcggcaagcccggcggcacgacggttggcgtcgggaagggcggagtcggcgttaacgtcaacccgggatacggaaagcccggcggcaccaccgttggcgtcggaaagggtggcgttggcgttaacgtcaaccccggcaagcccggtggcacaacggtcggcgtcggcaagggcggagtgggcgtcaacgtcaatcccggcaaaccggccggtggtgccggtacaaccgttggcgttggcaaaggcggcgtgggcgtgggcgtcaatcccgggcacggcaagccgggcggcaccacggtcggcgttggcaagggcggggttggcgttcacgtgaacccgggaaagaagcccgtccacgtcaacgtctcccctttcatctacacgtacgccgcgtcggagacgcagctgcacgacgaccccagcgtggcgctcttcttccaggagacggacctccggcccggtaagaagatgaccgtccagttcgccagcaccgggacgaccggcaccaagttcctcccgcggagcgaggccgaggccatcccgttctcctcacagaaggtgcccgagatcctcgcccgcctctcggtggacccggactccgtcgaggcggcggagatggcgcagacgctgcgcgactgcgaggcgcccgcggccaagggcgagaagaaggcgtgcgccacgtcgctggagtccatggtggacttcgccaccgccagcctcgggaccaggcacgtgagggccgtgtcgaccgtcgtggcgaaggagggatcgccgaagcaggagtacacggtgaccggcgtggagcgcgctgccggcggcaccgacgacgacggccgggtcgtggcctgccacgcggagccgtacgcgtacgccgtgttcgcgtgccacctgacgccgcagacgcgggcgtactctgtgtcgatgctcggcagggacggcacggccgtggacgctgtcgcggtgtgccacgccgacacgtccggctggaaccccaagcacgtcgccttccaggtgctcaacgtgaagcccggcaccgtgccggtctgccacttcctgccgcaggaccacgtcgtctggacccgcagcggctgagtttgctggatggccgccgtttgctcgcgtcgcgccgcctggagtgatttgttatgttccagtggcctctaggcatactgtcatattattattataccgaggtatcacgagtttgcttatgtttccagtacttgatgcttgtatggatatggtgtagccagctcagcaagtatcaacccacctgcttaattttgttgtatagttttaaataaacagacaacctctttatggttactgctctcagcct

SEQ ID NO: 4143 - DNA, 1814 bp, Leymus cinereus x Leymus triticoides
  misc_feature (5)..(9): n is a, c, g, or t
  misc_feature (578)..(578): n is a, c, g, or t
agtannnnnagtgagcagatcatcctcaccttgcgagttgtcgtcagtttcctctcgatggataggctcctcgcagccggcatccttggctttctactgattgcgtcggtaggaagccatgcagctcgtgctccggagcaatactggaactctgctcttcccaacactcccatgccaagctccctctctcaactcctcaacaatcaagccggaggcacgtcggtgaacgtcggctggggcggtgtccatgtcgacgcgggtcatgggaagcccgggggcacgacggtcgatgttggcaagggtggcgtcggcgtcaacgtgaagcctggcagcgccaagcccggcgggactacggtcggcgtcggcaagggcggcgtgggtgtcaacgtcaaccctggctacggcaagcccgggggcacaaccgtgggcgttggaaagggcggcgtggacgtcaacgtcaaacctggcagcggcacgacggtcggcgttggcaaaggcggcgtgggcgtcaacgtcaagcctggctatggcaagcccgggggcacaacagttggcgttggcaagggcggcgttgacgncaacgtcaaacctggcagcggcaagcccagcggcacgacggtcggcgtcgggaaaggtggcgtcggcgttaacgtgaaacccgcatacggcaagcctggtggcaccggcaccacggttggcgtcgggaagggcggcgtcggcgtcaacgtcaagcctggctacggtaagccaggcggcaccacggtcggcgtcggcaagggcggcgtcggcgtccaagtgaaaccccgggggaagcctgtccacgtcaacgtctcacctttcgtatacaactacgccgcaacggagacgcagctgcacgacgaccccagcgccgcgctcttcttcctggagaaggatctccacaccgggaagaagatgaaggttcatttcatggccaccccaggcgccggagagaagttcctgccgcggagcgaggccgacaccatcccgttctcctccgagaaggtccccgagatcctcacccgcttctccgtggcgccagactccgtcgaggcggcggagatgaagcagacgctgcacgagtgcgaggcgacggcagccaagggggagaagaagtcgtgcgccacgtcgctggagtccatggtggacttcgccacgtccagcctcgggaccagccacgtgagggccgtctccacggtggtcgggaaggaggggtcgccgaagcaggagtacaccatgaccggcgtgaagcgcgcggcgggcgcggaccagctcgtggcctgccacgcggagccgtacgcgtacgccgtgttcgcgtgccacctgacgcaggcgacgagggcctacacggtgtcgatggtcggcaaggacggcacggcggtggaggccgtcgcggtgtgccacgccgacacggccggctggaacccgaggcacgtcgcgttccaggtgctcaaggtgaagcccggcgcggcgccggtctgccacttcttgccgcaggaccacgtcgtctggacccgcagcggctgaagaagcccggatggatctgtgccgttcgtaagcaccatacagttcagtgctttgctatttggatgatgcctgcctttgttacggtcagatactactatgtcctatattgagtatatggtatcttgcatcctagcatacatttccgttgttgctacctattgtatttggatggtgttgccagtatcgccagcttgtacggagtgggatgtttgctgtatagtttagcacggttatgcaataaacagactggtacttatttacctcttttt

SEQ ID NO: 4144 - DNA, 1844 bp, Pseudoroegneria spicata
ccgttgctgtcggcagttccaagtgagcagatcatcctcgccttgcgagctgtcgtcagtttcctcattggtgccctccatggataggctcgtcgccgccggcatcctcggctttctactgatcgcgtcggtaggaagccatgcagctcgtgctccggagcaatactggaagtctgctcttccctacactcccatgccaagttccctctctcaactcctaaacaatcaagccggaggcacgtcggtgaacgtcggctcgggcggtgtccatgtcgacgcgggtcatgggatgcccgggggcacgacggtcgatgttggcaagggtggcgtcggcgtcaacgtgaagcctggcaccgtcaagcccggagggactacggtcggcgtcggcaagggcggcgtgggtgtcaacgtcaagcctggctacggcaagcccgggggcacgacagttggcgttggcaagggcggcgtggacgtcaacgtcaaacctggcaacggcaagcccagcggcacgacggtcggcgttggcaaaggcggcgtgggcgtcaacgtcaagcctggctacggcaagcccggtggcaccacggttggagtagggaaggggggcgtcggtgtgaacgtgaagcctggcggcggcaccacggtcggcgtcgggaaaggtggcgtcggcgtgaacgtgaaacctgcatacggcaagcctggtggcaccggcaccaccgttggcgtcgggaagggcggcgtcggcgtcaacgtcaaacctggctacggtaagccaggcggcaccacggttggcgtcgggaagggcggcgtcggcgtcaacgtcaagcctggctacggtaagccaggcggcaaaccccggggtaagcctgtccacgtcaatgtctcacctttcgtatacaactacgccgcaacggagacgcagctgcacgacgaccccagcgccgcgctcttcttcctggagaaggatctccacgccgggaagaagatggacgttcatttcatggccaccccgggcgccggagagaagttcctgccgcggagcgaggccgacaccatcccgttctcctcggagaaggtccccgagatcctcagccgcttctccgtggcgccagactccgtcgaggcggcggagatgaagcagacgctgcgcgagtgcgaggcgacggcggccaagggggagaagaagtcgtgcgccacgtcgctggagtccatggtggacttcgccacgtccagcctcgggaccagccacgtgagggccgtctccacggtcgtcgggaaggaggggtcgccggagcaggagtacaccatgaccggcgtgaagcgcgcggcgggggccgaccagctcgtggcctgccacgcggagccgtacgcgtacgccgtgttcgcgtgccacctgacgcaggcgacgagggcgtacacggtgtcgatggtcggcaaggacggcacggcggtggaggccgtggcggtgtgccacgccgacacggccggctggaaccctaggcacgtggcgttccaggtgctcaaggtgaagcccggcgcggcgccggtctgccacttcctgccgcaggaccacgtcgtctggacccgcagcggctgaagaatcccggatctgttccgttcgttcgtaagcaccatacagttcagtgctttgctatttggatttggatgatgcatgcgttcgtttatatgagtgtatggtatcttgcgtcctagcatacatttccgttgttgctacctattgtatttggatggcgttgccagtatcgccagcttgtacggagtgggctgtttgctgtatagtttagcacgttgatgcaataaacagactggtacttatttacctctca

SEQ ID NO: 4145 - DNA, 1875 bp, Triticum aestivum
cgcagttccaagtgagcagatcatcctcacattgcgagctgtcgtcagtttcctcattggtgccctccatggataggctcgtcgccgccggcatccttggctttctactgattgcgtcggtaggaagccatgcccatgcagctcgtgctccggagcaatactggaagtctgctcttcccaacacccctatgccaagctccctctctcaactcctaaacaatcaagccggaggcacgtcggtgaacgtcggctggggcggtgtccatgtcgacgcgggtcatgggatgcccggcggcacgacggtcgatgttggcaagggtggcgtcggcgtcaacgtcaagcctggcagcgccaagcccggcgggactacggtcggcgtcggcaagggcggcgtgggtgtcaacgtcaagcctgcctacggcaagcccgggggcacaaccgtgggcgttggcaagggcggcgtggacgtcaacgtcaaacctggcagcggcaagcccagcggcacgacggtcggcgttggcaaaggcggcgtgggcgtcaacgtcaagcctggctacggcaagcccggcggcaccacggtcggagtagggaagggaggcgtcggcgtgaacgtgaagcctggcgacggcaccacggtcggcgtcgggaaaggtggcgtcggcgtgaacgtgaagcctgcatacggcaagcctggtggcaccggcaccaccgtcggcgtcgggaagggtggcgtcggcgtcaacgtcaagcccggctacggtaagccaggcggcaccacggtcggcgttggcaagggcggcgtcggcgtcaacgtcaagcctggctacggtaagccaggcggcaaaccccggggtaagcctgtccacgtcaacgtctcgcctttcctatacaactacgccgcgacggagacgcagctgcacgacgaccccagcgccgcgctcttcttcctggagaaggatctgcacgccgggaagaagatgaacgtccatttcatggccaccccgggcgccggcgagaagttcctgccgcggagcgaggccgacgccatcccgttctcctcggagaaggcccccgagatcctcagccgcttctccgtggcgccggactccgccgaggccgcggagatgaagcagacgctgcgcgagtgcgaggcgacggcggccaagggggagaagaagtcgtgcgccacgtcgctggagtccatggtggacttcgccacgtccagcctcgggaccagccacgtgagggccgcctccacggtggtcggaaaggaggggtcgccggagcaggagtacaccatggccggcgtgaggcgcgcggcgggggccgaccagctcgtggcctgccacgcggagccgtacgcgtacgccgtgttcgcgtgccacctgacgcaggcgacgagggcgtacacggtgtccatggtcggcaaggacggcacggcggtggaggccgtggcggtgtgccacgccgacacggccggctggaacccgaggcacgtggcgttccaggtgctcaaggtgaagcccggcggggcgccggtgtgccacttcctgccgcaggaccacgtcgtctggacccgcagcggctgaagaagcccccggatctgtgccgttcgttcgtaagcaccatacagttcagtgctttgctatttgggttgatgatgcctgcgttcgtttacgttctagcctcagcagacgctgctgtgtcctactatatgagtatatggtatcttgcatcctagcatacatttccgttgttgttgcctattgtatttggatggcgttgccagtatcgccggcttgtacggagtgtgggctgtttgctgtatagtttagcacgttgatgcaataaacagactggtacttatttacctct

SEQ ID NO: 4146 - DNA, 1699 bp, Saccharum officinarum
aatttgaaagcggtcgcctgcgctaccggtccggaattgacggcccgtcccacgcgcccgcaaaattcatccaaaaaattcccaaattaaaaaaaacacttgcagcggcatccaccaccggagctcccatcatcggccccatccctccgtgtcaaccccctcctcagaagttctatttgcagttcagcccctggccggtccgcccggccaccggaaggagccgctcgccggaggaatcccccccgtctccttgccctgcggcgggttcatggggttctcgctgtaccccatgaagacgtccacgcggttgctctggagcactagcttcttccgccataagctcagctcctcctcctgcttcctctgagcccgcctcgatcgcctcggcggcggcccgctactgctgctgcgcggtcctagcatccgttcaagcgtgtgtgcttgtgtctgtgtttgtgttcgtgtgtgcgtgtgggggcgcgcgcgcgcatacgggtttcaagattgggttttgttgcgttcttggggagaggaagggactagggcgccggcaagaatcagcatggatccgagcgcggtcagtttcaactccggcggcgcgcggcggggcggcggcggcgcgcaaatgctgctcttcggcggcggaggcagcgccaacagcaacggcttcttccgaggtgttccgatggcggtcctgggcatggacgacgcgacgcgcgtgggcaagcggcccttcttcaccacacacgaggagctcctggaggaggagtactacgacgagcaggcgcccgagaagaagcgccgtctgacggcggagcaggtgcagctgctggagcggagcttcgaggaagagaacaagctggagcccgagcgcaagaccgagctggctcgccgcctcgggatggcgccccgccaggtggccgtctggttccagaaccgccgcgcgcgctggaagaccaagcagctcgagaccgactatgaccacctcaaggctgcctacgacgcgctcgccgccgaccaccagggcctcctggccgacaacgatagcctccgggcacaggtggtctccctaacagagaagctgcaaggcaaggagacatccccgtcggcgaccactgctgcccaagaggtcgaccagccagacgaacacaccgcggcgtcaggcactgagaaactgctggcgcagcagctcaaggacgacctccacagcagcggcgactgcactggccatggtgccctctcctcagaggaagaggatggtggtgtggtcagtgacgagggcagctttgatctcccggatgccatgtttgctgccggggtcacccaccatggcgccgacgccgaggaggcacagctggccaactggacatcctggttctggaactgatcgatggatggatgtgcaaagagcaaatcctctcctggtttcgaccctgttctgcaccatataattactgtgttgattatgtgccgtcgtcagaagttttcaagtaatgaaacagtactgatgttgtaagtttatgtttttgaagattttatatgttcgtatatattatatgctttgaacatgagactcgaaaagttgaaataagtggatgtggagacctgttgtgcactagcagcccgcatgagttttttatgctgcttcagacatgaaaatgtatatccaacttgggcctgtgaataagataattaaggt

SEQ ID NO: 4147 - DNA, 1605 bp, Saccharum officinarum
  misc_feature (79)..(79): n is a, c, g, or t
  misc_feature (619)..(619): n is a, c, g, or t
aatttgaaagcggtcgcctgcgctaccggtccggaattgacggcccgtcccacgcgcccgcaaaattcatccaaaaaantcccaaattaaaaaaaacacttgcagcggcatccaccaccggagctcccatcatcggccccatccctccgtgtcaaccccctcctcagaagttctatttgcagttcagcccctggccggtccgcccggccaccggaaggagccgctcgccggaggaatccccccgtctccttgccctgcggcgggttcatggggttctcgctgtaccccatgaagacgtccacgcggttgctctggagcactagcttcttccgccataagctcagctcctcctcctgcttcctctgagcccgcctcgatcgcctcggcggcggcccgctactgctgctgcgcggtcctagcatccgttcaagcgtgtgtgcttgtgtctgtgtttgtgttcgtgtgtgcgtgtgggggcgcgcgcgcgcatacgggtttcaagattgggttttgttgcgttcttggggagaggaagggactagggcgccggcaagaatcagcatggatccgagcgcggtcagtttcaactccggcggcgcgcggcggggcggcggcggcncgcagatgctgctcttcggcggcggaggcagcgccaacagcaacggcttcttccgaggtgttccgatggcggtcctgggcatggacgacgcgacgcgcgtgggcaagcggcccttcttcaccacacacgaggagctcctggaggaggagtactacgacgagcaggcgcccgagaagaagcgccgtctgacggcggagcaggtgcagctgctggagcggagcttcgaggaagagaacaagctggagcccgagcgcaagaccgagctggctcgccgcctcgggatggcgccccgccaggtggccgtctggttccagaaccgccgcgcgcgctggaagaccaagcagctcgagaccgactatgaccacctcaaggctgcctacgacgcgctcgccgccgaccaccagggcctcctggccgacaacgatagcctccgggcacaggtggtctccctaacagagaagctgcaaggcaaggagacatccccgtcggccaccactgctgcccaagaggtcgaccagccagacgaacacaccgcggcgtcaggcactgagaaactgctggcgcagcagctcaaggacgacctccacagcagcggcgactgcactggccatggtgccctctcctcagaggaagaggatggtggtgtggtcagtgacgagggcagctttgatctcccggatgccatgtttgctgccggggtcacccaccatggcgccgacgccgaggaggcacagctggccaactggacatcctggttctggaactgatcgatggatggatgtgcaaagagcaaatcctctcctggtttcgaccctgttctgcaccatataattactgtgttgattatgtgccgtcgtcagaagttttcaagtaatgaaacagtactgatgttgtaagtttatgtttttgaagattttatatgttcgtatatattatatgctttgaacatgagactcgaaaagttgagataagtggatgtgggacct

SEQ ID NO: 4148 - DNA, 1683 bp, Zea mays
aactttagcagcaaaattcacccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttagggctggtttgggaagttcatttttcaaagaattcatatttttcaaagggaaatgaactaattttacttaggaaaacggaaatccctcaagaaaatagagtttctaaact

SEQ ID NO: 4149 - DNA, 1649 bp, Zea mays
aactttagccacaaatttcacccaaaaccaaaaaaataataatcccaaattaaagaaaaggagcagaagaaaaacaactttcatcgccgtccgccaccggagctcacttcgtcggccttccctcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcattt

SEQ ID NO: 4150 - DNA, 1524 bp, Panicum virgatum
caaataaaaaaggaaggggaaaaaaacactaggagcggcatccaccaccggagctcctatcggcccatccctctgtgtcaaccccctccggaaaaattttatttgcaatcccgtccctggccggcggcccttgcagcggctcccgctcgccggaggaatccacccgtctccttgctctgcggcggggtcatggggttctcgctgtaccccatgaagacgtccacgcgcgttctctggagcaccagcttcttccgccataagctcgcctcctcctgctgcttcatctgagccagcccaacaccgccctcgatcgcctcggcggcggccacagctgcacggatttcaaagcggccgtttaagagcgtgtgtgtgcgcgcgcgcgcacgtgcgggtttcaagattgggtttttgtttcgttctttgggaggaaggggacaaggagaagggagagggcaagaagaagagcaagaatcagcatggatccgggccgcgtcggcgtcgactcgggcggcgcacggcggggcggcggcggcggcgcgcagatgctgctcttcggcggcgggggcagcgccaacagcaacggcttcatccgaggtattccgatggcggttctcggcatggacgacgcggcgcgcgtgggcaagcggccgttcttcacaacgcacgaggagctcctggaggaggagtactacgacgagcaggcgccggagaagaagcgccggctgacggcggagcaggtgcagctcctggagcggagcttcgaggaggagaacaagctggagccggagcgcaagaccgagctggcgcgccggctggggatggcgccccgccaggtggccgtctggttccagaaccgccgcgcgcgctggaagaccaagcagctcgagaccgactacgaccgtctcaaggctgcctacgacgcgctcgccgccgatcaccagggcctactcgccgacaacgacagcctcagggcacaggtaatctccctgacggagaagctgcaaggcaaggatacatccccatcggcgaccatcactgcccaagaggttgaccagctggacgagcacactgcggcgtcaggcaccgagaagctgctggtgcagctgaaacacgaccacctcagcagtggcgactgtaccggccacggtgccctctcgtccgaggaagaggacggtggcgtgatcagcgacgaggtatgcagcttcgaccttccagatgccttgttcgccgctgctggggtcacccaccacggcgcagaggaagcgcagctgtgcagctggaactcctggctgtggaacaactgatcggtggatggctggatggatccattccatgccccgtgtgcgaagttctcccctggtttcgacccttttctgcaccgtataattactgtgttaattatgttccgccaaaatgtttttgagtgttgaaacagaacctgatgttgtaagtttacgtttttgaagattttatgtgttcatatataaataatatgctttgaacatgagcgttgaaaggttggat

SEQ ID NO: 4151 - DNA, 1600 bp, Sorghum bicolor
atggccgtgacgccggaccagcagcagccaccaccaccagcaggggcctcctcgacacctcctcgcctcctcgtacacgtacacgaaaccaccctcgtgccgccgtctccatcgccgccggagacctcgctcccgctcaccttcctcgacgtcttctttcttcactccacgcccgtcaagcgcctcttcctctaccgcctcgccggccccgacgccgacgtcgccgccatcatctccagcctccgggactcgttgcaccaggccctccgtgccttctacccgctcgccggccgcgtccgcctcacccccggcacatccgaccgctacgagctgcactaccgccccggtgacgccgtcaccttcaccgtcgccgagtgcgacgacgacatgcacttcgacggcctcaccaccgacgagccgcgggaggttgccaagatcgccgcgctcgtgccgccgctgcccgacggcggcaaactgctcgccgttcaggccacgctccttcccgcgcgccgaggtctcgccatcggcgtcactgtgcaccacgccgcctgcgacggctctggatccacgcacttcctccacacctgggcggccgcctgcagaggcggcgccgccgaaccgtcgttgccgccgccgccgccgccgcctgtcatcgaccggactctcctccccgacccaaggcgcctgtacgacgtcttcgtccaagcggcgccgagcagccaagagctggagttcatcaaggtgtccgccgaccagctcttggccacgttcgtgctgtccaaggacgacctgacgcgcgtcaaggacgtcgtggccgacgaggctacgaggcgcggcgtcgcgccgccccggtgctcctctctcgtcgccaccttcggcttcgtctggtcgtgctaccagcgagccaagaacggcggcggcggagagggcccgatgatgacctgcatggtcatagccgtcgaccaccgctcgcggatgaagcctcccctgccggacaagtacctgggcaactgcgtcggcccagcgttcgcgctggcgccaacgggcgagctggccgtggctggcgcaggcgggctcttcagcgcgtgcgccgccgtcgccgcctccattgacgaagctgtacgcgacatcgggacgtcgagcatggaggcgtggatggaccggatcaaggaggtgctcctgatggatttactcaccgtgtccggctcgccgaggttccgcgtctacgacctggacttcggattcggccgaccggcgaaggtggaggtcgtgcccgtgacgaggaccggcgtagtggcggtggcggagagccgggttggggacggcgggatagaggtgggggtctctctccagccggctgccatggggagctacaagaagtgcttcgcggatgctatcgcgtggctccaccagagaagacatgagagcgacgactcgttctaaatctgcagaaacggaatctttaccgtgtgatgaaaagggggcctgccatatgtcaggtgtctgaaatttcacatctaatcagccgttgattctcattaattacatctaaatcaaatggttttggagtttcttttttcctttgtatgtttcctttccg

SEQ ID NO: 4152 - DNA, 1449 bp, Sorghum bicolor
atggccgtgacgccggaccagcagcagccaccaccaccagcaggggcctcctcgacacctcctcgcctcctcgtacacgtacacgaaaccaccctcgtgccgccgtctccatcgccgccggagacctcgctcccgctcaccttcctcgacgtcttctttcttcactccacgcccgtcaagcgcctcttcctctaccgcctcgccggccccgacgccgacgtcgccgccatcatctccagcctccgggactcgttgcaccaggccctccgtgccttctacccgctcgccggccgcgtccgcctcacccccggcacatccgaccgctacgagctgcactaccgccccggtgacgccgtcaccttcaccgtcgccgagtgcgacgacgacatgcacttcgacggcctcaccaccgacgagccgcgggaggttgccaagatcgccgcgctcgtgccgccgctgcccgacggcggcaaactgctcgccgttcaggccacgctccttcccgcgcgccgaggtctcgccatcggcgtcactgtgcaccacgccgcctgcgacggctctggatccacgcacttcctccacacctgggcggccgcctgcagaggcggcgccgccgaaccgtcgttgccgccgccgccgccgccgcctgtcatcgaccggactctcctccccgacccaaggcgcctgtacgacgtcttcgtccaagcggcgccgagcagccaagagctggagttcatcaaggtgtccgccgaccagctcttggccacgttcgtgctgtccaaggacgacctgacgcgcgtcaaggacgtcgtggccgacgaggctacgaggcgcggcgtcgcgccgccccggtgctcctctctcgtcgccaccttcggcttcgtctggtcgtgctaccagcgagccaagaacggcggcggcggagagggcccgatgatgacctgcatggtcatagccgtcgaccaccgctcgcggatgaagcctcccctgccggacaagtacctgggcaactgcgtcggcccagcgttcgcgctggcgccaacgggcgagctggccgtggctggcgcaggcgggctcttcagcgcgtgcgccgccgtcgccgcctccattgacgaagctgtacgcgacatcgggacgtcgagcatggaggcgtggatggaccggatcaaggaggtgctcctgatggatttactcaccgtgtccggctcgccgaggttccgcgtctacgacctggacttcggattcggccgaccggcgaaggtggaggtcgtgcccgtgacgaggaccggcgtagtggcggtggcggagagccgggttggggacggcgggatagaggtgggggtctctctccagccggctgccatggggagctacaagaagtgcttcgcggatgctatcgcgtggctccaccagagaagacatgagagcgacgactcgttctaaatctgc

SEQ ID NO: 4153 - DNA, 700 bp, Saccharum officinarum
ctcacatactctctgctaacctctgattggttatctctagtaccagtacctgccgccttgctcgctcgctgcagagctgcagcacaccggccagccggccaccacgtaacctacgacaccgccgggccggccatggccatggccctgggtggcgacgcggagcggaaggcgaagacagcggaggtggcgctgcgtgcgctcctgtgcgggctgggcgcgctggcggcggcgctggtggccacggacacccagacgcggaccttcttctccctgcagaagaaggccagctacacggacatgaaggccatggtgttcctggtggccgtcaccgccgtcgccgccggctacagcctgctgcagctgggggcgcgctgctgcatcgccctgctgccgtcgtccagctcccgcggaggcggaggcatggtgccgggccggcccctggcctggtgcgtgttctcgtgcgaccaggcgctggcatacgtgctgctggccgccgtcgccgccgcgctgcaggcctccgtcgtcgccaagcgcggccagcccgagatgcagtggatggggatctgcgccctctacggcaccttctgcaggcaggctggagccggcatcgctagcgccgtcgcaactgggcttgccggccgtctgcttcgctttctctccgccttcaactcttcaggctctacggcaccaaggcctaact

SEQ ID NO: 4154 - DNA, 2182 bp, Zea mays
catcgacctcgatccattgaataattttactaatcaaattcttgttgggatatattcctccaattcccctcctcctcccaacaaggcaacaacaatctgttccggccgccaaacaaaacccaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgctgccgcggtgggccgcggaggagatggagagggaccaggacctctgctacaccgaccagtggggccgccgcaactacgagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaggcggcagcggaggcggccggcaagcctgagtggggccacggtgggccgaccgacgctggcggctacaacaactggcctgaggacaccgtcttcttccgcggcgacaacggtgggtggagcaccgagtacggcgacttcttcctgtcgtggtactcgcagatgctgctggagcacggcgaccgcatcctgtcgggcgccacgtccgtgttcggcgccgcgcccgtggaggtctccgtgaaggtggccggcatccactggcattacggcagccggtcccacgcccccgagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgaggaccggatggtggccttcacgtacctgcgcatggggcccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccggccgggccgggacggaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcactgcagctccagcgtagacgagattgtattgtgaccaagccgggagggaaagcagggaggggaggacaaagatgttttgtcacgtttcaggctctggccatcgccggagtttgtgcggggaatatatcgatttcctattagaaatccgcaga

SEQ ID NO: 4155 - DNA, 2287 bp, Panicum virgatum
cccccaattcccctccttctcgtcccaacaacaatctggtcgatcactcccgccaaaaccgaaacgaaaacccagttcagttccatcccaatccgatcccacaaaagcagagaaagaacccaacaccatcccagttcagctcgatcgccgttggccaatcacccagaccggaaggaaacgatggccttcagcgtggctcagagcgccgccgccgctgcggcgtccgtcgcgcccggcacgcctcgacacgcgccggcgcccgcgtcgtccgtctccgtgaggaaagccggcggcgcgccgtcggccagcctcaggctgcagccttcggtgccgccggcgcgtccggtggcgtgccgggcagcggcgggcggcggcggccgagcgcgcctcgaggaggagcgcgggggtgccggtgttcgtcatgatgccgctcgacaccgtcaacaagtgcggcaccgcgctgaaccgccggaaggccgtccaggcgagcctggcggcgctcaagagcgcgggcgtcgagggcgtcatggtggacgtgtggtggggcatcgccgagagcgacggccccgggaggtacaacttcgccgggtacatggagctcatggagatggcgcgcaagacggggctcaaggtccaggccgtcatgtccttccaccagtgcggcggcaacgtcggcgactccgtcaccatcccgctgccgcgctgggtcctggaggagatggaggaggaccgggacctctgctacaccgaccagtggggccgccgcaactgcgagtacgtctccctcggctgcgacgccatgcccgtcctcaagggccgcacccccgtcgagtgctacaccgacttcatgcgcgccttccgcgaccacttcgccgactacctcggcaacaccatcgtcgaaatccaagtcggcatgggccccgccggcgagctgcgctacccgtcctacccggagagcaacggcacctggaggttccccggcatcggcgccttccaatgcaacgacaggtacatgcttagcagcctgaaggaggcggcggcggcggccggcaagccggagtggggccacggcgggccgaccgacgccggcagctacaacaactggccggaggacaccatcttcttccgccgcgagaacggcgggtggagcaccgagtacggcgacttcttcctgtcgtggtactcgcggatgctcctggagcacggcgaccgcgtcctcaccggcgcgacgtccgtgttctcggcctcgcccgtcgcgatctccgtgaaggtggccggcatccactggcactacggcacccggtcgcacgcgccggagctcaccgcggggtactacaacacgcggcaccgcgacgggtacctccccatcgcgcggctgctggcgcgccacggcgccgtgctcaacttcacctgcgtggagatgcgggaccacgagcagccgcgggaggcgcagtgcatgcccgaggcgctggtgcggcaggtgggcgccgcggcgcgcgccgccggcgcgggcctggccggcgagaacgcgctcccccggtacgacggcgcggcgcacgaccaggtggtggccacggccgccgagcgcgccgccgaggaccggatggtggccttcacctacctgcgcatgggcgccgacctcttccacccggacaactggcaccggttcgccgccttcgtgcgccgcatgagcggcgccgggtcgtgccgggaggccgcggagcgggaggcgcgcggcgtggcgcaggccaccgggtcgctggtgcgcgaggccgccgtcgcgctgcggagctgaccgcgaccgaatccgatcgccgctttgtctaggggttgggaagggggagctcggggtttgtcgttttggctttccttgggagggaaacgcgctcggatctcgagagcgggcgatctctcgggcaggttacgcgtagacgagattgtgacgaggccgggaggggatgacaaaaaaaaagatgattttttttttgtcacgttacaggctccgacgatcgccggagcttgttgggggaatatgaccatcgcctgcagaaatccgtagaaaccgctgtgtgcttgcacgaaactggctgattcggtgctgcttcaaacagtcttgtttctcctctcatctgcttctgctctgctgcgcgctgttgcttggccggacgataggctgctagaggtcgacggcctgtgtttgagccggccgtaactttcttttggatgtctgtaaatgactacttcaatagaaaggaaaagtgcattcgttccaatggagtctccaatt

SEQ ID NO: 4156 - DNA, 2445 bp, Oryza sativa
tcctcatcgacctccaccccacattgaataattatttttaataattttagttttttttttttggctttagatatattcccaatccccaacctcccaataatccgatctctcccagttctgttcggatcaaggctgtgtcgatcgcaaaaaagaaaaaaaaaacaatttccttttggggtggttcatctgttgatcacttctttgtttcccgcgttttgttggggattcgattttcgggttaagattttctacacgatggccttgaacttggctcagagcgccgcggcggcagcgtgcttcgcgaccgccggtgatgcgcggcgagctgcttcggtggtcgccatgccgtcgtcgtcgtcgtcggccacgacgagcctgaggatgaagaggcaggcggcgtgcgagccggtggcgtgccgggcggtggccaggcacgtggcggcggcggcggcgagcagcaggaggaacggcgtgccggtgttcgtgatgatgccgctggacacggtgagcaagtgcgggagcgcgctgaaccggaggaaggcggtggcggcgagcctggcggcgctgaagagcgccggcgtggaggggatcatggtggacgtgtggtggggcatcgtggagagcgagggccccggccggtacaacttcgacggctacgtggagctcatggagatggcccgcaagaccggcctcaaggtccaggccgtcatgtccttccaccagtgcggcggcaacgtcggcgactccgtcaacatcccgctcccgaggtgggtggtggaggagatggagaaggacaacgacctcgcctacaccgaccaatggggacgccgcaacttcgagtacatctccctcggctgcgacgccatgcccgtcttcaagggccgcacgcccgtcgagtgctacaccgacttcatgcgcgccttccgcgaccacttcgcctccttcctcggcgacaccatcgtcgaaatccaagtcggcatgggccccgccggcgagcttcggtacccgtcctacccggagagcaacggcacctggaggttccccggcatcggcgccttccaatgcaacgacaggtacatgcgtagcagcctgaaggcggcggcggaggcgaggggcaagccggagtggggccacggcgggccgacggacgccggcggctacaacaactggccggaagacacggtgttcttccgcggcgactgcggcgggtggagcaccgagtacggcgagttcttcctgtcgtggtattcgcagatgctgctggagcacggcgagcgcgtgctgtcgggcgcgacgtccgtgttcggcgacggcgccggcgccaagatctcggtcaaggtggccggcatccactggcactacggcacgcggtcgcacgcgccggagctcacggcggggtactacaacacgcggcaccgcgacggctacctcccgatcgcgcgcatgctggcgcgccacggcgccgtgctcaacttcacctgcgtggagatgcgcgaccacgagcagccgcaggaggcgcagtgcatgcccgaggcgctcgtcaggcaggtggccgccgcggcgcgcgcggcgggcgtcgggctcgccggggagaacgcgctgccgcggtacgacggcacggcgcacgaccaggtggtcgccgccgccgccgaccgcgcggcggaggaccggatggtcgccttcacctacctccggatggggcccgacctcttccacccggacaactggcgccggttcgtcgccttcgtccgccgcatgtccgagtctggctcgccgcgggaggccgccgagagcgccgcgcacggcgtcgcgcaggccaccggctcgctcgtgcacgaggccgcggtcgcgctccggagctagcacggtcagacgctcatatacaccgtcgcctcgaggtcggattccgatgtgggatcattcgatctcccttttttttttcttctttttgccattttgtacagccttttggggagctttggatttgtgctttttgtctcgggaggaaaaccgctctggaggtcgaagagagcgtcattttcctcccgttgaagatcacgaatcatttacgttagagatgatgtaattaagcagggaggggaggggaacacacacacactggcactcaaaagttgttgtcacgcttggggaatatatccatttccagccaaaaaaaaaacgcagaaatgcgttgtgttcttgcgctctggttcgttgctgctgtgggtcagattcagctggtgaaaaaactacagtactactgaaactgaaactactagagcctagagggagattaagctaagttaattgcacgagtaattactccacggttgtgtttagggtctacgtcggcagattttgctttctggtagatccctaaccttatgtttgttgggaattttataaaggagctaagtttgcctattgatttgcaatctacacata

SEQ ID NO: 4157 - DNA, 1450 bp, Saccharum officinarum
ctgttactgaacccagaagggtagcgtcatcatcaccttgagactttgagtgctctgctttcgctggagcccgtggtgcacgctcatggaggccgccattcatagtgcctcggaaacaaggattgctgtggtcaccggtgggaacaaagggattgggctagaggtgtgccggcagctggccggcgacggcgccaccgtcgtcttaacagccagggacgagacgaggggcgcagccgctgcagagaagctcagagaagcagggctctccgatgtaattttccaccagctggagatcaccgatgctccgagcatcgctcgactggctgagttcctgaagactcgttttggaaagctagacatcctgataaataatgccgcaattggtgctgttgagtacgtccaagatcctgttgacagttcaacaagcgaggataagttccgtggcatggataagggtcaaaggcttgaatgcatgtttaaaggtgtccgggagacctacgacgctgcaagagaaggcgtgaagaccaactattatggcacaaagcatgtgattgaagccttactgcccctgctgcaagcttcctcagatgggaggattgtcaacgtctcctctgaatttgggcttctaaggctaatcaacaacgaggagctaaggcaggagctgaacgatgtggagaagctcactgaggagaggctggacgaggtgctggccacgcacctaagagacttcgaggccggcgaggtggaggcgcgtgggtggccgatggatttctcggcgtacaaggtggccaaggtggccatgaacgcgtactcgaggatcctagcaagaaagcaccccgaactgtgcatcaattgtgcgcacccaggctacgtcagcactgacatgaccatccacaccggaccactgacgcctgaggaaggcgcgggcaacttggtgaaggtggcactgctgccggaaggcgggccgaccggcgcatacttcgcgttgggagaggaggcgccctttgtgtgacaaagcaccagcgttaacgttaagttcgttgttctccaactgcctcaaagtttactgctggctgctttgtgttctctccatgtcaagtccaaaatgttgtcacacaacgctggtatttttgtcaattgaagtgtacatatcaccggtgtcaaattgaagctacataccacgcaaatggtttttcttcatggcaatatgtatgaaaagcaacactaattaccagcatgacctcacaattgttcatgagaagacatttgatgggtggatcccttcagacataactcaatgctaccttattatgtgtaagattggtcacaactcaaccactattaatttcatttttaaaattatatttcccccttagtcacatgaaccatctaagaccattgataattttaatttttagaattttgcagattaattccaaaaaaaaaatat

SEQ ID NO: 4158 - DNA, 1449 bp, Saccharum officinarum
  misc_feature (32)..(32): n is a, c, g, or t
  misc_feature (63)..(63): n is a, c, g, or t
  misc_feature (73)..(73): n is a, c, g, or t
  misc_feature (1117)..(1117): n is a, c, g, or t
  misc_feature (1135)..(1135): n is a, c, g, or t
ctgttactgaacccagaagggtagcgtcatcntcaccttgagacttgagtgctctgctttcgntggagcccgnggtgcacgctcatggaggccgccattcatagtgcctcggaaacaaggattgctgtggtcaccggtgggaacaaagggattgggctagaggtgtgccggcagctggccggcgacggcgccaccgtcgtcttaacagccagggacgagacgaggggcgcagccgctgcagagaagctcagagaagcagggctctccgatgtaattttccatcagctggagatcaccgatgctccgagcatcgctcgactggctgagttcctgaagactcgttttggaaagctagacatcctgataaataatgccgcaattggtgctgttgagtacgtccaagatcctgttgacagttcaacaagcgaggataagttacgtggcatggataagggtcaaaggcttgaatgcatgtttaaaggtgtccgggagacctacgacgctgcaagagaaggcgccaagaccaactattatggcacaaagcatgtgattgaagccttactgcccctgctgcaagcttcctcagatgggaggatcgtcaatgtctcctctgaatttgggcttctaaggctaatcaacaacgaggagctaaggcaggagctgaacgatgtcgagaagctcaccgaggagaggctggacgaggtgctggccacgtacctaagagacttcgaggccggcgaggtggaggcgcgtgggtggccgatggatttctcggcgtacaaggtggccaaagtggccatgaacgcgtactcgaggatcctagcaagaaagcaccccgaactgtgcatcaattgtgcgcacccaggctacgtcagcactgacatgaccatccacaccggaccactgacgcctgaggaaggcgcgggcaacttggtgaaggtggcactgctgccggaaggcgggccgaccggcgcatacttcgcgttgggagaggaggcgccctttgtgtgacaaagcaccagcgttaacgttaagttcgttgttctccaactgcctcaaagtttactgctggctgctttgtgttctctccatgtcaagtccaaaatgttgtcacacnacgctggtatttttgtcnattgaagtgtacatatcaccggtgtcaaattgaagctacataccacgcaaatggtttttcttcatggcaatatgtatgaaaagcaacactaattaccagcatgacctcacaattgttcatgagaagacatttgatgggtggatcccttcagacataactcaatgctaccttattatgtgtaagattggtcacaactcaaccactattaatttcatttttaaaattatatttcccccttagtcacatgaaccatctaagaccattgataattttaatttttagaattttgcagattaattccaaaaaaaaaatat

SEQ ID NO: 4159 - DNA, 1282 bp, Zea mays
cgacacgactgcacgaggacgaaaaaaaaaatatccggacatccggtcacggttgccattcttttcctgtaaccgaaccctgaagggtagcgtcatcatccagaccaccattaccagagtgctctgctctcgctggaggccgtggttcattcacgttcatggaggccgccgccattcccaccagtgccccggaaaccaggattgccgttgtcaccggcggcaacaaagggatcgggctagaggtgtgccggcagctggccggcgccggcgccaccgtcgtcgtcttaacagccagggacgagacgaggggtgcagccgctgcacaagagctcagagaatctgggctctccgatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacagttcaacgagcgaggaagagctgagtggcatggatatggtccaaaggcttcagtgcatgcttaagagagtccgggagacctacgacgctgcgacagaaggcatcaagacaaactactatggcataaagcatgtgatcgaagccttgctgcctctgcttcaagcttcctccgatgggaggatcgttaacgtctcctctgacttcggactgctaaggctgatcaacaacgaggaagctaaggcaggagctaaacgacgtggagaagctcaccgaggagaggctggacgaggtgctggccgcgtacctgagagacttcgacgccggcgaggtgggggcgcgcgggtggccggtggacttctcggcctacaaggtggccaaggtggccatgaacgcgtacacgaggatcctagcgaggagccacccggggctgcgcgtcaactgcgcgcaccccggctacgtgagcaccgacatgaccgtccacaccgggcctctcacgcccgagcaaggcgcggccaacgtcgtgaaggtggcgctgctgccggagggcggcccgaccggcgcgtacttcgcgttgggagaggaggcgtcctttatgtgacgaaagcaccgtcgtcgttaagttcgtcgttgttcgccaactccctgttagtcgatttctaaatcgacgtacaatgaaatacatcatcgctgcaaactcacaaatgaaaacaagggaaccttgtagcaaaaaaaaaaagaagtggacagaataatgaataagcatgtcaaatatctcttgagtatct

SEQ ID NO: 4160 - DNA, 2079 bp, Zea mays
aggattgccgttgtcaccggcggcaacaaagggatcgggctagaggtgtgccggcagctggccggcgccggcgccaccgtcgtcgtcttaacagccagggacgagacgaggggtgcagccgctgcacaagagctcagagaatctgggctctccgatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacagttcaacgagcgaggaagagctgagtggcatggatatggtccaaaggcttcagtgcatgcttaagagagtccgggagacctacgacgctgcgacagaaggcatcaagacaaactactatggcataaagcatgtgatcgaagccttgctgcctctgcttcaagcttcctccgatgggaggatcgttaacgtctcctctgacttcggactgctaaggctgatcaacaacgaggaagctaaggcaggagctaaacgacgtggagaagctcaccgaggagaggctggacgaggtgctggccgcgtacctgagagacttcgacgccggcgaggtgggggcgcgcgggtggccggtggacttctcggcctacaaggtggccaaggtggccatgaacgcgtacacgaggatcctagcgaggagccacccggggctgcgcgtcaactgcgcgcaccccggctacgtgagcaccgacatgaccgtccacaccgggcctctcacgcccgagcaaggcgcggccaacgtcgtgaaggtggcgctgctgccggagggcggcccgaccggcgcgtacttcgcgttgggagaggaggcgtcctttatggtcgccgttgtcaccggcgggaacaaagggatcgggctggaggtgtgcaggcagctggccagcaacggcatcaccgtcgtcctaacagccagagacgagaagcggggcgccgccgccgtagaggagctcgcggacgcgggcctctccggcgtcgttttccatcagctggaggtcaccgacgcccagagcattgctagattggccggtttcctgaaggcgtggtttgggaagctagacatcctgattccgttcctttccttcgaccaacgccagcagctgctgctgctggatctgaaacaaagaatgcagtatctcaggaatgaggaggtgaagcatgagctggacgacattgagggcctgacggaggagaggttggacgagctgctgagcacgttcctccgggacttcgaggccggcgcgctgaagcccgcggctggccgacggagttcgccgcgtacaaggtggccaaggccgccctgaactcctactcgagggtcctggcgaggcggcaccccgagctgcgcgtcaactgcgcgcacccgggctacgtcaagaccgacatgaccaggcagacgggcctgctgaagcccgcgcagggcgcggccaacgtcgtcaaggtggcgctgctcccggaaggcggccccaccggagctttcttcgcgctaggcaaggaggcgccgttcgtgtgacgctgccgtactgggctggcgcctggcggtgggttcacggtccggcgctaatgcgccgcctctccgacttgcctggcgcctgctatctactatctactactccgcctctctgtgctgcgcagcgtaatttgctggtttgggtcggcgaataaagaaaggattgctgctgcctcttagttagttgggttctgttagtactaagcttcggtaataaaataaaatccccccagatagatatggccatattgtgatccactgttggatagtagtgtgtttgctaatttgggttaagccggtgcagagttttcgcccgtaccagtgacagtgagggtcagtaggcattggtgctcaacggccgcgattgttcgcagtgataggcggagtgccgtgacgaactggtcgcaaatttgctgccgcacgcgggtcgtcgcatactgccagcggtgagccggtggaactcacagataacagtgggaatccgattctcaatttctc

SEQ ID NO: 4161 - DNA, 1272 bp, Panicum virgatum
gatcacaacgtgtgatcaccgtcagcatctgccgtactacgccatttcctgggcgctctcctttcgctcgagcttgcagtgaaggtcacagagatggagggcgctatccccaatccccccaacgcaaggattgcggtggtcaccggcgggaacaaagggatcgggctggaggtgtgccggcagctcgccggcgccggcgtcaccgtcgtcttgacggccagggacgagacgaggggcgcagccgccgtggagaagctcagagaagcagggctctccgatgtcatgttccatcagctggacatcaccgacgctccgagcatcgctcggttggctgatttcttgaaggctcgtttcgggaagcttgacatccttataaataatgctgcaatcgttggtgttgagtacctcctagatccttttgatagttcaccgaccagcgaggaaaagttcagtggcatggataagcgtcagaggattgagtggctgaccagtgttgtccgggggacctacgacgctgccagagaaggcttgcagacaaactactacggtaccaagcatgttatcgaagccttactgccgctgctgcaagcctcatccgatgggagaatcgttaatgtctcatccgaatgggggctgctaaggctaatcaacaatgaggagctgaagcaggagctgaacgatgtcgagaagctcaccgaggcgaggctggacgaggtgctggacacgttcctgaacgacttcaaggccggcgagctggaggcgcgcgggtggccggagcatttctcggcgtacaaggtgtccaaggtgaccatgaacgcgtactcgaggatcctggcgaggcggcaccccgagctgcgcgtcaactgcgcgcatcccggctacgtgaacaccgacatgaccatccactccgggcccctgacgcccgaggaaggcgccgccaacgtggtgaaggtggcgctgctgccggaagccggggtcaccggcgccttctttgaagacggcgaggaggcgccgttcgtgtgacgctcacactgcacacctacacgggcacggccgatcggcagttcggcaccggccccgttgttcgccgtcctactccaactgcctgctatcatcgtgcaacggaaataagctgctggatctttagttcctctccatgtcgaagtccaaaattgttggcactttaatttgtcgacggaagtgtacttgttactttgaattactccagcttaactcaagtaaacaattcacggaagatgtgttagttttttt

SEQ ID NO: 4162 - DNA, 1879 bp, Zea mays
tcctctttctgctaaaaaaaaatactctcctatactatactagtgccaaattgcttctgcattctcttcccttcctgcatttcctcctctgtctcatcggggacccctgtccctcgtggcgacggccggtcgaccgccgctgccgaggacttcgccggcgacgaccacccccacgcccactacattatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagccaagaacaaagagaaaaacacacaacagtaatgggtcacgaccatatgtctcgtataaagatgcatatggcagaaggttcttttggtgacaggatccggtgccagcaacctgggtgcaatgaggttgtcgatagaagggtagtgtactgcaaaattcacagtggagagttgtcatgccaacagttcagttacctccagagcggactggagagctcaggtttatctgtgcgccctgttaacgacagccaatttaagggatctgtttccattgcagcagtgccatgcactgagcaagagttacatgtcaagcatgaaggtggtgatcgaggtaaactaaaggatagttctgggtacactttgggtcaggctgcacaatttatcttctctggggcaagcatgctttgcaagaacgataactgcagcaagcaagcacacgagaactcaatccactgtaagttgcatagcggcggcgttaacaagggctgcatggcacggggctgtacaagaggtgcgcatggaggcacgcctttgtgcattgggcacggaggtgggaggcggtgtgtggtccctggatgcccaaatgcagcatgtggccaaggccgtagcgaccgctgcgtgaggcacggtggcggcaagagatgtaaattcgaagggtgcgcgaagggcgcgcaagggaacaccgatcactgcataaggcacggtgggggaaggcggtgcaggttccaaggatgtacaaagagtgcgcagggacgcacagatttctgcatcaagcatggtgggggcagccggtgcaggttccaagggtgtggcgcgagcgcaaaatggggaacggatttgtgctctgtgcacaggaagagcctgttgggcggtgacaatgccatccctgaagctttggccgccccttcagaaaaacgacgccgggccaagacgccccaaagggaagcgaagccgtccgaggtcttccaagagaatgtcacaacagcagctactgctggtaacagcacacagcacacgggcttccttctcgtagctgcccctgttgctaaccgtgacatactgaccaatggtatggcagtgacggggcaagctgcaatagccccccaacggatagtggcaccgatgttcatgagatcaccaacgccatctggatcagtggctgcctcggcacagaggtgggaggcgggagcaagcaggggtatgctgggtctgtagaaaggtggtataatttgggaaggcttggagacaccttgcccaagatagttctctgattattggctttcagactgagaaacctctgaaacttgacagccttgtgccgtcaacggactctagtgatgtcctgtgcagctgtgctctctcatttgtattgtaaattgtaatgcaaatctctagttgttcttgtgtatgttctcttgtcgccttgtagtagcgtggaaaccggtcgggggaccatctggaactttggatgataagcaataatattgtgtcatggcctagctttgcaggtccagttggacttttttaagtagtggacatttt

SEQ ID NO: 4163 - DNA, 1728 bp, Zea mays
aagccgaagctgcccttgcccactcttcttctcctctcccccctctttctactaaaaaaatactcctccccacactaaactagtgccaaattgcttccgcattccctccctgcattcccctcctccgagtatccgacccatcggcggtcctctccctcgtggcgacggccgctccaccgccgctgccgagtgggtcttggccggcgacgaccgcccaccggatacagcagcaggactagtagccaagaacaaagaggctagctagcggtgataaagttttcataggtgtatgtttgggagccttatttggatcctgaaaaacacacaacaataatggggcacgaccatatgtctcgtataaagatgcatatggcagaaggttcttttggtgacaggaaccggtgccagcaacctgggtgcaatgaggttgtcgatggaagggtagtgtactgcaaaactcacagcggagagttgtcatgccaacagttcagtcacctccagagcggactggagagctcagcagtaccatgcactgagcaagagttacatgtcaagcacgaaggggatgatcgaggtaaactaaaggatagttctgggtacactttgggtcagactgcacaatttgtcttccctggggcaggcatgttttgcaagaacgatagctgcagcaagcaagcacatgagaactcaatctactgtaagttgcatagcggtgttagcaagggctgcatggtccgaggctgtacaagaggtgcacatggaggcacacctctgtgcattgggcatggaggcgggaaacggtgtgtgatccctggatgcccaaatgccgcgtgtggtcaaggcctcagtgaccgctgtgtgaggcatggtggtggcaggagatgtagattcgaagggtgtgcgaagggcgcacaggggaacaccgattactgcataaggcacggtgggggaaggcggtgcaagtttgaaggttgcacgaagagtgcgcagggacggacagatttctgcattaagcatggtggtggcagccggtgcaagttccaaggatgcggcacgagcgcaaaatggggaacagatttctgctctatccacaggaaggctttgttgggaggcgacaatgccgccgtccctgaagctttgcctgccgcttcagaaaaacgacgtcgtgccaagaagcccaagaaggcggcgaaactgtctgaggcctcccaagagaatgccacagcagcagcagctattgctggtaacagcactcaacatatgggcggtcttctcatagctatccctgttgctaaccgtgacatgttaaccaaagccgtggcagcgacggggcaagctgcaatagcctccgcacagatagtggcgccgctgtccatgaaatcgccgacgccatctggagcagcggcggctaccttgactgggagggaggcgggagcaagcagggagatgctgggtctgtagaaagatggtggcagtgcataattcgggaggcttggcgacaccccttgcccagatagttctctgattattgccttctttttagactgagaaaaacctcgaaactttaggagggttgtgcattttgacagactcgggccgtcgactgactctagtgatgttctgtgcctttctcgtttgtaaattgcaatgttctcgtgtattttctcttgtgaccatttggacagtaagcaataatattggtgttctaatctcagaccattatttgtg

SEQ ID NO: 4164 - DNA, 1755 bp, Panicum virgatum
atgcgtcgtccgcctgcaagtggcaaagctcaaagactaaaatactgttgccgactatagaaattgcatcctcattcctgcctttacccttcccactcctcgcccatccgctcctccgtcaacacctcggaggccgccgctgccgcggccgcggccgcatccggtgtccagtcaccctgcctccctgtcttgagaaagactacatttatggggcatgaccatatgtctcgcataaagatgcatatggcagaaggttcacttgttgacaggaaccgttgccagcaacctgggtgcaacgaggttgtcgatggaagggtactgtattgcaaaattcacagcggggggctgtcgtgccaacaatacaatcaccttcagagtgcacagggaagttctggtttattggtgtctcctgttaacgacagccaatttaatagacctgtttccagtgcagtgacatgcactgagcaagaaatgcacgtcaagcatgaaggggatgatcgcggtaaactgaaggatagttttgggaacactcagggtcagactacacagttggtctttcgtggggcaggcaggctttgtaagcatgaaagctgcagcaagcaggcgcaggagaactcaatctactgcaagttacatagtggtgttagcaagggctgcatggtacggggctgtgcaagaggcgcacatggaggcacacctttatgcattggccatggaggagggaagcggtgcattatccctggatgtccaaatgcagcatgtggccaaggccgtagtgaccgctgcataaggcatggtggtggcaagagatgcaaatttgaagggtgtgcaaagggtgcacaagggaacacagattactgtatcaggcatggtgggggaaggcggtgcaaattcgaaggatgtacaaagagtgcacaaggacggacagatttctgcattaagcatggtgggggcagtcggtgcaagttccaaggatgtggtacgagtgcgaaatgggggacatatttctgttcagtacacaggaagagtctattgagtagtgataatgctattcctgaggctttgccagcctcttcagaaaagcgacgccgagccaagaaacccaaaaaggcagtcaagccgtatgaaccctcgcaagagagtgtcaccacagcaggtattgctggtagcagcacacagcagatgggtgttcttctcgtagctaccccggttaccaaccatgacatattaactaagggtgtaacagtgacggcacgagctgcaatagctcccccacagatagtagcgccgctatccctgaaatcaccaacagcatctggatctgttgcttcagtggagagggaggcaggagcaagcagggcaatgttgggtctgtagaaatatggtggcagtgcataatttgggaagcttgcacaaatattgtcaaactcgtcctttgattattgctttcgcctgagaaacgtcgaaactttaggagctgttcatattaacaggttctctacgacaactgactctagtgatgtcctgtggctttacaatttgtcctatgaaactctagatgttcttgtgtatgttctcttgtgccttgtagcatggaaaccggtaagcggaccatacggaactgtggacaataagtaagaatactgcatcattgtctagtttgtgttcggtgtactgtactgtccgggtgtagaggttgatttctgcttatgtgatactagtaatggtgaaaatggtacagaatactttccgatc

SEQ ID NO: 4165 - DNA, 1423 bp, Saccharum officinarum
  misc_feature (544)..(544): n is a, c, g, or t
  misc_feature (622)..(622): n is a, c, g, or t
  misc_feature (1278)..(1278): n is a, c, g, or t
  misc_feature (1291)..(1291): n is a, c, g, or t
  misc_feature (1295)..(1295): n is a, c, g, or t
caggacacagagccgagccacccaccatcgacgagcgccagccgccggagcgagcatttttacgcagcgggccggagaaaggaagcaggcagccaaacccaccaccacttttaccgaccgaccgatcggtgttgccgccgcctgtcgggttcattcatcgccacgccagcaaccagaccaagccatgggactgccggtgaggagggagagggacgcggaggcggagctgaacctgccgccggggttccggttccaccccaccgacgacgagctggtggagcactacctgtgccggaaggcggcggggcagcgcctcccggtccccatcatcgccgaggtggacctctacaagttcgacccctggaacctgccggagcgcgcgctcttcggggtcagggagtggtacttcttcacgcccagggaccgcaagtaccccaacgggtcccgccccaaccgcgccgccggcaacggctactggaaggccaccggcgccgacaagcccgtcgcgccgcgggggcgcacgctcgggatcaagaaggcgctngtcttctacgccggaaaggcgccgcgcggggtcaagacggactggatcatgcacgagtacaggctcgcggacgccggncgcgccgccgccgccaagaagggatcgctcaggctggatgactgggtgctgtgccgcctgtacaacaagaagaacgagtgggagaagatgcagctggggaaggagtccgccgccggcgtcggcacaaccaaggaggaggcgatggacatgaccacctcgcactcgcactcccactcgcagtcccactcgcactcgtggggcgagacgcgcacgccggagtcggagatcgtggacaacgacccgttcccggagctggactcgttcccggcgttccaggacccagcggcagcgatgatgatggtacccaagaaggagcaggtggacgacggcagcgccgccgccaacgccgccaagagcagcgacctgttcgtggacctcagctacgacgacatccagggcatgtacagcggcctcgacatgctgccgccgcccggggaggacttctactcctcgctcttcgcgtcgcccagggtcaaggggaaccagcccggcggagccgccgggttgggacccttctgagctgaggcggagatggaggcatggagccatggatcaggagaagacggcgttgtaaggttgcgaactctgtaaatagatacagcatacgagtcgaacctgaacctgaacctgaacctgaactgatcggggttcagggntaagggtgtcggngtancgtacatggcacatggggccggcccaatggtggcgcggctaatctttaatttcacttttacgcttatatggggactggtcacttccttttcttttcacagaaccgatgaattttcttttaaaaaaaaa

SEQ ID NO: 4166 - DNA, 2361 bp, Panicum virgatum
aatccacaggacacagccagagctcgctctcaaccagcagcagcagccggagctgaggagagcgttgcggtttcagagtgggagggagaaatcaaggagccagcttcagtctgccgatcaattgcagcttcatcttcgccggccgatcagcgatcgccatgggagtgccggtgaggagggagagggacgcggaggcggagctgaacctcccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaacggctcgcgccccaaccgcgccgccgggaacggctactggaaggccaccggcaccgacaagcccgtcgctccgcgggggcgcacgctggggatcaagaaggcgctcgtgttctacgccggcaaggcgccgcgcggggtcaagaccgactggatcatgcacgagtacaggctcgccgacgccggccgcgccgccgcagccaagaaggggtcgctcaggttggatgactgggtgctgtgccgcctgtacaacaagaagaacgagtgggagaagatgcagctggggaaggagtccgccgccggcgccgtggccaaggaggaggccatggacatgaccacctcccactcgcactcgcagtcccactcgcactcgtggggcgagacgcgcacgccggagtcggagatcgtggacaacgaccccttcccggagctggactcgttcccggcgttccaggaccccgcggcggcgatgatggtgcccaagaaggagccgcaggcggacgacggcaacaacaacgccgccaagaacagcgacctgttcgtggacctcagctatgacgacattcagagcatgtacagcgggctcgacatgctgccgccgcccggggaggacttctactcgtcgctcttcgcgtcgccgagggtcaaggggaaccaacccgcgggcgccgcggggttggccccgttctgagaatctgagctgacgcggcacggcaaccatgcgaggatggtggatggccgacgaggagaggagacgacgccgcaaggctgcggcggcgacctctgtaaatacagcgaaggagtcgaagaagaacctgaacctgaacctggtcgtggttgcagggttaagagtgtcggtgtagcgtacatggagccggccctggtggtggcgcccggctcattctttcgttttcacctttcgctgcagacggtagatactcgatcgtactatatgtgtagctctttcctcctcttcaacagaaccgacgaaattttgctgttcctgtttacaaccaccgtgcctgagccctgctctccctatttcctctaatgttgaggaatgttgagtaatttattctgtctgtgatgagtgaattgtcaaccgtgcggtgtgatcgtgcgcttggtctttggattgcaggtacacgggcgtcgagtgtcgacggagagttgccgtggaggagctcaggcccgggcggcagctgtggcgtccactcctggatcgagggcgcaagcggcgacggaaggcgggtttcttggtttgcgccacaaaaccaaggaggcggacggcggttgaagacgccaagtcgtggaggcacgggcgtcggtctcgggactgacggaggcgacgggcgtcgacggcgtctagggcctcgctgcgggcgaggaggtgacgggcgtcgggcggcgtctagggccgtcagaaggccgaggcgggaacggcgtctagggccacggcgtggaggcgggaatcttcccgcgcgtgaggttttggcggttttctcaaaaccggccacctacccgggtttcgcggaccctccaaaaccgcggactggatcttcatcaagacggcggcatcgcggagaagacttcgtttcgaagaaagaacctcggccgtcggatgagatcgtgtacagggggtgctgcaggtcaaccggtctgaccggtccctggcaccggtctgaccggtctaaccaaccggtctgaccgacagcgtaccggtctgaccggtcccgcgggtataaataccccttcacttgtgttaggttaatagcggcttttgtaatctgttcgtggactctctgtttctccaggccgccgcccctgtgttcctctccctctgttcctctcgtttgagttgattttgtccatggattgttgaaaccttgtaagggatttaattgggaaaggaggccctatcctcctcgtgccctctgggcttttgattcgat

SEQ ID NO: 4167 - DNA, 1424 bp, Panicum virgatum
gaatccacaggacacagccagagctctctctcaaccaccagcagcagccggagctgaggagagcgttgcggtttcagagtgggagggagaaatcaaggagccagcttgatcaattgcagcttcagctttgccggccgatcagcgatcgccatgggagtgccggtgaggagggagagggacgcggaggcggagctgaacctgccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaacggctcgcgccccaaccgcgccgccgggaacggctactggaaggccaccggcgccgacaagcccgtcgcgccgcgggggcgcacgctggggatcaagaaggcgctcgtgttctacgccggcaaggcgccgcgcggggtcaagaccgactggatcatgcacgagtacaggctggccgacgccggccgcgccgccgcggccaagaagggatcgctcaggttggatgactgggtgctgtgccgcctgtacaacaagaagaacgagtgggagaagatgcagctggggaagacggagtccgccgccggcgccgtgcccaaggaggaggctatggacatgaccacctcccactcgcactcgcagtcccactcgcactcgtggggcgagacgcgcacgccggagtcggagatcgtggacaacgaccccttcccggagctggactcgttcccggcgttccaggaccccgcggcggcgatgatggtgcccaagaaggagccgcacgcggacgacggcaacaacaacaacgccgccgccaagaacagcaacctgttcgtggacctcagctacgacgacatccagagcatgtacagcgggctcgacatgctgccgccgcccggggaggacttctactcgtcgctcttcgcgtcgccgagggtcaaggggaaccagcccgcgggcgccgctgggttggccccgttctgagaatctgagctgacgcggcacggcaaccatgtgaggatggtggatgatggccgacgaggagaggagacggcgccccaaggctgcggcggcgacctctgtaaatacagcgtaggagtcgaagaagaacctgaaccacggaacctgatcggggtcgcagggttaagagtgtcggtgtagcgtacatggagccggccccggtgggtggcgccaggctcattcttttgttttcacctttcacctgagacgatagatactcgatcgtatatgtgtagctctttcctcttcaacagaaccgacgaaattttgctgttcctctttacaac

SEQ ID NO: 4168 - DNA, 1703 bp, Zea mays
ctctcctgcgcgcggttctcagcttcgacaacaccgcgcgcgcaatacacgggacacacacgcagatccgagctaaccaccatcgacgagcgccagccgccagcagccgagccggagcgaccttttcttttttcttttacacagcgggacagagaaaggagtcaggcagccaaagccacccaccgcttttacccaccgatcggcgttgccgccgctagcattgtcggcttcagctccatccaaatccaccgccagcaagcaagccgcggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaaggccaccggcgccgacaagcccgtcgcgccgcgcggccgcacgctcgggatcaagaaggcgctcgtcttctacgccggcaaggcgccgcgcggggtcaagacggactggatcatgcacgagtacaggctcgccgacgccggccgcgccgccgccgccaagaaggggtcgcttaggttggatgactgggtgctgtgccggctgtacaataagaagaacgagtgggagaagatgcagctggggaaggccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccaaagcagacgggtagatatatgtgtagctgttcacttaaactctcttcgacagaacaaccgacgaaattttgctcttgtttataagtactacctcgactgtcgcttccctttgtctgtctcttccctaccctgtgttgtatacttgtattggcatgcttgcagcgaccacggggacagcggcgggctcaggcctagatgtgtcaacagagatccgatacccgataattttcgaagattttaatctccatgtacagatctggaagaaattcttctccattggatatgaatatgtgtacgaagattttaatc

SEQ ID NO: 4169 - DNA, 1279 bp, Oryza sativa
cattcgagaaatccctcacaacccacaacattttcaaacaacgcaaagcagtagcagcagcgagaagcaagcaagaagcgatggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgccgccgccgccaccatccccaggaacaacagcagcctgttcgtggacctgagctacgacgatatccagggcatgtacagcggcctcgacatgctgccgccgggcgacgacttctactcgtcgctcttcgcgtcgccgcgggtgaaggggacgacgccacgcgccggcgccggcatgggcatggtcccgttctgaggtgacggcgacgcgatcgaacaggtggtgatcgatgctgcaacgtgtgtaaatatacagcgccggctgggtcaagagatggctcgggtgacgcgcgcgcggcgtgtcctggcgttggcgccggggcattctttagtttttcatcttttcatcatctcagatggtagatacaaaacagtgtatgtatgtagctctgtttctctctatagaaccccaacaaattttgttgttgatgttgtttatcttca

SEQ ID NO: 4170 - DNA, 1737 bp, Zea mays
aatgacagcgcagaacccgcccacaggacaggacacacagagccgagccaccccacccaccatcggcgaccagcagccagccgcgggagcgagctgtttaaagacaccgagtcggagtcggacggaggactggcaggcacaaccgaagccaccgcttctagttctcgggttcatcgccagcaatccagaccacataatgggacagccggtgacgaggaggagggagagggacgcggaggcggagctggacctgccgccggggttccggttccaccccacagacgacgagctggtggagcactacctgtgccgcaaggcggcggggcagcgcctccccgtgcccatcatcgccgaggtggacctgtacaggttcgacccgtgggacctgccggagcgcgcgctcttcggggcccgggagtggtacttcttcacgcccagggaccgcaagtaccccaacggctcccgccccaaccgcgccgccggcgacgggtactggaaggccaccggcgccgacaagcccgtcgcgccgcgcgccgccgccgccgacgcccgcacgctcgggatcaagaaggcgctcgtcttctacgccggcaaggcgccgcgcggggtcaagacagactggatcatgcacgagtacaggctcgctgacgccggccgccgcgccaagaaggggtcgctcaggttggatgactgggtgctgtgccggctgtacaacaagaagaacgagtgggagaagatgcggctggggaagggggcagccgccggcgcagtcaaagaggaggaggccatggacatgagcacctcccactcgcagatcacccactcgtggggcgagacgcgcacgccggagtcggagatcgtggacaacgacctgccgttcccggatccggcgatgatggtgcccaagaaggagcgggtggacgacggcggcagcgccaggaccagcgacctgttcgtggatctcagctacgacgacatccaaggcatgtacagcggcctcgacatgctgccgccggccggcgaggacttgtactcctcgctcttcgcgtcgcccagggtcagggggaaccagcccaccggacccgcggggttgggccccttctgagtgagctcaggcgaggatggaggcatggagatcaggagagaagacggacggcgttgccaactctgtaaatacagcataggacgaggagtcgaacctgactgaacctggtcggggttacaagtcgagtgtgtcggtgtttcgtacatgggaaccgggccttacatgggagccggcccggtcttggtttggcgctggctcattctttagtttcacttcctgcgcagacggtagatgtgtatgcatagctgttcactatcacttcctcttcaacagaaccgattcactccgaatggcaatgtttgaagtgaatccagcgaacggaaaaggttaggttctgtcgtgcgtgcaacgtggtggtagactggtagtcttccaatgcagcaggcatagagacacgtggtaccctaaaagtgcagcaagatagtttaagttcaagctaaaaattaatactttttcagcagaaagtgcagcagaggggatattattgaaccacaaccatgacacacctaaacgaacaaatttcttaaaaaaagtttcacatggagctcgtttgactgcactattagactttattttgctattcccattatatatgggttcccattatatatggaatatagtgggttagtagg

SEQ ID NO: 4171 - DNA, 773 bp, Saccharum officinarum
  misc_feature (725)..(725): n is a, c, g, or t
ggccgcgcgtcccgcgccgccgccgcaggtcctcactgctcgccgcgcgttgcaatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgccttgtcaacttcatggagggcaaggagaaccaaattgctgtgattgtgggcactgtgactgacgacaagagggtgtatgaggtaccagcaatgaaggtggctgcgctcaggttcactgagacagcaagggcccggattgcgaacgcgggtggcgagtgcctcacctttgaccagcttgcactgcgtgccccactgggccagaacacggttctgctgaggggacctaagaatgctagggaagctgtgaagcactttggccctgcgcctggtgtgccgcacagccacacgaagccttacgtgcgctccaagggaaggaagtttgagaaggcaagaggaaggaggaacagcagaggcttcaaggtctaggttgtcgccatatttatgtattctgatctggttgaccatcttgtttgtcacaccattttaaggacaaaaccagatatacactatatgtgaaataaagaggtcaaatntcacatatagctgcagttaagtgtaatatcaaaagacaaatgcttatt

SEQ ID NO: 4172 - DNA, 761 bp, Saccharum officinarum
cgcgccgccgccgcaggtcctcactgctcgccgcgcgttgcaatgggtatcgacctagtcgccggcggccggaacaagaagaccaagcgcaccgcgcccaagtccgacgatgtctacctcaagctcctcgtcaagctgtaccgcttccttgttcggaggaccaagagcaacttcaacgctgtgatcctgaagcggctcttcatgagcaagaccaaccgcccgcctctctcgctccgccgccttgtcaacttcatggagggcaaggagaaccaaattgctgtgattgtgggcactgtgactgacgacaagagggtgtatgaggtaccagcaatgaaggtggctgcgctcaggttcactgagacagcaagggcccggattgcgaacgcgggtggcgagtgcctcacctttgaccagcttgcactgcgtgccccactgggccagaacacggttctgctgaggggacctaagaatgctagggaagctgtgaagcactttggccctgcgcctggtgtgccgcacagccacacgaagccttacgtgcgctccaagggaaggaagtttgagaaggcaagaggaaggaggaacagcagaggcttcaaggtctaggttgtcgccatatttatgtattctgatctggttgaccatcttgtttgtcacaccattttaaggacaaaaccagatatacactatatgtgaaataaagaggtcaaatttcacatatagctgcagttaagtgtaatatcaaaagacaaatgcttatt

SEQ ID NO: 4173 - DNA, 639 bp, Saccharum officinarum
  misc_feature (94)..(94): n is a, c, g, or t
  misc_feature (109)..(109): n is a, c, g, or t
  misc_feature (112)..(113): n is a, c, g, or t
  misc_feature (118)..(118): n is a, c, g, or t
  misc_feature (319)..(319): n is a, c, g, or t
  misc_feature (451)..(451): n is a, c, g, or t
  misc_feature (460)..(460): n is a, c, g, or t
  misc_feature (463)..(463): n is a, c, g, or t
  misc_feature (466)..(466): n is a, c, g, or t
  misc_feature (484)..(484): n is a, c, g, or t
  misc_feature (493)..(493): n is a, c, g, or t
  misc_feature (496)..(496): n is a, c, g, or t
  misc_feature (502)..(502): n is a, c, g, or t
  misc_feature (591)..(591): n is a, c, g, or t
gggtatcgacctagtcgccggcggccggaacaagaagaccaagcgcaccgcgcccaagtccgacgatgtctacctcaagctcctcgtcaagctntaccgcttccttgtncgnnggacnaagagcaacttcaacgctgtgatcctgaagcggctcttcatgagcaagaccaaccgcccgcctctctcgctccgccgccttgtcaacttcatggagggcaaggagaaccaaattgctgtgattgtgggcactgtgactgacgacaagagggtgtatgaggtaccagcaatgaaggtggctgcgctcaggttcactgagacngcaagggcccggattgcgaacgcgggtggcgagtgcctcacctttgaccagcttgcgctgcgtgccccactgggccagaacacggttctgctgaggggacctaagaatgccagggaagctgtgaagcacttnggccctgcnccnggngtgccacacagccacacnaagccttangtncgctcnaagggaaggaagtttgagaaggcaagaggaaggaggaacagcagaggcttcaaggtctaggttgtcgccatatttatgtattctgatcnggtaagggaaggaagtttgagaaggcaagaggaaggaggaacagcaga

SEQ ID NO: 4174 - DNA, 876 bp, Panicum virgatum
aaccgcccctccgccgcccctccgccgccgccgcaggccgctcgccgctcgcgccatgggtatcgatctcgtcgccggcggccggaacaagaagaccaagcgcaccgcgcccaagtccgacgatgtctacctcaagctcctcgtcaagctgtaccgcttcctggttcgcaggaccaagagcgacttcaacgccgtgatcctgaagcggctcttcatgagcaagaccaaccgcccgccgctctcgctacgccgcctcgtcaaattcatggagggcaaggagaaccagattgctgtgatcgtgggcagcgtgaccgacgacaagagggtctacgaggtcccagcgatgaaggtggctgcgctcaggttcactgagacggcgagagcccggatcgtgaatgctggtggcgagtgcctcacctttgaccagctggcgctccgtgcgcctctgggccagaacacggttctgctgaggggacctaagaatgctagggaagctgtgaaacactttggcccagcacctggtgtgcctcacagccataccaagccatacgttcgctctaagggaaggaagtttgagaaggcaagaggaaggaggaacagcagaggcttcaaggtctaagttgtcgtgtctcatccatgtggtctcacctagtggactaaataggttttgcttgagcctgagttctgtgttattacctcagttcaagacttttgagggctatgttatttgtataccggttccaggatctgctcaattttgccctgaatttgcgttttgtattggaatttgcaagtgtttttggcagtattatgcactagatgcactataatctttcttaacgacatcgaagcgcagctaattgatacttaattgct

SEQ ID NO: 4175 - DNA, 795 bp, Panicum virgatum
ccgccgccgcagccgcaggccgctcgccgctcgcgccatgggtatcgacctcgtcgccggcggccggaataagaagaccaagcgcaccgctcccaagtccgacgatgtctacctcaagctcctcgtcaagctgtaccgcttcctggttcgcaggaccaagagcgacttcaacgccgtgatcctgaagcgtctcttcatgagcaagaccaaccaaccgccgctctcgctccgccgcctcgtcaagttcatggagggcaaggagaaccagattgctgtgatcgtgggcaccgtgaccgacgacaagagggtctacgaggtgccggcgatgaaggtggctgcgctcaggttcactgagacggcgagggcccggatcgtgaatgctggcggcgagtgcctcacctttgaccagctggcgctccgtgcgcctctgggccagaacacggttctgctgaggggacctaagaatgctagggaagctgtgaaacactttggcccagcgcctggtgtgcctcacagccacaccaagccatatgtccgctctaagggaaggaagtttgagaaggcaagaggaaggaggaacagcagaggcttcaaggtttaagttgccgtgtcttatccatttggtctcacctagtgggctaaataggtcttgcttgagcctgagttctatgttaatgttattacctcagttcaagtcttttgagggctatgttatttgtataccagttccaggatctgctcaattttgtcctgaatctgcgttttgtattggaatttgcaagtgtcttttggcag

SEQ ID NO: 4176 - DNA, 784 bp, Oryza sativa
caaaaccctagaagaaatcacctccccctccgccgccgcacgccgccgccatgggtatcgacctcgtcgccggcggccggaacaagaagaccaagcgcacggcgcccaagtccgacgatgtctacctcaagctcatcgtcaagctctaccgcttcctggtgcggaggaccaagagccccttcaacgccgtgatcctgaggcggctcttcatgagcaagaccaaccgcccgccgctctcgctccgccgcctcgtcaggttcatggagggcaaggagaaccagatcgccgtgatcgtgggcaccgttaccgacgacaagagggtctacgaggtgccggcgatgaaggtggccgcgctcaggttcaccgagaccgcgagggctcgcattgtgaatactggtggagagtgccttaccttcgatcagctggcgctccgcgctcctctgggccagaacacggttctcctgaggggtcctaagaacgccagggaagcagtgaagcactttggtcctgctcctggagtgccacacagcaacaccaagccttacgtgcgctcaaagggaaggaagtttgagaaggcgagaggaaggaggaacagcaaaggcttcaaggtctaagttatcgcctgctattcgtgtggttgcactgaatgggctacatagctcttgtttgagtttcagagttcttgtgttgttattactcaagtgccaggatcagctaaattttgttcgaatgttatgcactttgaatcagagaattacaagcgttggcagcacgttaggcctct

SEQ ID NO: 4177 - DNA, 822 bp, Brachypodium distachyon
aaccctagaacactcccctcctccgccgccgcgcagctgcttcaccgccgcgcaccaccatgggaatcgacctcgtcgccggcggccggaacaagaagaccaagcgcaccgcgccaaagtcggacgatgtctacctcaagcttctggtgaagctctaccgcttcctggtccggaggaccaagaaccacttcaatgcggtgatcctgaagcggctcttcatgagcaagaccaaccgcccgcctctctctctccgccgcctcgtcaagttcatggaaggcaaggagaaccagatcgctgtaatcgtgggcaccataaccgacgacaagaaagtttatgaggtgccggcgatgaaggtagccgcgctcaggttcactgagacggcgagggcccgcattgtgaatgctggaggagagtgcctcacctttgaccagctggcactccatgcgcctcttggtcagaacacggttctcctgaggggtcctaagaacgcccgtgaggctgtgaggcacttcggcaaggctcctggcgtgccgcacagccacaccaagccttacgtccgctccaagggaaggaagtttgagaaggcgagagggaggaggaacagcagaggcttcaaggtctaggtcgttatatcctatcaccatgtattacaccacagctcttgtttgagtttgggagttctcgaagtgtcaggatcggataaattttgtcgggatgttatgagctttgtatcagaaattcacatgtatttgatcaatgcactggctatctctgcttctacctggatttccgacagtcaatcgaaagtcccatataaagcaa

SEQ ID NO: 4178 - DNA, 745 bp, Brachypodium distachyon
acactcccctcctccgccgccgcgcagctgcttcaccgccgcgcaccaccatgggaatcgacctcgtcgccggcggccggaacaagaagaccaagcgcaccgcgccaaagtcggacgatgtctacctcaagcttctggtgaagctctaccgcttcctggtccggaggaccaagaaccacttcaatgcggtgatcctgaagcggctcttcatgagcaagaccaaccgcccgcctctctctctccgccgcctcgtcaagttcatggaaggcaaggagaaccagatcgctgtaatcgtgggcaccataaccgacgacaagaaagtttatgaggtgccggcgatgaaggtagccgcgctcaggttcactgagacggcgagggcccgcattgtgaatgctggaggagagtgcctcacctttgaccagctggcactccatgcgcctcttggtcagaacacggttctcctgaggggtcctaagaacgcccgtgaggctgtgaggcacttcggcaaggctcctggcgtgccgcacagccacaccaagccttacgtccgctccaagggaaggaagtttgagaaggcgagagggaggaggaacagcagaggcttcaaggtctaggtcgttatatcctatcaccatgtattacaccacagctcttgtttgagtttgggagttctcgaagtgtcaggatcggataaattttgtcgggatgttatgagctttgtatcagaaattcacatgtatttgat

SEQ ID NO: 4179 - DNA, 939 bp, Sorghum bicolor
agaaccctagcgcccgtcccgccgccgccgcagccgccgctgcagcaccaccgctccgtttcacaaccatgggtatcgacctcgtcgccggcggccgcaacaagaagaccaagcgcacggcgcccaagtccgacgatgtctatctcaagctccttgtcaagctctaccgcttccttgtccgtaggacaaagagcaacttcaacgccgtgatcctgaagcgactgttcatgagcaagaccaaccgcccgccgctctcgatgcgccgcctcgttaagttcatggaggggaagagtgatcagattgccgttattgtgggcaccgtgactgacgacaagaggatcaacgaggtgccggcgatgaaggtgtgtgcgctcaggttcactgagacagctagggccaggatcatcaatgccggtggagagtgcctcaccttcgaccagcttgcgctccgtgccccgctcgggcaaaacacggttctcctgaggggtcctaagaacgctagggaagctgttaagcacttcggccctgcaccaggagtgccacacagccacaccaagccttacgttcgctcaaagggaaggaagtttgagaaggcaagaggtaggaggaacagcaggggcttcaaggtctaaggagccgcagccatgcaaatccatgtcattttgctctaatcagctatacattactgttttggggtatcagagttgcaatgttttacatgtcagaatctcaagttattaccagatattggaccaatcaaattttgctcttaattttttgcgccgtgagatttttgtttgtcagcccgtgatgaagatactctcatatcattgttgttggtgccaacagtatgagaaagtctaggtgcctttttgcattgctcatctatattctcagaatttgttcatttaaattcagcgctttcacaatgtaacagtg

SEQ ID NO: 4180 - DNA, 874 bp, Sorghum bicolor
accctagcgcccgtcccgccgccgccgcagccgccgctgcagcaccaccgctccgtttcacaaccatgggtatcgacctcgtcgccggcggccgcaacaagaagaccaagcgcacggcgcccaagtccgacgatgtctatctcaagctccttgtcaagctctaccgcttccttgtccgtaggacaaagagcaacttcaacgccgtgatcctgaagcgactgttcatgagcaagaccaaccgcccgccgctctcgatgcgccgcctcgttaagttcatggaggggaagagtgatcagattgccgttattgtgggcaccgtgactgacgacaagaggatcaacgaggtgccggcgatgaaggtgtgtgcgctcaggttcactgagacagctagggccaggatcatcaatgccggtggagagtgcctcaccttcgaccagcttgcgctccgtgccccgctcgggcaaaacacggttctcctgaggggtcctaagaacgctagggaagctgttaagcacttcggccctgcaccaggagtgccacacagccacaccaagccttacgttcgctcaaagggaaggaagtttgagaaggcaagaggtaggaggaacagcaggggcttcaaggtctaaggagccgcagccatgcaaatccatgtcattttgctctaatcagctatacattactgttttggggtatcagagttgcaatgttttacatgtcagaatctcaagttattaccagatattggaccaatcaaattttgctcttaattttttgcgccgtgagatttttgtttgtcagcccgtgatgaagatactctcatatcattgttgttggtgccaacagtatgagaaagtctaggtgcctttttgca

SEQ ID NO: 4181 - DNA, 992 bp, Zea mays
cccatcactctctagaaccctagcgccccgcccgtcctgccgccgccgcagccgccatcgcacggccatgggtatcgatctcgtagccggcggccgcaacaagaagaccaagcgcacggcgcccaagtccgacgatgtctacctcaagctcctcgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtgatcagatcgccgtgattgtgggcaccgtgaccgacgacaagaggatcagcgaggtgccggcgatgaaggtctgcgcgctcaggttcactgagacagcgagggccaggatcatcaatgctggcggagagtgcctcaccttcgaccagctcgcgctccgtgccccacttgggcaaaacacggttctgctgaggggtcctaagaacgctagggaagctgtcaggcacttcgggcctgcaccaggagtgcctcacagccacaccaagccttatgttcgctcgaagggtaggaagtttgagaaggcgagaggaaggaggaacagcaggggcttcaaggtctaagtggccactgccttgccaatctagtgccgttttgctcgtgtcagctcaatattaccgttttggtgtcatagttgtaatgttttagttgtcggaatctcgtgtcattatcggatatcgaaccaatcaaatttcgctccttttttgtttttgccatgagacttgcccgtcacgaagatgctcacatatcattgtgggccgtaactatgtgaaagtctagctgcccttttgctttgctcgtctatcttcacttgtcagctgttcattttaatccagcgccttcacaattttttaacagtgaggccgcctgaaacgaactatactgatacagtgacattatagtccgttattttggttgcacagc

SEQ ID NO: 4182 - DNA, 1109 bp, Saccharum officinarum
agcaggaggcggacaaggtaagcagcagccgcaggaacccttagcgccgccgcatccgcagccatgggtatcgacctcgtcgccagagggaggaacaagaagaccaagcgcacggcgcccaagtccgacgatgtctacctcaagctcctcgtcaagctctaccgcttccttgtgcgccggacaaagagcaacttcaacgccgtgatcctgaagcggctgttcatgagcaagaccaaccgcccgccgctctcgatgcgccgcctcgtcaagttcatggaggggaagggtgatcagatcgccgtgattgtgggcaccgttaccgacgacaagaggatcaacgaggtgccagccatgaaggtgtgtgcgctcaggttcactgagacggcgagggccaggatcatcaatgccggtggagagtgcctcaccttcgaccagcttgcgctccgtgccccgctcgggcaaaacacggttctcctgaggggacctaagaatgccagggaagctgttaagcacttcggccctgcaccaggagtgccacacagccacaccaagccttatgttcgctcaaagggaaggaagtttgagaaggcaagaggtaggaggaacagtaggggcttcaaggtctaagcagccgcagccatgcaaatccatgtcattttgctcttgtcagctaaacattattgttttggggtgtcagagttgcaatattttagatgccagaatatcgagttattaccaatatcggaccaatcaaattttgctcttaaattttatgcgtcctgagaagtgtgtttgtcagcccttgatgaagatactctcgtaccattgtgggtgccaactatgggccggtttagatgcaatttttttttgcaaaatgacactgtagcaaatttcgttgttatttggtaattagtgttcaatcatggtctaattaggcttaaaagattcgtctcgtccatttcgtctaaactgtgtaattagttttatttttttatctatatttaatgcttcatgtatgtatctaaagactcgatgtgacggggaatgttgaaaaattttgcaaaatttcttgaactaaacagggcctatgtgaaagtctaggtgccttt

SEQ ID NO: 4183 - DNA, 946 bp, Brachypodium distachyon
actccgccccctaaaccctagctcccctcccgccgccgccgcctttccgcacctctgccgccgcgcaaccatgggtatcgacctcgtcgccggcggccgcaacaagaagaccaagcgcacggcgcccaagtccgacgatgtctacctcaagctgctcgtcaagctctaccgcttcctcgtgcggaggacgaagagccacttcaacgcggtgatcctgaagcggctgttcatgagcaagaccaaccgcccgccgctctcgatgcgacgcctcgtcaggttcatggagggcaagggtgaccagatcgctgtgatcgtgggcaccatcaccgacgacaagagggtctacgagatcccggcgatgaaggtggccgcgctcaggttcaccgagacggcgagggccaggattgtcaatgccggtggcgagtgcctcaccttcgaccagctcgcgctccgtgcgccgcttggacagaacacgcttctcctgaggggccccaagaatgccagggaagctgttaggcactttggcgctgctccaggtgtcccacacagccacaccaagccatatgttcgctcaaagggcaggaaatttgagaaggcaagaggaaggaggaacagcaggggcttcaaggtttaagctgaagcagttttgtcacccttgtgtcgtatcgctcttgttacttaatcattactcctttggataccagaattatactgttttagatgtcagaatcttgtgctgatgaattttttagaaccagttaatttttggtttcatgtttgtcactagccagttatgaatatccttttggaaatcatatggggcctttcccctatgtgaacctttacaattgttgatctttcatgagttatctcctttgccgtgtaactggtcaaaatacatggtcagaattgtggtattcaatttttaaaattgaacgccgggttg

SEQ ID NO: 4184 - DNA, 1108 bp, Zea mays
  misc_feature (110)..(110): n is a, c, g, or t
tagaaccctagcgccccgcccgtcctgccgccgccgcagccgccatcgcacggccatgggtatcgatctcgtagccggcggccgcaacaagaagaccaagcgcacggcgnccaagtccgacgatgtctacctcaagctcctcgtcaagctctaccgcttccttgtgcgcaggacaaagagcaacttcaacgccgtgatcctcaagcgcctcttcatgagcaagaccaaccgcccgccgctctcgatgcgccgcctcgtcaggttcatggaggggaagggtgatcagatcgccgtgattgtgggcaccgtgaccgacgacaagaggatcagcgaggtgccggcgatgaaggtctgcgcgctcaggttcactgagacagcgagggccaggatcatcaatgctggcggagagtgcctcaccttcgaccagctcgcgctccgtgccccacttgggcaaaacacggttctgctgaggggtcctaagaacgctagggaagctgtcaggcacttcgggcctgcaccaggagtgcctcacagccacaccaagccttatgttcgctcgaagggtaggaagtttgagaaggcgagaggaaggaggaacagcaggggcttcaaggtctaagtggccactgccttgccaatctagtgccgttttgctcgtgtcagctcaatattaccgttttggtgtcatagttgtaatgttttagttgtcggaatctcgtgtcattatcggatatcgaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtcccgattccgttgaatcatcgctgtttcgcacaactgcagcggcgtagcagcacgagcttgccgccttgtgagccttgagcccacaaaggttgctgagatccttaaggatcgtgcatcgtggtatcgcgattgtcggcatgttgatgtcctccatgttatccctacgggtaacggtggaacgattgagctgatctatatgcagacttatgcac

SEQ ID NO: 4185 - DNA, 910 bp, Sorghum bicolor
cccccacactataaaactccgttgcgccgccgccacacttccttcccgagcaggaggcggacaaggtaagcagccgcagcagccggaaccctagcgccgccgccgcatccgcagccatgggtatcgacctcgtcgccggtgggaggaacaagaagaccaagcgcaccgcgcccaagtccgacgatgtctacctcaagctcctcgtcaagctctaccgtttcctggttaggaggaccaagagcaacttcaacgctgtcatcctcaagaggctcttcatgagcaaaaccaaccgcccaccaatttccctgcgccgccttgtcaagttcatggaaggaaaggagaagaacattgctgtgattgttggcacagtcacagatgacaaaaggatccaggaggttccagcaatgaaggttactgccctgaggttcaccgagacagcaagagccaggattgtcaatgctggtggggagtgcctcacatttgaccagcttgctctccgtgctccacttggcgagaacacggtcctcttgaggggccccaagaatgctcgtgaggcggtgaggcactttggcaaggctcctggcgtgccgcacagccacaccaagccatatgtgcgctccaagggaaggaagttcgaaaaggctcgtggcaggaggaacagccgtggattcaaggtttaaaaaagttgttttgtggtccttgtgcgtgttgccatcagcatagtgcaaccgttctgtttgatcaatcgacagtaattagtaatcactttctaccgagagtagtagcacaatttgttgtcctggtttgaattttgaaagatatttgaaggatttcgtcgccttatctactggttactggttgagcaagaagacaatgatctgttgcacctcttatcagagccttgcatctt

SEQ ID NO: 4186 - DNA, 811 bp, Panicum virgatum
ggccgccgccgtcaccgccgccgctgcggtcacacaacaatgggtatcgacctcgtcgccggcggccgcaacaagaagactaagcgcacagcgcctaagtccgacgatgtctacctcaagctcctcgtcaagctctaccgcttcctggttcgaaggacaaagagcaactttaacgccgtgatcctcaagcggctgttcatgagcaagaccaaccaacctccgctctcgatgcgccgcctagtcaagttcatggagggcaagggtgaccagatcgctgtgatcgtgggcaccgtcaccgacgacaagaggatcactgaggtgccggcgatgaaggtgtgcgcgctcaggttcaccgagacggcgagggccaggatcatcaatgcctgtggcgagtgcctcaccttcgaccaacttgcactccgtgcaccgctcggacaaaacacggtcctcctgaggggtcctaagaatgcgagggaagctgttaagcactttggccctgcgcctggagtcccacacagccacaccaagccttatgttcgctcaaagggacggaaatttgagaaggcgagagggaggaggaacagcaggggcttcaaggtctaagtggcggatatcagctaaattcttcatgccatactgctcctatcagctaaatatcactgttttggtgccagagctgtactctactactctactgctttagatgtcagaatcatatgttggtattatcggattgcagaccaatcaaacttctttctttatttggaccatttgacttgtgtctatcagccaattacgagtatgctttctc

SEQ ID NO: 4187 - DNA, 800 bp, Triticum aestivum
aaaaccctagaacccacccctacgccgccgccgccgccgccatgggtatcgacctcgtcgccggcggccgtaacaagaggaccaagcgcaccgcgccaaagtcggacgatgtctacctcaagcttctggtgaagctctaccgcttcctggtgaggaggaccaagagccagttcaatgctgtgatcctgaagcgcctcttcatgagcaagaccaaccgcccgccgctctcgcttcgtcgcctcgtcaagttcatggacggcaaggacaaccaaatcgctgtgatcgtgggtaccataaccgacgacaagagagtttacgaggtgccggcgatcaaggtggcagcgctcaggttcactgagacggcaagggcccgcattgtgaatgccggtggagaatgcctcacctttgaccagctggcccttcgtgctcctcttggccagtacacggttctcctgaggggccctaagaacgcccgtgaggcagtgaggcacttcggtaaggctcctggtgtgccgcacagccataccaagccttatgtccgctcgaagggaaggaagtttgagaaggcaagaggaaggaggaacagcagaggcttcaaggtctaggttgttgcttgttcatgtgctacacagctcttgtttgagtctgagttatgttattattaattgctaggatcatctaaattttgttcgaacgtcatgcactgtgtaagaaatttacatctgttttacccgatactgtactgtttaacctctctcaactggaaatctttcaagtatctgatcctcttgaatgaagta

SEQ ID NO: 4188 - DNA, 970 bp, Zea mays
aattcaaaaccctagcagcaccacccgtcttcctcttcacccacattataaagatcctccacttcgcactttcgccgccgcctctctccttcccgagcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagtaattagtcatcactctgtaccgagattagtagcacaatttgttgtcctggtttgaattttggaagatatttgatgtcgtctccttattatctactcgttactggttgagcacgaagattgttttgtgatactcctacatgatttaagacggttcccgacgttccatgtatcatttttgtggta

SEQ ID NO: 4189 - DNA, 970 bp, Zea mays
ctgaagtcgaatcccctcacactataaagctcctccattgcgccgccgccactctcctttcggaggaggcggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggcaggaggaacagccgtgggttcaaggtttaagaaagttgtgggccatcagcatagtaatcacttcctaccgagtagtagcacattttgttgccttggcttggattttgaaagatatttaaggattttcgtgccttgtctactggttactggttgagcaagaagacaatgttcttttgcacctctttttattggtcggcatattttgcgctgtgattggaactgtgttgtgttatctgctggatgtacttactgcatcacctagaaaggtggcttgggccatttggaatcataaaacgaaagttgctcgcttcaagcta

SEQ ID NO: 4190 - DNA, 748 bp, Pseudoroegneria spicata
gggtatcgacctggtcgccggcggccgtaacaagaggaccaagcgcaccgcgccaaagtcggacgatgtctacctcaagcttctggtgaagctctaccgcttcctggtgaggaggaccaagagccagttcaatgccgtgatcctgaagcgcctcttcatgagcaagaccaaccgcccgccgctctcgcttcgtcgcctcgtcaagttcatggacggcaaggataaccaaattgctgtggtcgtgggtaccataactgacgacaagagagtttacgaggtgccggcgatcaaggtggcagcgctcaggttcactgagacggcaagggcccgcattgtgaatgccggtggagaatgcctcacctttgaccagctggcgcttcgtgctcctcttggccagaacacggttctcctgaggggtcctaagaacgcccgtgaggcagtgaggcacttcggtaaggctcctggtgtgccgcacagccataccaagccttatgtccgctctaagggaaggaagtttgagaaggcaagaggaaggaggaacagcagaggcttcaaggtctaggttgttgcttggtgttcatgtgctacacagctcttgtttgagtctgagagttatgttattaataagtgctaggatcatctaaattttgttcgaatgtcatgcactgtgtaagaaatttacatctgtttttccggatactgtttctctcaactggaaatctttcaagtatctgatcctcttgaatga

SEQ ID NO: 4191 - DNA, 1039 bp, Sorghum bicolor
tcccccacactataaaactccgttgcgccgccgccacacttccttcccgagcaggaggcggacaaggtaagcagccgcagcagccggaaccctagcgccgccgccgcatccgcagccatgggtatcgacctcgtcgccggtgggaggaacaagaagaccaagcgcaccgcgcccaagtccgacgatgtctacctcaagctcctcgtcaagctctaccgtttcctggttaggaggaccaagagcaacttcaacgctgtcatcctcaagaggctcttcatgagcaaaaccaaccgcccaccaatttccctgcgccgccttgtcaagttcatggaaggaaaggaggagaagaacattgctgtgattgttggcacagtcacagatgacaaaaggatccaggaggttccagcaatgaaggttactgccctgaggttcaccgagacagcaagagccaggattgtcaatgctggtggggagtgcctcacatttgaccagcttgctctccgtgctccacttggcgagaacacggtcctcttgaggggccccaagaatgctcgtgaggcggtgaggcactttggcaaggctcctggcgtgccgcacagccacaccaagccatatgtgcgctccaagggaaggaagttcgaaaaggctcgtggcaggaggaacagccgtggattcaaggtttaaaaaagttgttttgtggtccttgtgcgtgttgccatcagcatagtgcaaccgttctgtttgatcaatcgacagtaattagtaatcactttctaccgagagtagtagcacaatttgttgtcctggtttgaattttgaaagatatttgaaggatttcgtcgccttatctactggttactggttgagcaagaagacaatgatctgttgcacctcttatcagagccttgcatcttatgttctgtgattcgaaccgtgttgtggcctgtgggatcagttctgtgaccttgatgcttgaggtcatacatatatggtcttctggggcgattgctgagtatcatacgttccacgtatcattttt

SEQ ID NO: 4192 - DNA, 910 bp, Saccharum officinarum
agcagcagcagcagcaggaaccctagcgccgccgcatccgcagccatgggtatcgacctcgtcgccggcgggaggaacaagaagaccaagcgcaccgcgcccaagtccgacgatgtctacctcaagctcctcgtcaagctctaccgtttcttggtcaggaggaccaagagcaacttcaacgctgtcatcctcaagaggctcttcatgagcaaaaccaaccgcccaccaatctccctgcgtcgcctcgtcaagttcatggaaggaaaggaggagaagaacattgctgtgattgttggcacagtcacagatgacaagaggatccaggaggttccagcaatgaaggttactgccctgaggttcaccgagacagcaagggccaggattgtcaatgctggtggggagtgcctcacatttgaccagcttgctctccgtgctccacttggcgagaacacggtcctcttgaggggccccaagaatgcccgtgaggcggtgaggcactttggcaaggctcctggcgtgccacacagccacaccaagccatatgtgcgctccaagggaaggaagttcgagaaggctcgtggcaggaggaacagccgtggattcaaggtttaaaaaagttgtgggccttgttcgtgttgccatcagcatagtgcaactgttctgtttgatcaatcgacagtaattagtaatcactttctaccgagtagtagcacaatttgttgacctggtttgaattttgaaagatgtttgaaggatttggtcgccttatctactggttgagcaagaatacaatgttctgttgcacctctcattagagcgttgcatcttaggccctaattggtttccacatgttaaaagttaactctcatcacaataatgtttggggaaaagcatggtctactaaatgtag

SEQ ID NO: 4193 - DNA, 1609 bp, Triticum aestivum
cctatatatccctcactctttcggctcgcccgcaaaaccctagaacccacccctacgccgccgccgccgccgccatgggtatcgacctcgtcgccggcggccgtaacaagaggaccaagcgcaccgcgccaaagtcggacgatgtctacctcaagcttctggtgaagctctaccgcttcctggcgaggaggaccaagagccagttcaatgccgtgatcctgaagcgcctcttcatgagcaagaccaaccgcccgccgctctcgcttcgtcgcctcgtcaagttcatggatggcaaggataaccaaatcgctgtggtcgtgggcaccataaccgacgacaagagagtttacgaggtgccggcgatcaaggtggcagctctcaggttcactgagacggcaagggcccgcattgtgaatgccggtggagaatgcctcacctttgaccagctggcccttcgtgctcctcttggccagaacacggttctcctgaggggtccaaagaatgcccgtgaggcagtgaggcacttcggtaaggctcctggtgtgccgcacagccataccaagccttatgtccgctcgaagggaaggaagtttgagaaggcaagaggaaggaggaacagcagaggcttcaaggtctaggttcttgcttggtgttcatgtgctacacagctcttgtttgagtctgagttatgttattattaagtgctaggatcatctaaattttgttcgaatgtcacgcactgtgctgtgtatccgttttaccggaaactgtattgtttaacctctctcaactggaaatctttcaagtatctgatcctcttgaatgaagtatgatggtttgtttggttgccaaaaaccaataaaacaaacaaagaaatcaaaataaaatataaaaaaaaaaaaaactatatgaactataacaaacaggggtcgccggcttaaattatccccctggggcccaacgattcccagtacccagatttcttggacaatcggcgcccctatgcgagtcttattatactcatagaccacgggcgtcgtgtctaaacgactacagaggaaaacttgctatcttgggagttcctgaaaggaaacttcactatgtgggggaccatacgtgggccaaccccctaggggggtttaaacccctaacgataaaatgaaagtcctcagggtttaagcgagtaaacttacctggaattcctgtccgtgctgaagtttccctacccgattctggtcattgaaaattttctccacagggcctgggggctacgaagggcggtgaattctcaatgcaaaatcccgaggcttttttacagccccttaactcctcacgattcccggaattcttattcaaccataccaatttgttagggtttcatttcctctaaaaaaattttccaaattccctttttattttcagagttaagtggagccccggggtgtcggaaaacttgtgcccggcacgctttctggtggtatcaccttcaagcggttagccccccaaatttcccaagattagcaatttccccacacggctatcctaagggggggggtgggccaaaaccccaaaaatcttttttatttatggccggaagcaacaccggcaa

SEQ ID NO: 4194 - DNA, 940 bp, Saccharum officinarum
cttcccgaacaggaggcggacaaggtaagcagcagcagcagcagcaggaaccctagcgccgccgcatccgcagccatgggtatcgacctcgtcgccggcgggaggaacaagaagaccaagcgcaccgcgcccaagtccgacgatgtctacctcaagctcctcgtcaagctctaccgtttcttggtcaggaggaccaagagcaacttcaacgctgtcatcctcaagaggctcttcatgagcaaaaccaaccgcccaccaatctccctgcgtcgcctcgtcaagttcatggaaggaaaggaggagaagaacattgctgtgattgttggcacagtcacagatgacaagaggatccaggaggttccagcaatgaaggttactgccctgaggttcaccgagacagcaagggccaggattgtcaatgctggtggggagtgcctcacatttgaccagcttgctctccgtgctccacttggcgagaacacggtcctcttgaggggccccaagaatgcccgtgaggcggtgaggcactttggcaaggctcctggcgtgccacacagccacaccaagccatatgtgcgctccaagggaaggaagttcgagaaggctcgtggcaggaggaacagccgtggattcaaggtttaaaaaagttgtgggccttgttcgtgttgccatcagcatagtgcaaccgttctgtttgatcaatcgacagtaattagtaatcactttctaccgagtagtagcacaatttgttgacctggtttgaattttgaaagatgtttgaaggatttggttgccttatctactggttgagcaagaatacaatgttctgttgcacctctcatcagagcgttgcatcttaggccctaattggtttccacatgttaaaagttaactctcatcacaataatgtttggggaaaagcatggtctactaaatgtag

SEQ ID NO: 4195 - DNA, 798 bp, Secale cereale
  misc_feature (185)..(186): n is a, c, g, or t
  misc_feature (637)..(637): n is a, c, g, or t
  misc_feature (709)..(709): n is a, c, g, or t
cgccgctgccgctgccgccctcaccctcgccgctgctgcagccaccaccgcgcaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccnnttcaacgccgtgatcctcaagcggctcttcatgagcaagaccaaccgcccgccgctctcgatgcgccgcctcgtcaggttcatggaggggaaggaggacaagatcgccgtgatcgtgggcaccatcaccgatgaccagagggtctacgagataccggcaatgaaggtggccgcgctcaggttcaccgagacggcgagggccaggattgtcaacgctggtggcgagtgccttacctttgaccagcttgccctccgtgctccgcttggacagaacacgcttctcctgaggggccccaagaacgccagggaagctgttaggcactttggcaaagctccaggagtgccgcacagccacaccaagccatatgtccgctcaaagggcaggaaattcgagaaggccagaggaaggaggaacagcaggggcttcaaggtttaagctgtggagttttcancacccttatgtcacatttgctattattatcggtcaatcttctccttttttgcgtaccagaatcatactgctntagatgtcagtgtcttgtgtcgatgagtattcagaaccagttaattcgtgtttcggtattttgctacttgagaccatgcttgcaagccg

SEQ ID NO: 4196 - DNA, 846 bp, Triticum aestivum
gcaccagtcccgccgccgccgctgccgccctgaccctcgccgctgctgcagcctccaccgcgcaaccatgggtatcgacctcgtcgccggcggccgcaacaagaggaccaagcgcacggcgcccaaatcggacgatgtgtacctcaagctgctcgtcaagctctaccgcttcctggtccggaggaccaagagccagttcaacgccgtgatcctgaagcgcctcttcatgagcaagaccaaccgccccccgctctcgatgcgccgcctcgtcaggttcatggaggggaaggaggacaagatcgctgtgatagtgggcaccatcaccgatgaccagagggtctacgagataccggcaatgaaggtggccgcgctcaggttcaccgagacggcgagggccaggattgtcaatgccggtggcgagtgccttacctttgaccagctcgcgctccgtgctccgcttggacagaacacgcttctcctgaggggtcccaagaacgccagggaggctgttaggcactttggcaaggctccaggagtgccacacagccacaccaagccatatgtccgctccaagggcaggaaattcgagaaggcaagaggaaggaggaacagcaggggcttcaaggtttaagccgtggagttttcggcacccttgtcacatttgctgttatcggtcaatcttcacttttttgggtaccagaatcatactgctttagatgtcagagtcttgtgtcgatgagtattcagaaccagttcattcttgtttcagtattttgcaacttgagaccatgcttgcaatccagttatgaatatcatttctagtatcagaagttgtctccgtttgca

SEQ ID NO: 4197 - DNA, 1008 bp, Oryza sativa
ctccttccccttagccggaggccgacacgaggtaagaagcccagaagccctagcgccgccgcagcagcagcagccatgggtatcgacctcgttgccggcgggaggaacaagaagacgaagcgcaccgcgccgaggtcggacgatgtctacctcaagctcctcgtcaagctgtaccgtttcctggtgaggagaaccaagagtaacttcaatgccgtgatcctcaagaggctcttcatgagcaagaccaaccgcccgccgctctccctgcgccgcctcgccaagttcatggaaggcaaggaggagaacaacattgctgtgattgttggtacagtcactgatgacaagaggatccaagagattccgaaaatgaaggttactgccctgaggttcacggagacggctagggcaaggattgtcaatgctggcggcgagtgcctcaccttcgaccagcttgctctccgtgctccgcttggggagaacacggtcctcttgaggggtcccaagaatgcccgtgaggccgtcaggcactttggtaaggctcctggtgtgccgcacagccacacgaagccatatgtgcgctccaagggaaggaagttcgagaaggcccgtggcaggaggaacagccgtggattcaaggtctaagtcagctcctgtttgcaagtgttgcgatcggcattgtgcgaccgttctgtttgagcaatcgacagtaattagtagtcacttctctactgagactagcaaaacttaattgtgtcatttctgaaagatattttgaaggatcctttctacctacctacatgcgtttgtgggcaagaagacaatgttttttgtttcctctctattagagcttgaaaattttcgcctccattgctctcttggtgatagtgaagtcatgggctcatggcttgctgtcatggtgaaatgatggttcagctcatggctgatgtgcttgattatgtgggtttctgtgatgttattgcataagtcaatgcctgaagccactcaacc

SEQ ID NO: 4198 - DNA, 709 bp, Saccharum officinarum
attcggtcgaccacgcgtccgggacaaggtaagcagcagcagcagcaggaaccctagcgccgccgcatccgcagccatgggtatcgacctcgtcgccggcgggaggaacaagaagaccaagcgcaccgcgcccaagtccgacgatgtctacctcaagctcctcgtcaagctctaccgtttcttggtcaggaggaccaagagcaacttcaacgctgtcatcctcaagaggctcttcatgagcaaaaccaaccgcccaccaatctccctgcgtcgcctcgtcaagttcatggaaggaaaggaggagaagaacattgctgtgattgttggcacagtcacagatgacaagaggatccaggaggttccagcaatgaaggttactgccctgaggttcaccgagacagcaagggccaggattgtcaatgctggtggggagtgcctcacatttgaccagcttgctctccgtgctccacttggcgagaacacggtcctcttgaggggccccaagaatgcccgtgaggcggtgaggcactttggcaaggctcctggcgtgccacacagccacaccaagccatatgtgcgctccaagggaaggaaagtcgagaaggctcgtggcaggaagaacagccgtggattcaaggtttaaaaaagttgtggccctttttcgtgttgcattagcataagtgcactggtcttgttgatcaatcgacag

SEQ ID NO: 4199 - DNA, 776 bp, Saccharum officinarum
  misc_feature (560)..(560): n is a, c, g, or t
  misc_feature (584)..(584): n is a, c, g, or t
  misc_feature (628)..(628): n is a, c, g, or t
agcaggagcagcagcaggaaccttagcgccgccgcatccgcagccatgggtatcgacctcgtcgccggcgggaggaacaagaagaccaagcgcaccgcgcccaagtccgacgatgtctacctcaagctcctcgtcaagctctaccgtttcttggtcaggaggaccaagagcaacttcaacgctgtcatcctcaagaggctcttcatgagcaaaaccaaccgcccaccaatctccctgcgtcgcctcgtcaagttcatggaaggaaaggaggagaagaacattgctgtgattgttggcacagtcacagatgacaagaggatccaggaggttccagcaatgaaggttactgccctgaggttcaccgagacagcaagggccaggattgtcaatgctggtggggagtgcctcacatttgaccagcttgctctccgtgctccacttggcgagaacacggtcctcttgaggggccccaagaatgcccgtgaggcggtgaggcactttggcaaggctcctggcgtgccacacagccacaccaagccatatgtgcgctccaagggaangaagttcgagaaggctcgtggcangaggaacagccgtggattcaaggtttaaaaaagtggtgggcctngttcgggttgccatcagcatagtgcaaccgttctgtttgatcaatcgacagtaattagtaatccatttctaccgagtagttacccaatttgtggacctggtttggactttcgaaagatgtttgaacgattgggtgccttatctactgg

SEQ ID NO: 4200 - DNA, 772 bp, Triticum aestivum
aacccacccctacgccgccgccgccgccgccgccatgggtatcgacctcgtcgccggcggccgtaacaagaggaccaagcgcaccgcgccaaagtcggacgatgtctacctcaagcttctggtgaagctctaccgcttcctggtgaggaggaccaagagccagttcaatgccgtgatcctgaagcgcctcttcatgagcaagaccaaccgcccgccgctctcgctttgtcgcctcgtcaagttcatggacggcaaggataaccaaatcgctgtggtcgtgggcaccataacagatgacaagagagtttacgaggtgccggcgatcaaggtggcagcgctcaggttcactgagacggcaagggcccgcattgtgaatgccggtggagaatgcctcacctttgaccagctggcccttcgtgctcctcttggtcagaacacggttctcctgaggggccctaagaacgcccgtgaggcagtgaggcacttcgtaaggctcctggtgtgccgcgcagccataccaagccttatgtccgctcgaagggaaggaagtttgagaaggcaagaggaaggaggaacagcagaggcttcaaggtctaggttgctgcttgttcatgtgctacacagctcttgtttgagtctgagttatgttataattaagtgctaggatcatctaaattttgttcgaacgtcatgcactgtgtaagaaatttacatctgttttacctgatactgtactgtttaacctctctcaactggaaatctttcaagtatc

SEQ ID NO: 4201 - DNA, 841 bp, Avena sativa
gctagcacccttcctgccgcccccctcaccgccgccgccgccgctgctgttgccgccaccgcgcaaccatgggtatcgacctcgaagccggcggccgcaacaagaggaccaagcgcacggagcccaaatcggacgatgtctacctcaagctgctcgtcaagctctaccgcttcctggtgcggaggaccaagagccacttcaacgccgtgatcctgaaacgcctgttcatgagcaagaccaaccgtgcgccgctctcgatgcgccgcctcgtcaggttcatggagggaaagggagaccagatcgctgtgatcgtgggcaccatcaccgacgacaagagggtctacgaggtgccggcgatgaaggtggccgcgctcaggttcaccgagacggcgagggctaggatagtcaatgctggtggcgagtgcctcacctttgaccagctcgccctccgtgctcctcttggacagaacacggttctcctgaggggtcccaagaacgccagggaagctgttaggcactttggcaaagctccgggtgtaccgcacagccacaccaagccatatgtccgcgcaaagggcaggaagtttgagaaggcaagaggaaggaggaacagcaggggcttcaaggtttaagctgcagcgttttcggcacccttttgtcgtattgctcttgttagtcaatcatcatcatcacctctttgggtaccagaatcgtactgttttagatcccgtaatctttgcgttgatggattttcagaaccagttaaattttggttccttgtattgcactgggatattactatgtttgcaagccagttatgaatattatcgtttctagtatc

SEQ ID NO: 4202 - DNA, 839 bp, Triticum aestivum
gccgccgccgctgccgctgccgccctgaccctcgccgctgcagcagccaccaccgcgcaaccatgggtatcgacctcgtcgccggcggccgcaacaagaggaccaagcgcacggcgcccaaatccgacgatgtgtacctcaagctgctcgtcaagctctaccgcttcctggtgcggaggaccaagagccagttcaacgccgtgatcctcaagcgtctcttcatgagcaagaccaaccgcccgccgctctcgatgcgccgcctcgtcaggttcatggaggggaaggcggacaagatcgccgtgatcgtgggcaccatcaccgatgaccagagggtctacgagataccggcaatgaaggtggccgcgctcaggttcaccgagacggcgagggccaggatcgtcaatgctggtggcgagtgccttacctttgaccagctcgccctccgtgctccgcttggacagaacacgcttctcctgaggggtcccaagaacgccagggaagctgttaggcactttggcaaagctccaggagtgccacacagccacaccaagccatatgtccgctcaaagggcaggaaattcgagaaggcgagaggaaggaggaacagcaggggattcaaggtctaagatgtggaatttctggcgcacttgtgtcatattttgctatcttcggtttatcgtcatctttttggataccagaatattaccgctttagatgtcagtgtcttgtgtcaacgagtattcagaaccagttaatttgtgtttcatcattttgcaacttgagagaccatgcttgcaagccagttatgaatatcatttctagtatcagaagttgtctcc

SEQ ID NO: 4203 - DNA, 846 bp, Triticum aestivum
  misc_feature (17)..(17): n is a, c, g, or t
ccgaattcggcacgagncgccgccgctgccgctgacgccctgaccctcgccgctgcagcagccaccaccgcgcaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccagttcaacgccgtgatcctgaagcgcctcttcatgagcaagaccaaccgcccgccgctctcgatgcgccgcctcgtcaggttcatggaggggaaggcggacaagatcgccgtgatcgtgggcaccatcaccgatgaccagagggtctacgagataccggcaatgaaggtggccgcgctcaggttcaccgagacggcgagggccaggattgtcaatgccggtggcgagtgccttacctttgaccagctcgccctccgtgctccgcttggacagaacacgcttctcctgaggggccccaagaacgccagggaagctgttaggcactttggcaaagctccaggagtgccacacagccacaccaagccatatgtccgctcaaagggcaggaaattcgagaaggcaagaggaaggaggaacagcaggggcttcaaggtttaagctgtggaatttctggcgcacttgtgtcatattttgctattattatcggttcatcatcacctttttgggtaccagaatcataccgctttagatgtcagtgtcttgtgtcaatgagtattcagaaccagttaattcttgtttcagtattgtgcaacttgagaccatgcttgcaagccagttattaatatcatttgtagcaccaaaa

SEQ ID NO: 4204 - DNA, 723 bp, Eragrostis curvula
ggggttacctccgtcgcgggggccgggaacagaagaccaagcgcaccgcgcccaagtccgacgatgtctacctcaagccctaaaacaagctgtaccgcttcctgttgcgcaggacgaagagcaacttcaacgccgtgatcctgaagcggctgttcatgagcaagaccaaccgcccgccgctctcgctccgccgcctcgtcaagtttatggagggcaaggagaaccagattgctgtgatcgtgggcaccgtgactgacgacaagagggtctacgaggtgccggcgatgaaggtggccgccctcaggttcactgagacggcaagggcccggattgtgaacgctggcggcgagtgcctcacctttgaccagctggcgctccgtgcacctctgggccagaacacggttctgctgaggggacctaagaatgctagggaagctgtgaagcactttggcgctgcacctggtgttccgcacagccacaccaagccttatgtccgctcgaaggggaggaagtttgagaaggcaagaggcaggaggaacagcagaggctttaaggtgtaataagctaatgcatcatatccgtgtggtctcaactagtggattaaatagatctttgagcccgagagttctatgttattacctcagttccaggacgtttgtcttttgtacaccagttccaggatctgctgaattttgctcgaatgttatccagtatgcactttgt

SEQ ID NO: 4205 - DNA, 877 bp, Hordeum vulgare
aaaaaccctagcacccgtcccgccgccgccgctgccgcctcgaccctcgccgctgctgcatccaccaccgcggaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccagttcaacgccgtgatcctgaagcggctcttcatgagcaagacaaaccggccgccgctctcgatgcgccgcctcgtcaggttcatggatgggaaggcggacaagatcgctgtgatcgtgggcaccatcaccgatgaccagagggtctacgagataccggcaatgaaggtggccgcgctcaggttcaccgagacggcgagggccaggattgtcaacgctggtggcgagtgccttacctttgaccagctcgccctccgtgctccgcttggacagaacacgcttctcctgaggggtcccaagaacgccagggaagctgttaggcactttggcaaagctccaggagtgccacacagccacaccaagccatatgtccgctccaagggcaggaaattcgagaaggcaagaggaaggaggaacagcaggggcttcaaggtttaagctgtggaattttgggcaccctcgtgtcgtattttgctgttatcggtttattatcatcacctttttgggtaccagaatcataccgctttagatgtcagtgtcctgtgtcaatgagttctcagaaccagttaattcgtgtttcgttgttttgcaacttgagaccatgcttgcaagccagttatgaatatcatttctagcaccaaaatttctctctgtttggcagtgaggtttgtgtt

SEQ ID NO: 4206 - DNA, 935 bp, Hordeum vulgare
ctgaggccgtcccgccgccgccgctgccgcctcgaccctcgccgctgctgcatccaccaccgcggaaccatgggtatcgacctcgtcgccggcggccgcaacaagaggaccaagcgcacggcgcccaagtcggacgatgtgtacctcaagctgctcgtcaagctctaccgcttcctggtgcggaggaccaagagccagttcaacgccgtgatcctgaagcggctcttcatgagcaagacaaaccggccgccgctctcgatgcgccgcctcgtcaggttcatggatgggaaggcggacaagatcgctgtgatcgtgggcaccatcaccgatgaccagagggtctacgagataccggcaatgaaggtggccgcgctcaggttcaccgagacggcgagggccaggattgtcaacgctggtggcgagtgccttacctttgaccagctcgccctccgtgctccgcttggacagaacacgcttctcctgaggggtcccaagaacgccagggaagctgttaggcactttggcaaagctccaggagtgccacacagccacaccaagccatatgtccgctccaagggcaggaaattcgagaaggcaagaggaaggaggaacagcaggggcttcaaggtttaagctgtggaattttgggcaccctcgtgtcgtattttgctgttatcggtttattatcatcacctttttgggtaccagaatcataccgctttagatgtcagtgtcctgtgtcaatgagttctcagaaccagttaattcgtgtttcgttgttttgcaacttgagaccatgcttgcaagccagttatgaatatcatttctagcaccaaaatttctctctgtttggcagtgaggtttgtgttctgccgcttgtgctcattattgagatgttatagattgcaaatgtaatgcatcatttacgttgacga

SEQ ID NO: 4207 - DNA, 930 bp, Pennisetum glaucum
acaaggtaagcagccgcagcaggaaccctagcgccgccgccgcagacgcagccatgggtatcgacctcgtcgccggtgggaggaacaagaagaccaagcgcaccgcgcccaagtccgacgatgtctacctcaagctcctcgtcaagctgtaccgtttcttggtcaggaggaccaagagcagctttaacgctgtcatcctcaagaggctcttcatgagcaagaccaaccgccctcccatctctctccgccgcctgtccaagttcatggaaggaaaggaggagaagaacattgctgtgattgttggtacagtcacagatgacaagaggatccaagagattccggcaatgaaggttactgcacttaggttcactgagacagcaagagctaggattatcaatgctggtggggagtgcctcacatttgaccagcttgctctccgcgctccacttggcgagaatacggtcctcctgaggggtcccaagaacgcccgtgaggcagtgaggcactttggcaaggcccctggtgtgccacacagccacaccaagccttatgttcgctccaagggaaggaagtttgaaaaggctcgtggcaggaggaacagccgtggtttcaaggtttaagttgttggcttttgcctgttcatgttgccatcagtattgtgcgacagttctgtttgagcaatcgacagtaattagtaatcactttctaccgagagtagtagcacaatatgttgtcctggtttgaattttgaaggattcttggtgttatccgctggttgagcaagaagacaatgttctgttgcacctcttatcagagcttgatatttatcttccatggcccttgtacgatgattgttgcatctttgtgctgtgattgtagatggtacacgtgctgtgaaaactcgttatgctcatcatcgagtgggcaaaa

SEQ ID NO: 4208 - DNA, 1211 bp, Panicum virgatum
attccgggtcgagccggaggcgaacaaggtaagcagcagcagcaggaaccctagcgccgccgcagccatgggtatcgacctcgtcgctggcgggaggaacaagaagaccaagcgcaccgcgcccaagtcagacgatgtctacctcaagctcctcgtcaagctgtaccgtttcttggtcaggaggaccaagagcaactttaatgccgtcatcctcaagaggctcttcatgagcaagaccaaccgccctcccatctccctgcgccgccttgccaatttcatgaaaggaaaggaggagaagaacatcgctgtgattgttggctcagtcacagatgacaagaggatccaagagattccagcaatgaaggttaccgcactgaggttcaccgagacagcaagggcgaggattatcaatgctggtggggagtgcctcacatttgaccagcttgctctccgtgctccacttggcgagaacacggtccttctgaggggtcccaagaacgcccgtgaggcagtgaggcactttggcaaggctcctggtgtgccacacagccacaccaagccgtatgtgcgctccaagggaaggaagttcgagaaggctcgtggcaggaggaacagccgtgggttcaaggtctaagccattggcctttgcctgtgcgtgttgccatcagcattgtactgtggttctgtttgagcaagcgacagtaattagtaatcactttctactgagtagtagcacaatttgttgtcctggtttgaattttgaaagatatttgaaggattcgtggtgttatctgcttgttaagctaagatacaatgttctgtttgcatcccttaccagagattgagtcctcttccatggccctttcaaggtgaggctgcggtcttatgtgctgtgattgtaaatgtttggtcagtggtactttcatggttagttgttatggtcgaccaagtatctcggagaagaagccatgaccgtgactgaagcccaagccaacatcagcgatcaagacgtggagcaagcgacgctccagtcagttatccttttatttcaaatttgtaatcgtagtcagttaatgtaatggacctatatgtattgtactaggagatctaatgacgagttacgctagagatcattctgatctctcggcgcccttgtgcctctcgcaactctcgcttggcatgaagttgtaggagtttacaagcatgcgatt

SEQ ID NO: 4209 - DNA, 856 bp, Cenchrus ciliaris
  misc_feature (629)..(629): n is a, c, g, or t
  misc_feature (810)..(810): n is a, c, g, or t
  misc_feature (813)..(813): n is a, c, g, or t
  misc_feature (815)..(816): n is a, c, g, or t
ggtaagcagccgcagcaggaaccctagcaccgccgccgcagcagccatgggtatcgacctcgtcgccggcgggaggaacaagaagaccaagcgcaccgcgcccaagtccgacgatgtctacctcaagctcctcgtcaagctgtaccgtttcttggtcaggaggaccaagagcagcttcaacgctgttatcctcaagaggctcttcatgagcaagagcaaccgccctcccatctctctgcgccgccttgccaagttcatggaaggaaaggaggagaagaacattgctgtgattgttggtacagtcacagatgacaagaggatccaagagattccagcaatgaaggttaccgcacttaggttcaccgagacagcaagagctaggattatcaatgctggtggggagtgcctcacgtttgaccagcttgctctccgtgctccacttggcgagaacacggtcctcctgaggggacccaagaatgcccgtgaggccgtgaggcactttggcaaggcccctggtgtgccacacagccacaccaagccgtacgtgcgctccaagggaaggaagttcgagaaggctcgtggcaggaggaacagccgtggtttcaaggtttaagttgtcggcctttgcntgtgcatgttgccatcagcattgtgcgacagttctgtttgagcaatcgacagtaattagtaatcactttctaccgagagtagtagcacaatttgttgtcctggtttgaattttgaaggattcgtggtgttatccgctggttgagcaagaagacaatgttctgttgcacctgttatcagagnttngnntttatcttcatggcccttgtttgttgatggttgcatttta

SEQ ID NO: 4210 - DNA, 833 bp, Eragrostis curvula
  misc_feature (657)..(657): n is a, c, g, or t
  misc_feature (663)..(663): n is a, c, g, or t
  misc_feature (680)..(680): n is a, c, g, or t
  misc_feature (713)..(713): n is a, c, g, or t
  misc_feature (726)..(726): n is a, c, g, or t
  misc_feature (794)..(794): n is a, c, g, or t
  misc_feature (801)..(801): n is a, c, g, or t
cggcgcgggggagccggaggcggacaaggtaagcagcagcagacgttgccgcagcgggaaccctagcgccgccgccatgggtatcgacctcgtcgccggtgggaggaacaagaagaccaagcgcaccgcgcccaagtccgacgatgtctacctcaagctcctcgtcaagctgtaccgtttcctggttaggaggacgaagagcaacttcaatgccgtcatcctcaagaggctcttcatgagcaagaccaacaggcccccgatttcgctacgccgcctcacaaagttcatggcaggaaaggaggagaagaacattgctgtgattgttggtacagtcacagatgacaagaggatccaagaaatcccggcaatgaaggtaaccgccctcaggttcactgagacggcgagggcaaggattgtcaaggctggcggggagtgcctcacattcgaccagcttgctctccgcgctccacttggggagaacacgatcctcctgaggggacccaagaatgcccgtgaggcggtgaggcactttggtaaggctcctggtgtgccgcacagccacacaaagccttatgtgcgctccaagggaaggaagttcgagaaggctcgtggcaggaggaacagccgtggattcaaggtctaagttggttttgttcntggttnttgccattaatattgtncaaccgtgtactgtttgagcagttgacagtaantagtgatcacttnctactgagagtagcgcaatttgttgtcccgttttgaaagatatttcaaagtatttgtgccattacccnctggtgngcagactgtttggttgcactccatctctttcc

SEQ ID NO: 4211 - DNA, 975 bp, Panicum virgatum
cttcccgagccggaggcgaacaaggtaagcagccgccgcaggaaccctagcgccgccgcagcagcagccatgggtatcgacctcgtcgccggcgggaggaacaagaagaccaagcgcaccgcgcccaagtcggacgatgtctacctcaagctcctcgtcaagctgtaccgtttcttggtcaggaggaccaagagcagttttaatgccgtcatcctcaagaggctcttcatgagcaagaccaaccgccctcccatctccctgcgccgtctagccaatttcatgaaagggaaggaggagaagaacattgctgtgattgttggttcagtcacagatgacaagaggatccaagagattccagcaatgaaggttaccgcactgaggttcacagagacagcaagggctaggattatcaatgctggtggggagtgcctcacatttgaccagcttgctctccgtgctccacttggcgagaacacggtccttctgaggggtcccaagaacgcccgtgaggcagtgagacactttggcaaggctcctggtgtgccacacagccacaccaagccgtatgtgcgctccaagggaaggaagttcgagaaggctcgtggcagaaggaacagccgtgggttcaaggtctaagccattggcctttgcctgtgcatgttgccattgtgctgcggttctgtttgagcaagcgacagtaattagtaatcactttctactgagtagtatcacaatttgttgtcctggtttgaattttgaaacatatttgaaggattcgtggtgttatctgctggttgagcaagacacaatgttctgttgcatctcttatcagagcttgagattcctcttccatggccctttcaaggtgctgctgggcgtcttagtgctgtgattgtaaacggtcaatggtactttcatggtcacttctgtggcataaagtcacaggagtttacaagcatgtgatttcagacgact

SEQ ID NO: 4212 - DNA, 557 bp, Triticum aestivum
cagcaccaccgctccgtttcacaccatgggtatcgacctcgtcgccggcggccgcaacaagaagaccaagcgcacggcgcccaagtccgacgatgtctatctcaagctccttgtcaagctctaccgcttccttgtccgtaggacaaagagcaacttcaacgccgtgatcctgaagcgactgttcatgagcaagaccaaccgcccgccgctctcgatgcgccgcctcgttaagttcatggaggggaagagtgatcagattgccgttattgtgggcaccgtgactgacgacaagaggatcaacgaggtgccggcgatgaaggtgtgtgcgctcaggttcactgagacagctagggccaggatcatcaatgccggtggagagtgcctcaccttcgaccagcttgcgctccgtgccccgctcgggcaaaacacggttctcctgaggggtcctaagaacgctagggaagctgttaagcacttcggccctgcaccaggagtgccacacagccacaccaagccttacgttcgctcaaagggaaggaagtttgagaaggcaagag

SEQ ID NO: 4213 - DNA, 1053 bp, Brachypodium distachyon
accttccacgcgccgccactctccttccccagccggaggccgacaaggtaagaagaagccgcgaacaaaccctaccgccaccgccgccgcagcagccatgggtatcgacctcgtcgccggcgggaggaacaagaagaccaagcgcaccgcgcccaagtccgacgatgtgtaccttaggctccttgttaagctctaccgtttcctggtgaggaggaccaagagcaagttcaatgccgtcatcctcaagaggctcttcatgagcaagaccaaccgcccgccgctctccatgcgccgtctctccaatttcatgaaggggaaggacgagaagagcatcgctgtgattgttggtacaatcacagacgacaagaggatccaagagatcccggcaatgaaggtcactgccctgaggttcacagagacagccagggccaggattatcaatgctggtggggagtgcctcacatttgaccagcttgctcttcgtgctccgatgggggagaacacgatcctcctgaggggacccaagaatgcccgtgaggcggttaggcactttggcaaggctcctggtgtgccgcacagccacaccaagccgtatgtgcgctccaaggggagaaagtttgagaaggctcgtggtaggaggaacagccgtggattcaaggtctaagtcggtccatcttgttgccatctggaccgttctgtttgagcaattgacagtaattagtaagctttgtactgagtagcacaatctatcgccctggtttgaatgatactttgcaagattgttatcgctgtcaactgttttgagtttctgaagacaatttttgttgcaccccatcagggcttaaaattttctgtcttgccaatgttgaattgtaaatcctgcgttgtcttgcttggttcggttgtcctgcgttgtctaagaagatgtacatcggagaacagcatggcacagggtaactgttccgttttcatgtgaaacacatccgtcattacgtatagaaacaagttgcaaattcgctgttgccgtgacatcaacatgtagagtcattcaag

SEQ ID NO: 4214 - DNA, 835 bp, Catharanthus roseus
tcggcacgaggtagaaacccaccgcaaagaatacgccacgagagccgccatagcctcagcgcgcaggagccaacttcattagaatcagctatgggtattgatttgaaagccggtggtaaaaacaagaagacgaagaggactgctcccaagtccgatgatatctacctcaagctccttgtcaagctctaccgatttttggtccggaggacggagagcaagttcaatgctgtgatattgaagaggttgtttatgagcaagactaacaaggctccattgtctctctcgaggcttgtagacttcatgaaaggaaaggatggtaagattgcagtgattgttggaacagtcactgatgatattagagtgtatgaagtgcccgcattgaaggtggctgccttgaggttcacagagactgcaagagcaagaattgagaaggctggtggagagtgtttgacatttgatcagttagctcttagagctccacttggtcagaacacggtccttcttagaggtccaaagaatgcccgtgaggcagtgaaacactttggtcctgctccaggtgtaccacacagccatactaaaccatatgttagggccaagggaaggaagtttgagagagccagaggaaggagaaacagcagaggcttcaaagtttaagttggctatcgtatttgtgttcatttgtggccaaacaatcaaactctttttcgtagtcaattttgtcagagttgttttctaaggaacaatccaactatatattgttactctatcgttgaatttgaatgtgttccaatttataacacttccatttacccctttattttcagtcttttatctt

SEQ ID NO: 4215 - DNA, 829 bp, Zingiber officinale
  misc_feature (821)..(821): n is a, c, g, or t
gcacgaggcctcgtgccgaattcggcacgaggaacgccatgggtatcgatctcgtcgccggtggtcggagcaagaagactcgtcgtacggcccctaaatccgacgatgtctatctgaaactcctagttaggctctacaggtttctggtgcgtaggacgggaagtaagttcaacgccgtgatcctgaagcggctcttcatgagcaagaccaatcggccacctctctccctcaggaggctcatcaagttcatggaaggaaatgaaaacaaaatagctgtgattgccgggacagtgacggatgataagagggtgtatgatgtgcctgctatcaaggtgacggctcttaggttcacggagacagctagggcgaggattttgaaggctggcggagagtgcctcacttttgaccagcttgctctccgagctcctcttggacagaacactattctcctgaggggtcccaagaacgcgagggaagctgttaagcactttggcaaagctcctggtgtgccgcacagccacacgaagccttatgtccgggctaaggggaggaaatttgagaaagcaaggggaagaagaaacagcagaggattcagggtttgagttagttaattcggtactactattacaatttgatctaccaacaaccagcgatctaccatcttgttctttcttttatgttctattttgcatgatctgagattgttaatttcctccgaatttccctgggccttttgagttatttagtgaaaccttcaaacttaaatatttgtatttggttaaaatgcatctttcttcttaagtttccatgcttttcttttnaaaaaaaa

SEQ ID NO: 4216 - DNA, 845 bp, Ananas comosus
ccgacgcaaaccctcagctgcaatgggtatcgatctcgtcgccgggggccggagcaagaaggcgaggcgcactgctcccaaatccgacgatgtctacctcaagctcctcgtcaagctctaccggttcctggtgcggagaacggggagcaagttcaatgcggttatcctgaagcggctcttcatgagcaagatcaataggccccccatctccctcaggaggctcgtcagtttcatgagcggaaagggagataagactggagtaattgttgggacggtgacagatgataagagggtgtatgaggtgccggccatgaaggtgactgcccttaggttcacggagacggcaagggcgaggattgttaatgctggtggggagtgcctgacgcttgatcagctcgctctgcgtgccccactagggcagaacacggttctcttgaggggaccgaagaatgcccgcgaagccgtgaagcactttggcaaggcgcctggggtgccgcacagccacacgaagccctatgtccgcgccaaaggcaggaagtttgagaaggccagaggtagacggaacagccgtggatttagggtctaaaaggccattacatcctcgctctttctccagaaattatcctaaacaattaccgtgtgagcgcttattctcctctctactttttgtagtctctttacatcacatctggattgtagaagtgtttgggaagttttgatcatctagctattccttgtgattgcactggttatttcatgattggtaatgttttaaaaaaaatatatgagaaatttggactcaaaatggaatttaaacagtctcttaacttttttttttttttgat

SEQ ID NO: 4217 - DNA, 1016 bp, Saccharum officinarum
aacaagaagaccaagcgcacggcgcccaagtccgacgatgtctacctcaagctcctcgtcaagctctaccgcttccttgtgcgccggacaaagagcaacttcaacgccgtgatcctgaagcggctgttcatgagcaagaccaaccgcccgccgctctcgatgcgccgcctcgtcaagttcatggaggggaagggtgatcagatcgccgtgattgtgggcaccgttaccgacgacaagaggatcaacgaggtgccagccatgaaggtgtgtgcgctcaggttcactgagacggcgagggccaggatcatcaatgcccgtggagagtgcctcaccttcgaccagcttgcgctccgtgccccgctcgggcaaaacacggttctcctgaggggacctaagaatgccagggaagctgttaagcacttcggccctgcaccaggagtgccacacagccacaccaagccttatgttcgctcaaagggaaggaagtttgagaaggcaagaggaaggaggaacagcaggggcttcaaggtctaagcagccgcagccatgcaaatccatgtcattttgctcttatcagctaaacattattgttttggggtgtcagagttgcaatattttagatgccagaatatcgagttattaccaatatcggaccaatcaaattttgctcttaaattttatgcgtcctgagaattgtgtttgtcagcccttgatgaagatactctcgtaccattgtgggtgccaactatgggccggtttagatgcaatttttttttgcaaaatgacactgtagcaaatttcgttgttatttggtaattagtgttcaatcatggtctaattaggcttaaaagattcgtctcgtccatttcgtctaaactgtgtaattagttttatttttttatctatatttaatgcttcatgtatgtatctaaagactcgatgtgacggggaatgttgaaaaattttgcaaaatttcttgaactaaacagggcctatgtgaaagtctaggtgccttt

SEQ ID NO: 4218 - DNA, 901 bp, Oryza sativa
aaaaccctaacaccctcgccgccgccgacccattcgccgccgccgccgccgccggaaaaccatgggtatcgacctcgtcgccggcggccggaacaagaagaccaagcgcacggcgcccaggtccgaggatgtctacctcaagctcatcgtcaagctctaccgcttcctggtgcggaggaccaagagccacttcaacgccgtgatcctgaagcggctcttcatgagcaagaccaaccgcccgccgctctcgatgcgccgtctcgtcaggttcatggaggggaaggtacctgatcgccatgccatttcgggggaccagatcgccgtgatcgtgggcaccgtcacagatgacaagaggatctatgaggtgccggcgatgaaggtggctgctctcaggttcaccgagaccgcgagagcacggatcatcaatgccggtggcgagtgcctcacgttcgaccagctcgctctccgcgccccgcttggccagaacacggtcctcctgaggggtcccaagaacgctagggaagctgttaagcactttggccctgctccaggagttccccacagcaacactaagccatatgttcgctcaaagggaaggaaatttgagaaggcaagaggaagaaggaacagcaagggcttcaaggtataagttgtggcagctttggcaccattacaccaaactgctcatatcagttagacatcactgttttggatgccagacttgcactgttgttttggatgctagacttacactgttttagatgtcaaaatattgtgttactgacttcacaggaacaattaaattgtttacctcctttgcacttcaagatatttgtttggcgtctcgcattatgaatataatctcctttatttatgaggctgggcaactgcgttctgaaga

SEQ ID NO: 4219 - DNA, 856 bp, Zea mays
cttcccgagccggaggtggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacactatcctgttgaggggacccaagaatgcccgtgaggcggtgaggcacttcggcaaagcacctggtgtgccgcacagccataccaagccctatgtgcgctccaagggtaggaagtttgagaaggctcgtggtaggaggaacagccgtggcttcaaggtttaagtcgccctttcttgttagtcgctgtttgcgtggagcggctgttgttctgtttgagcaattgacagtaattagtaaagtactttgtactgagagtagcaaaatctatcgccccagtgtttgaatgatattttgcaagattcttatcgctgtcaactcttttgattttgtgagcttgaagaccatgtttcgttgt

SEQ ID NO: 4220 - DNA, 900 bp, Triticum aestivum
cggaggcggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacactatcctgttgaggggacccaagaatgcccgtgaggcggtgaggcacttcggcaaagcacctggtgtgccgcacagccataccaagccctatgtgcgctccaagggtaggaagtttgagaaggctcgtggtaggaggaacagccgtggcttcaaggtttaagtcgccctttcttgttagtcgctgtttgcgtggagcggctgttgttctgtttgagcaattgacagtaattagtaaagtactttgtactgagagtagcaaaatctatcgccccagtgtttgaatgatattttgcaagattcttatcgctgtcaactcttttgattttgtgagcttgaagaccatgtttcgttgcaaccagtcattgcttagcttcagcgccttgcaatatctttgcttggcgatgtcc

SEQ ID NO: 4221 - DNA, 1019 bp, Triticum aestivum
attagcgtgttcgcgcacgagggtaagaagcagcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacacgatcctgttgaggggacccaagaatgcccgtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttctgtgtagtcgctgtttgcggggagcgactggtgttctgtttgagcaattgacagtaattagtaaagtactttgtactgagagtagcacaatctatcgcccccgtgttcggatgatattttggaagatccttatcgctgtcatctgttttgaatttttgagcttgaagaccatgttttgttgcttttctgttgacaatgtccactggtgaatgtgtctatgtgcgctccagtttgcagtatcattgtgttaactttgtaccccatctgttgcttagcaacatataattctgtagggcatttaaacttgttaaatgcaacttgattctgagaaatgttaatgaactgtgatgaact

SEQ ID NO: 4222 - DNA, 769 bp, Elaeis guineensis
  misc_feature (568)..(568): n is a, c, g, or t
  misc_feature (611)..(611): n is a, c, g, or t
  misc_feature (651)..(651): n is a, c, g, or t
  misc_feature (677)..(677): n is a, c, g, or t
  misc_feature (689)..(689): n is a, c, g, or t
  misc_feature (692)..(692): n is a, c, g, or t
  misc_feature (721)..(721): n is a, c, g, or t
cgagggcgggccgttaaaaccctagaaccgaagccgccgcaggggaccaaggagaggaggaggacctttagccatgggtatcgatctcaaagccggcggcagaagcaagaaggccaggcgcaccgcgcccaagtccgacgatgtctacctcaagctccttgtcaagctgtataggtttctagtgcggaggacggggagcaggttcaatgcggtgatcctcaggcgcctgtttatgagtaaggtcaacaagccccccctttccctcaaaaggctcgtcaccttcatgcaaggaaaggaggataagatcgcagttattgttggcacagtgactgatgataagagagtttatgaggttccagcaatgaaggtgacggctttaaggttcacggagacggctagggcaaggatcgtcaaggccgggggtgaatgcttgacctttgatcagcttgccctccgagctccacttggacagaacacggttctcctcaggggtccaaagaatgctagggaagctgtgaagcactttggtaaggctcctggagttccacacagccataccaagccttangtccgatccaaggggagaaaatttgagaagcaagaggaagaangaacagcaggggatttagggtttaagttggtttatcttgntttcatcccaaaggaagaacaaatgntgatgtttttancantgaggattgttgacatgcaaatttttggngtgtttcaggtttcagtagaaatttatcaggtctggcatgtaatgttc

SEQ ID NO: 4223 - DNA, 804 bp, Musa acuminata
  misc_feature (79)..(79): n is a, c, g, or t
  misc_feature (783)..(783): n is a, c, g, or t
ggggaatcagagcgccaaaaccctagaaccgaagcggcgcgaggagcagaggaacggcgagaggcaatgggtatcgatntcgtcgccggcggccggagcaagaaggcgaggcgcactgccccgaggtccgacgatgtctacctcaaacttctcgtcaagctctataggttcttggtgcggaggacggggagcaagttcaatgcggtgatacttaagaggctttttatgagcaagatcaacaggcccccgatctccctcaagaggctcatcactttcatgaatgggaaggataataagattgctgtcatcgttgggaccgtgaccgacgataagagagtttacgaggttccggcgctcaaggtgacggctctgaggtttacggagacagcgagggctaggattctcaaggctggtggggaatgcttgacttttgatcagcttgctcttcgggcgcctcttgggcagaacacggtactccttaggggtccaaagaatgccagggaagctgtgaagcactttggtaaagcacctggagttccacacagccacaccaagccttatgtccgatccaagggaaggaaatttgaaaaggctagaggaaggaggaacagcaggggttttagggtttgagccgcctcatatcattctaattactttacgagaactaaatggtactgttgtcgcattaaggatttcctattatcattgctgttttgcttttgtttcgattttgttaaggaaacaagaattgcttagttcatttgagaattttatttttaattngacatgcatgagttcaaaaaa

SEQ ID NO: 4224 - DNA, 1003 bp, Hordeum vulgare
gacgaggtaagaagcagcagccgcagcgcgaccccgcgaggaaaccctaccgccgccgccgcagaagcagccatgggtatcgacctcgtcgctggcgggaggaacaagaggaccaagcgcgtcgcgcccaagtccgacgatgtgtacctcaagctcctcgtcaagctctaccgtttcctggtgaggaggaccaagagcaagttcaacgccgtcatcctcaagaggctcttcatgagcaagaccaaccgcccgccgctctccatgcgccgtctctccaacttcatgaagggaaaggaggagaagaacattgctgtggttgttggcacaatcacagatgacatgcggatccaagagatcccagcaatgaaggttaccgctctgaggttcacagagacagcgagggcaaggattgtcaatgctggtggggagtgcctcacttttgaccagcttgctctccgtgctccaactggggagaacacgatcctgttgaggggacccaagaatgcccgtgaggcggtgaggcacttcggcaaggctcctggtgtgccgcacagccacaccaagccctatgtgcgctccaagggtaggaagtttgagaaggctcgtggtaggaggaacagccgtggcttcaaggtttaagttgccctttctggttagtcgctgtttgcgtggagcggctgttgttctgtttgagcaattgacagtaattagtaaagtacttagtactgagagcagcacaatctatcgccccagtgttcgaatgatattttggaagattcttatggctgtcaactgtttttattttgtgagcttgaagaccatgttttgttgcaccctgtctcttagaattctctgctggcaatgtctactgctgaatgtgttctctctacgtgatggtcagtgtagttggttctctttggtgccttgggctctatcctctttgatcagttgctgtatctttgcatgaactaatgcaattctgatgaattgcgttctcttgctt

SEQ ID NO: 4225 - DNA, 1022 bp, Hordeum vulgare
acttcccgagccggaggcgaaggaggtaagaagcagcagccgcagcgcgaccccgcgaggaaaccctaccgccgccgccgcagaagcagccatgggtatcgacctcgtcgctggcgggaggaacaagaggaccaagcgcgtcgcgcccaagtccgacgatgtgtacctcaagctcctcgtcaagctctaccgtttcctggtgaggaggaccaagagcaagttcaacgccgtcatcctcaagaggctcttcatgagcaagaccaaccgcccgccgctctccatgcgccgtctctccaacttcatgaagggaaaggaggagaagaacattgctgtggttgttggcacaatcacagatgacatgcggatccaagagatcccagcaatgaaggttaccgctctgaggttcacagagacagcgagggcaaggattgtcaatgctggtggggagtgcctcacttttgaccagcttgctctccgtgctccaactggggagaacacgatcctgttgaggggacccaagaatgcccgtgaggcggtgaggcacttcggcaaggctcctggtgtgccgcacagccacaccaagccctatgtgcgctccaagggtaggaagtttgagaaggctcgtggtaggaggaacagccgtggcttcaaggtttaagttgccctttctggttagtcgctgtttgcgtggagcggctgttgttctgtttgagcaattgacagtaattagtaaagtacttagtactgagagcagcacaatctatcgccccagtgttcgaatgatattttggaagattcttatggctgtcaactgtttttattttgtgagcttgaagaccatgttttgttgcaccctgtctcttagaattctctgctggcaatgtctactgctgaatgtgttctctctacgtgatggtcagtgtagttggttctctttggtgccttgggctctatcctctttgatcagttgctgtatctttgcatgaactaatgcaattctgatgaattgcgttctcttgctt

SEQ ID NO: 4226 - DNA, 599 bp, Festuca arundinacea
ggcacgaggcctcgtgccgcctcgtgccggaacaagaggaccaagcgcaccgcgcccaagtcggacgatgtctacctcaagcttctggtcaagctctaccgcttcctggtgcggaggaccaagagccacttcaatgccgtgatcctgaagcggctcttcatgagcaagatcaaccgcccgccgctctcgatgcgccgcctcgtcaagttcatggaggacaaggataaccagatcgctgttgtcgttggcaccatcacagacgacaagagagtctacgaggtgccagcgatcaaggtgaccgcgctcaggttcaccgagacggccagggcccgcattgtcaatgctggtggagagtgcctcacctttgaccagctggctctccgcgctcctcttggccagaacacggttctcctgaggggtcctaagaacgctcgtgaggcagtgaggcactttggtaaggctcctggtgtaccgcacagccacaccaagccttacgtccgctcaaagggaaggaaatttgagaaggccagaggaaggaggaacagcagaggcttcaaggtctaagctattgcatcgtgtcccatgtgctacacagctcc

SEQ ID NO: 4227 - DNA, 949 bp, Elaeis guineensis
  misc_feature (194)..(194): n is a, c, g, or t
  misc_feature (895)..(895): n is a, c, g, or t
  misc_feature (934)..(934): n is a, c, g, or t
cgaaagcggccgaaaccctagaatcgcctcccccttttatgtgaccgaagccagccgcagaacgaagtggtaggagcaaaacccttgcgagaatgggtatcgatctcgtcgccggtggccggagcaagaaggccaggcgcaccgcgcccaaatccgacgatgtctatctcaagctcctcgtcaagctctaccgntttttggtgcggaggaccgggagcaagttcaacgccgtgatccttaaacggctgtttatgagtaagatcaacaagcccccaatctccctcaagaggctcgcaaaattcatggaaggaaaggacgataagattgcggtcatagtggggactgtgacagatgataagagggtgtatgaggtcccagcaatgaaggtgacggctctgaggtttacggagacggtgagggctaggattcttaaggctggtggagagtgcttgacctttgaccagctcgctctccgtgcaccccttgggcagaacacggttctcttgaggggtccgaagaatgccagggaagctgtgaaacactttggtccggcccctggtgtgcctcacagccgcacaaagccttatgtccgttctaaggggaggaaatttgagagggccagaggaagaaggaacagcaggggatttagggtttaagcctcatcctagttattccaagggcaaacctaaatgttactatttgagtagcaagtatcgtctttctatgtttggaatatcttggtacgttaggacatgggaaagtgaagtgacgctcgacttttctgttcatttgattcaacgctttaaccgtttacatcgttatttatgagaaatttttgatggcttgttttgtcgtcaagttggtgatggcatgtgttctgtgactttggtttcanaaactggttgagattggcaatataaatcaccacttgctntcttaacaaagaaaa

SEQ ID NO: 4228 - DNA, 867 bp, Pseudoroegneria spicata
  misc_feature (6)..(7): n is a, c, g, or t
  misc_feature (53)..(53): n is a, c, g, or t
  misc_feature (834)..(834): n is a, c, g, or t
ccgttnntttcgggcggacgaggtaagaagcagcagccgcagcgcgaccccgngaggaaaccctaccgtcgccgccgcagaagcagccatgggtatcgacctcgttgccggcgggaggaacaagaggaccaagcgcatcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagagatcccagcaatgaaggttaccgctctgaggttcactgagacagcgagggcaaggattgtcaatgctggtggggagtgcctcacttttgaccagcttgctctccgtgctccaactggggagaacacgatcctgttgaggggacccaagaatgcccgtgaggcggtgaggcacttcggcaaggctcctggtgtgccgcatagccacaccaagccctacgtgcgctccaagggtaggaagtttgagaaggctcgtggtaggaggaacagccgtggcttcaaggtttaagtcgccctttctgtgtagtcgctgtttgcgtggagcgactgttgttctgtttgagcaattgacagtaattagtaaagtactttgtactgagagtagcacaatctatcgccccagtgttcgaatgatattttggaagattcttatcgctgtcaactgtttacaatttttgagcttgaagnccatgttttgttgcttgtctttgccaaaaaaaa

SEQ ID NO: 4229 - DNA, 918 bp, Triticum aestivum
ggacgaggtaagaagcagcagccgcagcgcgacaccgcgaggaaaccctaccgccgccgacgcagaagcagccatgggtatcgacctcgtcgccggcgggaggaacaagaggactaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaacttcatgaagggaaaggaggagaagaacattgctgtggttgttggtacaatcacagatgacatgcggatccaagaggtcccagcaatgaaggttactgctctgaggttcacagagacagcgagggcaaggattatcaatgctggtggggagtgcctcacttttgaccagcttgctctccgtgctccaactggggagaacacgatcctgttgaggggacccaagaatgcgcgtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttcttgttagtcgctgtttgtgtggagcggctgttgttctgtttgagcaattgatagtaattagtaaagtactttgtactgagagtagcaaaatctatcgccccagtgttcgaatgatattttgcaagattcttattgctgtcaactgttttgattttgtgagcttgaagaccatgtttcgttgcaaccagtcattgcttagcttcggtgcctctttgcttggcgatgtccattctctctaagtgatgttcattgtatttggttagcttc

SEQ ID NO: 4230 - DNA, 790 bp, Lolium multiflorum
ccggaggcggacgaggtaagaagaagaagcagccgcacaaggaaccctaccgccgccgccgccgcagcagccatgggtatcgacctcgaagccggcgggaggaacaagaggaccaagcgcgtcgcccccaagtccgacgatgtgtacctcaagctcctcgtcaagctctaccgtttcctggtgaggaggaccaagagcaagttcaatgctgtcatcctcaagaggctcttcatgagcaagaccaacctcccaccgctctccatgcgccgcctctccaacttcatgaaggggaaggaggagaagaacattgctgtggttgttggtacaatcacagatgacaagaggatccaagagatcccggccatgaaggttactgccctgaggttcactgagacggccagggcaaggattgtcaatgctggtggggagtgcctcacatttgaccagcttgctctccgtgctccgacgggggagaacacgatcctcttgaggggacccaagaatgcccgtgaggcagtgaggcactttggcaaggctcctggtgtgccgcacagccacaccaagccttatgtgcgctccaagggcaggaagtttgagaaggctcgtggtaggaggaacagccgtggcttcaaggtctgagttagtcgctgtctgcgtcgtgcgactgttgttctgtttgagcaattgacagtaattagtaaagtactttgtactgagagtagcccctgtgttggaatgatattttgcaagattcttatctctgtcaactgtttggagtttgtgagcatga

SEQ ID NO: 4231 - DNA, 798 bp, Avena sativa
gcttcccgagccggaggcggacgaggtaagaagcagcagcagcgaaggaaccctaccgccgccgcagccatgggtatcgacctcgaagccggcgggaggaacaagaggaccaagcgcacctgtcccaagtccgacgatgtgtacctcaagctcctcgtcaagctctaccgtttcctggtgaggaggaccaagagcaagttcaatgctgtcatcctcaagaggctcttcatgagcaagaccaaccgcccgccgctctccatgcgccgcctctccaacttcatgaagggaaaggaggagaagaacattgccgtggttgttggtaccatcacagatgacaagaggatccaagagatccctgccatgaaggttaccgccctgaggttcacagagacagcgagggcaaggattgtcaatgctggtggggagtgcctcacatttgaccagcttgctctccgtgctccaatgggggagaacacgatcctcttgaggggacccaagaatgcccgtgaggcagtgaggcacttcggcaaggctcctggtgtgccgcacagccacaccaagccctacgtgcgtgccaagggcaggaagtttgagaaggctcgtggtaggaggaacagccgtggcttcaaggtttaagttggtgtcccttagtgtctgtcggtgtcgtgggactgttctgtttgagcaattgacagtaattagtaaagtactttgtactgagagtagcacatcctattgccaccgtgttggaatgatattttgcaagattcttatgcatgaagacacttttttgttgca

SEQ ID NO: 4232 - DNA, 863 bp, Leymus cinereus x Leymus triticoides
  misc_feature (10)..(10): n is a, c, g, or t
  misc_feature (122)..(122): n is a, c, g, or t
  misc_feature (170)..(170): n is a, c, g, or t
  misc_feature (239)..(239): n is a, c, g, or t
  misc_feature (445)..(445): n is a, c, g, or t
  misc_feature (572)..(572): n is a, c, g, or t
  misc_feature (655)..(655): n is a, c, g, or t
  misc_feature (684)..(684): n is a, c, g, or t
  misc_feature (720)..(720): n is a, c, g, or t
  misc_feature (733)..(733): n is a, c, g, or t
  misc_feature (735)..(735): n is a, c, g, or t
gcagccgcancgcgaccccgcgaggaaaccctaccgccgccgcagccgcagaagtagccatgggtatcgacctcgttgccggcgggaggaacaagaggaccaagcgcgtcgcgcccaagtcngacgatgtctacctcaagctcctcgtcaagctctaccgtttcctggtnaggaggaccaagagcaagttcaacgccgtcatcctcaagaggctcttcatgagcaagaccaaccgcccnccgctctccatgcgccgcctctccaacttcatgaagggaaaggaggagaagaacattgccgtggttgttggtacaatcacagatgacaagcggatccaagagatcccagcaatgaaggttaccgctctgaggttcacagagacagcgagggcaaggattatcaatgctggtggggagtgcctcacttttgaccagcttgctctccntgctccaactggggagaacacgatcctgttgaggggacccaagaatgcccgtgaggcggtgaggcacttcggcaaggctcctggtgtgccgcacagccacaccaagccctacgtgcgctccaagggnaggaagtttgagaaggctcgtggtaggaggaacagccgtggcttcaaggtttaagttgctctttcttgttagtcgctgtttgngtggagcggctgttgttctgtttgagcanttgacagtaattagtaaagtactttgtactgagagnagcacaatctatngncccagtgttcgaatgatattttggaagattcttatggctgtcaactgtttttattttgtgagcttgaagaccatattttgttgcactggtgaatgtccactggtgaatgtgttctctcgaaaaaaaaa

SEQ ID NO: 4233 - DNA, 849 bp, Musa acuminata
  misc_feature (6)..(6): n is a, c, g, or t
  misc_feature (676)..(676): n is a, c, g, or t
gaaggnaggagtgcttccctcgagtcggcatgggtatcgatctcgtggccggaggccggagcaagaaggccagacgcactgccccgaggtccgacgatgtctacctcaagctcctcgttaagctctacaggtttctcgttcggaggaccgagagcaagttcaacgcagtgatccttaaacggctcttcatgagcaagaacaaccggccgcccatctccctcaagaggctcattactttcatggagagaaaggatgacaagatagccgttattgttgggacggtgacggatgataagagagtgtacgacgtgccggccatgaaggtgacggctctgaggttcacggagactgctagggcgaggattctgaaggccggtggggagtgcttgaccttcgaccagctcgccctccgagctcctctcgggcagaacactgttctcttgagaggcccaaagaatgccagggaagctgttaaacatttcggtaaagctcctggcgtgccacacagccacacaaagccctacgtccgctccaaggggaggaagtttgagagggccagaggaagaagaaacagcaggggtttcagggtctaagtcagccaagccgatgttcttgacccactatctatatcatctcttagtatgtgttaaatctcaacctcacaaggatttcttgngcttcttatcaacctgaatcaatccgactttgatgtttgttgacttcaaatgaactgcatgtgtttttggccctggtgggggtggtggtaaaccaactgtgcaacatggctttcttgtgtttttgatttatcatctgaattattgacttccatggtagatgatttcaattgcg

SEQ ID NO: 4234 - DNA, 862 bp, Manihot esculenta
gtcaacatatactcccccagcagcagcggcagcagcgactaggagctccaccagactttagcagcaatggggatcgatctgaaagcaggaggtaagagcaagaagaccaagcggacagcccccaaatccgatgatatctacctcaagcttctcgtcaagctctaccgctttctggtaaggagaaccggaagtaagttcaacgcggtgatcttgaagaggctcttcatgagcaaagtgaacaaacccccactttctctgtctaggcttatcaccttcatgaaaggaaaggagaataagattgcagtggttgttgggacagtgactgacgatatcagggtttatgaggttccagcattgaaggttactgctttgaggtttacagagacagccagagctaggattgagaaggctggcggagagtgcctgacatttgaccagcttgctttgagagctcctttgggacagaacacggttctccttagaggtccaaagaatgctcgtgaagctgtgaaacattttggcccagctcctggtgtgccacacagccataccaaaccatatgtacgatcaaagggaaggaagtatgagagagctagaggaaggaggaacagcaggggatttagggtttgagtcgtttttaatcctaaattgtgagacagttgttttatttctgactattgtgtccaaattttgttagactttagtttcctctggaacttgcttgttttatttccctttgaattatcagttaccagcatgaattgttttacgcttggcaatcatacttaactttcacatcttggtgtttaatgtttgagatataaaatcttgtttattagatacttatctggaattcagtgac

SEQ ID NO: 4235 - DNA, 863 bp, Manihot esculenta
ggtcaacatatactcccccagcagcagcggcagcagcgactaggagctccaccagactttagcagcaatggggatcgatctgaaagcaggaggtaagagcaagaagaccaagcggacagcccccaaatccgatgatatctacctcaagcttctcgtcaagctctaccgctttctggtaaggagaaccggaagtaagttcaacgcggtgatcttgaagaggctgttcatgagcaaagtgaacaaacccccactttctctgtctaggcttatcaccttcatgaaaggaaaggagaataagattgcagtggttgttgggacagtgactgacgatatcagggtttatgaggttccagcattgaaggttactgctttgaggtttacagagacagccagagctaggattgagaaggctggcggagagtgcctgacatttgaccagcttgctttgagagctcctttgggacagaacacggttctccttagaggtccaaagaatgctcgtgaagctgtgaaacattttggcccagctcctggtgtgccacacagccataccaaaccatatgtacgatcaaagggaaggaagtatgagagagctagaggaaggaggaacagcaggggatttagggtttgagtcgtttttaatcctaaattgtgagacagttgttttatttctgactattgtgtccaaattttgttagactttagtttcctctggaacttgcttgttttatttccctttgaattatcagttaccagcatgaattgttttacgcttggcaatcatacttaactttcacatcttggtgtttaatgtttgagatataaaatcttgtttattagatacttatctggaattcattgac

SEQ ID NO: 4236 - DNA, 1191 bp, Citrus sinensis
aaccatcgaacacttacccgccgcgccagcgcccagccactcgccaaccgtcgccatgggtatcgatttggtcgcaggaggtaagagcaagaagtccaagagaaccgctcccaagtccgatgatatctaccttaagctcctcgtcaagttgtaccggtttcttgttcgaagaaccgacagcaactttaataaagtgattctgaagaggctgtttatgagtaaagtcaacaagccaccactttcactctccaggctcatcaacttcatgaagggaaaggaggataagattgcggtggtagtggggacagtcaccgatgacattagggcttacgaggtgccggcattgaaggttactgctttgaggtttactgagactgcaagagctcggattgagaaggcaggcggagagtgcttgacttttgatcagcttgctctcagggctccattgggacagaacacggtccttcttagaggtccaaagaatgcccgtgaggcagtgaagcactttggtccagctcctggtgtaccacacagccacaccaagccttacgtgcgatcaaagggaaggaagtttgagcgtgctagaggaaggaggaacagcaggggtttcagagtttaagtttactaaattgtgaggcagttgtgtcatttcttactatcgtgattgaaattttgctagactctaggtatcaattatggttccctatttttcttactgttggtttaattaccatgacaacggatgccttgttttgagatgcaattttattactttcaattaaaaaaaaaaaacaaaaaaaccccacctttccttgtacgaggtgggcatttaacaaaagattgcttttctatatttgaggcaacgaaaggggcccaaacaggctaacataaattcattattgaggatcccggctttaaaccctctatacgggacatataatcttacagataggaatttcccagggccctcgggccagtctcagtaatctagcctaaagtccttcacttcagaaattaaccaatttatttatttcgattacaccacaacactctcacaccaacaattatctctatatataaaccttgctctgtgacgaaaaactctcttaatactgactttcaaggccttctttttctacttcgagacgttcttattcacaacgagtcgcgcccctcctctcttccttttcc

SEQ ID NO: 4237 - DNA, 787 bp, Gossypium hirsutum
aagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggcaggaggaacagccgtgggttcaaggtttaagaaagttgtgggccatcagcatagtaatcacttcctaccgagtagtagcacattttgttgccttggcttggattttgaaagatatttaaggattttcgtgccttgtctactggttactggttgagcaagaagacaatgttcttttgcacctctttttattggtcggcatattttgcgctgtgattggaactgtgttgtgttatctgctggatgtacttactgcatcacctagaaaggtggcttgagccatttggaa

SEQ ID NO: 4238 - DNA, 804 bp, Saccharum officinarum
  misc_feature (285)..(285): n is a, c, g, or t
  misc_feature (357)..(357): n is a, c, g, or t
  misc_feature (389)..(389): n is a, c, g, or t
  misc_feature (429)..(429): n is a, c, g, or t
  misc_feature (436)..(436): n is a, c, g, or t
  misc_feature (459)..(460): n is a, c, g, or t
  misc_feature (465)..(465): n is a, c, g, or t
  misc_feature (506)..(506): n is a, c, g, or t
  misc_feature (513)..(513): n is a, c, g, or t
  misc_feature (520)..(520): n is a, c, g, or t
  misc_feature (525)..(525): n is a, c, g, or t
  misc_feature (541)..(541): n is a, c, g, or t
  misc_feature (552)..(552): n is a, c, g, or t
  misc_feature (565)..(565): n is a, c, g, or t
  misc_feature (567)..(567): n is a, c, g, or t
  misc_feature (570)..(570): n is a, c, g, or t
  misc_feature (584)..(584): n is a, c, g, or t
agcagcagcagcagcaggaaccctagcgccgccgcatccgcagccatgggtatcgacctcgtcgccggcgggaggaacaagaagaccaagcgcaccgcgcccaagtccgacgatgtctacctcaagctcctcgtcaagctctaccgtttcttggtcaggaggaccaagagcaacttcaacgctgtcatcctcaagaggctcttcatgagcaaaaccaaccgcccaccaatctccctgcgccgcctcgtcaagttcatggaaggaaaggaggagaacattgctgtnattgttggcacagtcacagatgacaagaggatccaggaggttccagcaatgaaggttactgccctgaggttnaccgagacagcaagggccaggattgtcaatgntggtggggagtgcctcacatttgaccagcttgctctccgngctccanttggcgagaacacggtcctcttnnggggncccaagaatgcccgtgaggcggtgaggcactttggcaaggntcctggngtgccanacagncacaccaagccatatntgcgctccaanggaaggaagttcnanaangctcgtggcaggangaacaaccgtggattcaaggtttaaaaaagttgtgggccttgttcgtgttgccatcagcatagagcaaccgttttgtttgatcaatcgacagtaattagtaatcactttctaccgagtagtagcacaatttgttgacttggtttgaattttgaaaaatgtttgaaggatttggttgccttatttactggttgagcaagaatacaatgttttgttgcacct

SEQ ID NO: 4239 - DNA, 899 bp, Cleome gynandra
ctcttttaaaagtttccatctaaaccctggctccctctctctttgctgagcgttttgaacatacgaacgaacaggcgaggcttcccctttcgaattcttcggagaaatggggatcgatttggttgcaggaggtaagagcaagaagacgaagagggttgctcctaaatctgatgacgtctatctcaagcttcttgtaaagctttaccggtttttggtaaggaggaccggcagcaatttcaatgctgtgattctgaagcgacttttcatgagcaaagtgaacaaagcccctatttctctctcgagactcgtcaaattcatgcaggggaaggaggacaagaatgctgtgatagttggaaccgtaactgatgacttgagagtttatgaggtccctgcacttaaggttactgcacttaggttcaccgagacagctagagcaagaatcgagaaggctggaggagaatgcttaacatttgatcagcttgctctccaggctcccctgggccaggatacggttcttcttagagggcctaagaacgcccgtgaagcagtgaagcattttggtccagcacccggtgtgccacacagccacaccaagccattcgttcgctcgaagggaagaaagtttgagagagccagggggcgcaggaacagccgtggattcaaggtttaatatcggcagttttactctatataaacccagcaaatccatttatttattgcagctctcaaagtttaagtcaaaccgtccagttttgggtttcttggcaccgtttatcgacgatgtattcctcaattcttttacatcttttgtggattaaacccatcttagcttttactatttcagtttgacgctaaaccggttcaacaaaccggtttatgtttgttttctctggcttaaa

SEQ ID NO: 4240 - DNA, 859 bp, Cleome spinosa
cagcagtcgaaggcccgagccgcttcgccagtccctgcaacaatgggtatcgatttgaaggccggaggtaagagcaagaagacgaagcgcactgcgcctaagtccgatgatgtctatctcaagctcctcgtcaagctatatcggttcctagtgaggagaactggaagcaagttcaatgctgtgattcttaagcgcttgttcatgagtaaagtgaacaagccgccattgtctctctctcgtttgatccgctacatgcagggaaaggaggaccagattggtgttattgttggcactgtgactgatgatgcaagagtgtatgaagtcccagctcttaagatcacggcactgagattcacggagagggcgagggccaggatcgagaaagctggtggggagtgtctcacatttgatcagctggctcttcgtgcacctcttggccagaacacggttctactgagaggccctaagaatgcacgtgaagctgtgaagcactttggtcccgctcctggtgttcctcacagccacaccaaaccgtacgtccgatcaaagggcagaaagtttgagagagctcgaggtaggagaaagagccgaggattcaaggtttaagcccaccaatctgccaaagcagctagtaactccctgttctttttttactgtaagtcactttgtgtcatctttgtccgaaaagacctgcgtttattttgcttgcaagctttcgactttttcagccgttgttgaattacactgcatgctattgctcttatcctatatgatgtcgactttgaacccttttccctcgaggtatcgctttcttgtttccaatcatctgtgtggattaagctcagtgattatgtgatgc

SEQ ID NO: 4241 - DNA, 754 bp, Cleome spinosa
aacgagcaacgggcgaggtttcccgatccaattcttcagaaaaatggggatcgatttgattgcaggagggaagagcaagaagaccaaaagggttgctccgaaatctgatgatgtttatctcaagcttcttgtcaagctttaccggtttttggtaaggaggaccggcagcagtttcaatgctgtgattctaaagcggctcttcatgagtaaagtgaacaaggccccaatttctctctcgaggcttgtccgcttcatgcaggggaaggaggacaaagttgctgtaatagttggaaccgtgactgatgacttgagagtgtatgaggtccctgcacttaaggtcactgcacttaggttcactgagacagccagggcaagaatcgagaaagctggaggagaatgtttgacatttgaccagcttgctctccgagctcccctcggccagaacacggttcttcttagagggccaaagaatgctcgtgaagcggtgaaacactttggtccagctccaggtgtgccgcacagccacaccaagccttatgtccgtgcgaagggaagaaagttcgagagggccagaggacgcagaaacagtcgtggattcaaggtttaatatttgatatcttcgccttatttttttcccctattgcagaactcaaagtcttgtcggaccatctagttttggggtgtgctctgtttgtggacaatgcatcgctcaattctttacatctttgtcgattactcattcttggcattagcc

SEQ ID NO: 4242 - DNA, 813 bp, Linum usitatissimum
ggttcgtcaaagctccgtctccactagccaccaccttagccagcggcgtctgagctccagatcctaccggcggccatgggtatcgatttgaaggcaggaggtaagaggaagaagaccaagaggacggctcccaagtccaatgatatctacctcaagcttctcgtcaagctgtaccgatttctcgtgaggaggactggaagcagcttcaacggtgtgattttgaagaggctgttcatgagcaaggttaacaagcccccgctatctctctccaggctcatccgattcatgaagggaaaggaggggaagattgctgtgattgttggaacaatcactgatgacatcagagtttatgatgttccagctatgaaggttactgctttgaggttcactgagactgctagggctagaattgagaaggctggtggtgagtgcttgacattcgaccagctcgccttgagagctcctctcggccagaacacggttctgctcaggggtcctaagaacgcccgtgaggcagtgaagcactttggtcctgcccctggtgtgcctcacagccacaccaagccatatgtcaggtcgaagggaaggaagtttgagaaagctaggggaaggaggaacagcagaggattcagggtttaagctgttggtggttttcctgtgagttgtgtcgagtttagagggccgtttgtgtttctttccatctataagacttggtattcccaacatttttgctagaaccagtaatctgttgaacaaagcttatccttctgattgctatatccctttttgaaggtcatatattatgactcttcc

SEQ ID NO: 4243 - DNA, 844 bp, Jatropha curcas
ctagtggataccccggggctgcaggctccaaccagcagctgtattagcggcgtgcagcctcggaggtccaacacgctaaagctctaatggggatcgatttgaaagcaggaggtaagagcaaaaagaccaagcgcacagctcctaaatctgatgatatctatctcaagctacttgttaagctataccgatttctggtaaggagaaccggtagcaagttcaatgcggtgatattgaagaggctgttcatgagcaaggtcaacaaaaccccgctctctctctctaggctcatcaggttcatgaagggaaaggagagtaagattgcagtggttgtgggcacagttaccgatgacattagggtttatgaggttccggcattgaaggttactgccttgaggtttacagagacagcaagagccagaatcgagaaggctgggggagagtgtttgacatttgaccagcttgctctgagagctcctttggggcagaacacagttctcttaagaggtcctaagaatgctcgtgaagctgtgaaacactttggcccagctcctggtgtgccacacagccataccaaaccatatgttcgatcaaagggtaggaagtttgagagagctagaggaaggaggaacagcaggggatttagggtttgacgtgtttttagttctaaattgtgaggcacttgttttacttttcccaaattttgttagactttaggttcctttggaacttgtttatgttattcttctcggttatcaattatcagtctgaattgttttatgcttgggaatcatatttcactcttacaaaattggtaatgctttaattaaattttgagttttacact

SEQ ID NO: 4244 - DNA, 871 bp, Amborella trichopoda
ctacattctcgcgctgcaattgcaggacgaaaccctagcttgtagccatgggtatagatctggtagccggagggaagagcaagaaaactaagcgcactgcgcctaagtcaggtgatatttatctgaaactcctggttaagctatacaggtttcttgttaggcggaccggtagtaaattcaatgctgttatattaaagaggcttttcatgagcaagattaacaggccacccatttcgctctctcggctgattaagttcatgcaagggaaggaaggtaagattggtgtcattgttggttgtgtcactgatgatacccgagtatatgaagttcctgcactgaaggtggccgcactaaggttcacagagactgctagagctagaattgtgaaagcagggggtgaatgccttacgtttgatcagcttgctctcttggctcctcttgggcagaatacagttcttttgcgtggacccaagaatgctcgtgaggcagtgaagcactttggcaaggcaccaggtgtgcctcacagccacactaagccttatgttcgatctaaggggaggaagtttgagagagcaagaggcaggaggaacagccgaggtttcagagtctgatgctctatgctttcctttattgtgtttgcattccgtttttgaggttttaatccttgctttagaaactgaggtctacaagttttgcttttcaaagggcaattttttggtagtgcatgagtgagaacttgttcttatggtgaatgtcactcttgaaaatgaggtaaacttttctttcattttctggaatattagaagttaacttcaaagagtatgagtggattaggtacgttaatatatatgtattgttggtactgtcttca

SEQ ID NO: 4245 - DNA, 738 bp, Musa acuminata
ggagccttccagaaaccctagaaactgcgccgtcatgggtatcgatatcgtcgccggaggccggagcaagaaggcgaggcgaacgtcgccaaggtcggacgatgtttaccttaagctcctcgtcaagctctacaggtttttggtgcgaaggacgggtagcaagttcaatgcggtgattctaaaaaggctcttcatgagcaagatcaaccggcctccgatatccctcaaaaggctaattacttttatgaatggaaaggatgacaaaattgcagtcatcgtgggaacggtgactgatgacaagagggtttacgaagtgccagcaatgaaggtcacggctctgaggttcacggagacagcaagagccaggattctgaaggcaggtggggagtgcctgacgtttgatcagcttgccctccgtgcacctcttggacagaacactgtactcctgaggggtccaaagaatgctagggaagctgtgaagcactttggtaaggcacctggagttccacatagccacaccaagccttacgtccgatccaagggaaggaagtttgaacgggctcgcggaaggaggaacagtaggggtttcagagtttgatttggcccttgttgttattgtttcgtaaaaagttttgcacaactcctgctgcagtgagaactctactttcccaaaaattgtggtgttttgttttcttaaaggatgcttcggcttggaaacacgaattcaatttttctagc

SEQ ID NO: 4246 - DNA, 901 bp, Theobroma cacao
cggggctttcatttcttgtttatcgtgtctttcttcatcagtcgcagcgcctccccacttcaaaccaccaaaagcgttcggcaatggggatcgatttagtcgcaggaggtaagagcaagaagtccaagaggacagctcccaaatctgatgatatttacctcaaactcctcgtcaagctttatcgtttccttgtaagaagaactgggagcaaattcaatgctgtgatattgaaacgcttgtttatgagcaaagttaacaagcctccactatcactctctaggcttattgagttcatgaagggaaaggaggataagattgctgtggtagttgggacagtgacagatgatataagggtttatgaggttccagctttgaaggttacagctcttaggtttactgagactgctagagctaggattgagaaggctggtggagaatgcttgacttttgaccagcttgctttgagggctcctttgggtcagaacacggttctcctcagaggtccaaagaatgcccgtgaagcagttaaacactttggtccggctcctggtgtgcctcacagccacactaagccatatgtgcgctcaaagggaaggaagtttgagagggctagaggaagaaggaacagcaagggatttagggtttaagatgacattagtatttcattgtgaggcctgtctgtcatttattactgcaaaccaaattttggtagactttaggtttctctgtcagttgtttacttgcttatgtttacttcatgttggtggattgtttaatggctggtttgaggatcaatctttcctatgctacaaagtcgagcgtgtttaagcatttttaatggagttatattttactatggaattattctctggttaatactgcacttattattgggattata

SEQ ID NO: 4247 - DNA, 1045 bp, Ricinus communis
tatcatgagccggacccatcgagtctataggcacaccgccccactctctcaagtctcaacccattaacaaaatgaatcagccacgtgtacggaaaataactgaggcgcatagtagaagtcgatagacttcaccacaaatagaagtagccaatcacaactctttccctacaaagtcctgaaaaaccctagccactctccctttaagcacatttgcctcgctgaaagtcgcgcgccgggcagcactaacagtatcagagatgggtatcgatttgaaggcaggaggtaagagcaagaagactaagcggacagcaccgaagtccgatgatatctacctcaagctcatcgtcaagctgtaccgattcttggtacggagaactggaagcaaattcaatgcagtgattttgaagaggctttttatgagcaagattaacaaagcccctctttcattatcacgtttgattactttcatgaagggcaaggagaataaaattgctgtgattgtgggtactgtgactgatgatgtccgggtgtatgaagtccccgctctcaaggttactgctctcaggttcaccgagacagcaagggcgaggattgagaaggctggtggagaatgtttgacgtttgaccaacttgctcttagagctcctcttggtcaaaatacggtcctcctcagaggtcccaagaatgcccgtgaggcagtgaagcactttggaccagcacctggtgtaccacacagccataccaaaccctatgtccgagcaaagggaaggaaatttgagcgggctagaggaagaaggaacagcagaggctttagggtgtaagcactcacacctcgttcagaaaatcagtctacaaatttcaaccagatgcatccatgcaccaacagttgatctggttattttttcttgtgttttctcatcctctagtgtggaacaattacattatcttagcgggtcaacatctgcagtttattttgtatttcgctttaaacaatagattttggatgtcagagtaaagattgctagtattttttatggcttttgta

SEQ ID NO: 4248 - DNA, 866 bp, Ricinus communis
catttgcctcgctgaaagtcgcgcgccgggcagcactaacagtatcagagatgggtatcgatttgaaggcaggaggtaagagcaagaagactaagcggacagcaccgaagtccgatgatatctacctcaagctcatcgtcaagctgtaccgattcttggtacggagaactggaagcaaattcaatgcagtgattttgaagaggctttttatgagcaagattaacaaagcccctctttcattatcacgtttgattactttcatgaagggcaaggagaataaaattgctgtgattgtgggtactgtgactgatgatgtccgggtgtatgaagtccccgctctcaaggttactgctctcaggttcaccgagacagcaagggcgaggattgagaaggctggtggagaatgtttgacgtttgaccaacttgctcttagagctcctcttggtcaaaatacggtcctcctcagaggtcccaagaatgcccgtgaggcagtgaagcactttggaccagcacctggtgtaccacacagccataccaaaccctatgtccgagcaaagggaaggaaatttgagcgggctagaggaagaaggaacagcagaggctttagggtgtaagcactcacacctcgttcagaaaatcagtctacaaatttcaaccagatgcatccatgcaccaacagttgatctggttattttttcttgtgttttctcatcctctagtgtggaacaattacattatcttagcgggtcaacatctgcagtttattttgtatttcgctttaaacaatagattttggatgtcagagtaaagattgctagtattttttatggcttttgtatggtagtgctgtggtataattacgaatt

SEQ ID NO: 4249 - DNA, 816 bp, Gossypium hirsutum
ctcaaccgcaaaaaaaaaaaaaaagagtagcagttccggtttcaccagctatgggtattgacttggtcgctggcggcaagagcaagaagacgaagagaactgctcccaagtctgatgatatatatctcaagctccttgtcaagctttaccgctttctggtaagaaggactggcagcaaattcaatgcggtgatcttgaagcggctatttatgagcaaaaccaacaagcctcctttatctctttctagattgattcaattcatgaagggcaaggaggataagattgctgtggtagtcggggctgtcaccgatgacattcgtgtgtatgaagttcctgcgctgaaggttactgcgttaaggttcactgaaacggccagggcaaggattgagaaagctggtggggaatgtttaacttttgaccaacttgctcttcgagcacctcttggacagaacacggttctcctccgaggtccaaagaatgctcgtgaggcagtgaagcacttcggaccagctcctggcgtgccacacagccacaccaagccctatgtgcgggcaaagggaaggaaatttgagagggctagaggaagaaggaacagcaaaggcttcagggtttgagtttgtgattaccctggaacaaaatgacttgtcgtcaacctattctcatgaaaatgagaattctctgtttttcttattttgtttttccatggaacattattataattggggatattttgtaattttgtttatcaaggaaattttggattgattaaaacgtttttttccctcttctaaatctatatggagtatttatgggtgc

SEQ ID NO: 4250 - DNA, 858 bp, Gossypium hirsutum
ctaagttgctattaaggccattttccctcgctcggcactgccttccccctcgtatcagcttcaccggccatgggtatcgacttggtcgccggtggcaagagcaagaagacgaagagaactgctcccaagtccgatgatatctacctcaaactcatcgtcaagctttaccgatttctggtaagaaggactggcagcaaattcaatgctgtgattttgaagcgtctttttatgagcaaagtgaacaagcctcctctctctctatccagattgattgaattcatgaagggcaaggaggataagattgcagtggtagttggaactgtcaccgatgacattcgtgtatatgaagttcccgctctgaaggttactgcactaaggttcactgagacagcgagggcgagaattgacaaggctggtggggaatgtttaacatttgaccaacttgctcttcgagcacctcttggacagaacacggttctcctccgaggtccaaagaatgctcgtgaggctgtgaagcacttcggacctgctcctggtgtgccacacagccacaccaagccctatgtgcggtcaaaaggaaggaaatttgagagggctagaggaagaaggaacagcaaaggcttcagggtttgagattccaattgccctggaaaaaaaaaacttatcaacctatcatgataatgggaatgctcagttttgctttttgtgctttccacctttcctgttctttttcttttccatgattgtaatttggaatcttttataatttgtttaatgaaaaggattttagagtgattgaagaacgttgttggatgtctgtatttcttatatataaatcagaacagcattgagttccat

SEQ ID NO: 4251 - DNA, 848 bp, Vigna unguiculata
gcctagcacaattttctccttggtgacggcatcagcaacagcgcgggcggcgagaagctacattcgcgatgggaatcgatttgaaggcaggaggtaagtccaaaaagaccaagcgaaccgccccaaaatccgatgacatttacctcaagctcctcgtcaagttgtaccgttttcttgttcggaggactgggagtaatttcaatgccgtcattctcaagcgtcttttcatgagcaaggtcaacaagcctccgctatccctctctagattgatccgttacaccaagggaaaggaggataagattgctgtggtggttggggccgtcactgatgatattcgtgtgtacgaagtgcctgctctgaaggtagcagcactgaggttcactgaaactgccagagctaggattgagaaagctggcggggaatgcctcacctttgatcaactggctcttagagctccactcggccaaaacacggttcttcttagaggtcctaagaatgctcgggaggctgtgaagcactttggaccggctcctggtgtgccccatagccataccaagccctatgtccgttcaaagggtcggaaatttgagcgggccagagggagaaggaatagcagaggctttagagtttgagttttgtaactcaaacatgaaggaattttcctcttaccttgtgatcattatgtactgttttctcgtgctttttgaacaattgttaattttagtttttactattccttccaagggaaaaaatattgaagctccttccccgaacaattttgttctagcagactacttttgagaggattaatgagtaactattggcctacttaaggtgtgtttatggca

SEQ ID NO: 4252 - DNA, 1342 bp, Zingiber officinale
  misc_feature (600)..(600): n is a, c, g, or t
  misc_feature (620)..(620): n is a, c, g, or t
  misc_feature (682)..(682): n is a, c, g, or t
  misc_feature (756)..(756): n is a, c, g, or t
  misc_feature (785)..(786): n is a, c, g, or t
  misc_feature (790)..(790): n is a, c, g, or t
  misc_feature (860)..(860): n is a, c, g, or t
  misc_feature (902)..(902): n is a, c, g, or t
  misc_feature (968)..(968): n is a, c, g, or t
  misc_feature (1011)..(1011): n is a, c, g, or t
  misc_feature (1073)..(1073): n is a, c, g, or t
  misc_feature (1083)..(1083): n is a, c, g, or t
gttaaaattatttaaatctcaatcgattatatttgatacagtcatttaactaggtaataattgaacaacaaaatcaataaacgcccgcatgcatcgaggatggcttaattgttgttggaagaggaggcgccggtggacgccttagccaaggaagttatattcacctgtgcgccgagcaactgcgtgcccacctcggcagtgaaggagtcgtaccggataaagaaatccacgacgagcagccgccccacgaggaccaccagatccttcgctgggcactgcttgttcgccaccgtcgggctcactgtctctggcccgttcgaccaaaccacgtactcgagcaacttctgcccctcctcgcccacgaaccgatccggcacgaactggtcggcttggtcgaagactttggggtcgcgcgtggcgaaaggttggtagccgaaaagcatctcgcctgagcgcacttggtatgccccatcgtggctctcgatgatcaagtcgcgcttagcgtgcccgtattggtacttcacgggagggtccaggcgcagtgcctcgtaaaccaccgagcgcgtcagttccatccgttccactgcgggcaacaagccnccatgggtatcgatttagtngccggcggtcgtagcaagaaaactcgtcgcacggcccccaaatccgacgatgtctatctcangctcatagttaggctctacaggtttctggtgcgtaggactggaagcaagttcaacgccgtgatcctcaaacggntcttcatgagcaagaccaaccggcctccnntatnccttaggaggctgatcaagttcatggaaggaaaggaagacaaaattgccgtgattgttgggacggtgacngatgataagagagtatacgaggtgcctgctattaaggtgacngctcttaggttcacggagactgcaagggcgaggatcttgaaggcaggaggagagtgcctcacgttngaccagcttgctctacgagctcctcttgggaagaacactattntcctgagaggtcccaagaacgcaagagaagctgttaagcactttggtagagctcctggtgtnccacacagcnatacaaagccctacgtgcgatccaaggggaggaagtttgagaaggcaaggggtagaaggaacagcagaggattcagagtttgagttggtctattcgatactttgggagttgtattggagtgcaaaaatcttccatcatgttctttcttctgttctattttgcatcgcctgggatttgtcaatttcgcttagatttctcatgcctttttgacttgattcgttaatgatcaaaccaaaatgtagtttgcatttggtttctt

SEQ ID NO: 4253 - DNA, 926 bp, Vitis vinifera
aaaccctaatctcatttgcctcgaaggtcgaagaaaccctaactctcatctctctagcggcctccaacttcaacttctcacaatggggatcgatcttgtcgccggaggcaagagcaagaagaccaagcggaccgcccccaaatccgatgatatttacctcaagcttctcgtgaagctgtaccgcttccttgtgcggagaactggaagcaagttcaatgcggtgatactgaagaggctgtttatgagcaaggtcaacaaacctccactttctctctccaggttggtccgttacatggggggaaaggagggaaagattgctgtggttgtggggactgttacagatgatattagggtttatgaagttcctgcattgaaggttacagcattgaggttcacagagactgcaagagcaaggattgagaaggcaggtggagagtgcctgacttttgatcagcttgcactcagggctccactcggacagaacacggttcttctccgaggccctaagaattctcgtgaagcagtgaaacactttgggaaagctcctggtgtgccacacagccataccaaaccttatgtgcggtcaaagggacggaagtttgagagagctaggggcaggaggaacagcagggggtttagggtttgagttaattataatacttagttgtgaggttgtttgtcatttcttactatggcaattcaaattttgctagacttctaggaatctattgaagtcatttgtggtatttttatgttcttatgggttttcattttttatttggacaaccgaacacctgcttaagacttaaatatcatttccctactttgcaactgatttgtggaattaaaagaaactatgctcagatggtagttgactatcaaaactttcaataaaaaagtgttaaatgacatgatcagatgctgat

SEQ ID NO: 4254 - DNA, 741 bp, Allium cepa
gacgaagcagccacatcactgctcatgggtatcgatctcatcgctggtggtaggaacaagaagacgaagcgcaccgcgaccaagtccgacgatgtgtacctcaagctacttatcaagctgtataagtttttagttaggaggacaggtagtaagttcaatgctgtaattttgaagaggctccttatgagcaggaccaatcgccctcccctttctatgaggagattgattactttcatgaaaggaaaggagaataatattggcgtattagttggaactgttactgatgataacagagtgtatgaggtgcctgcaatgaaagtggcagccttgaggtttactgagaccgcaagggcaagaatcctgaaagctggtggagagtgtttgactcttgatcagctagctcttcgtgctccacttggacagaatactattctgttgcgggggccaaagaatgctagggaagcagtgaagcattttggtccagcgcctggtgtacctcacagtcacactaagccctacgtgcgatcaaagggaagaaagtttgaaaaggccagaggtcgtagaaacagcagaggctatagaaactgaggagctaactcccaactctctctgcatatgttactgttttgcgcaaatatggaaccatttgtttcactttgtactagtgtgttatgctctctattttggtttgaacgtggtgtaccatcacttcccacttttttagttttgatttgtattagt

SEQ ID NO: 4255 - DNA, 924 bp, Carica papaya
aacccttctttgtcttccgtgactcgtctctttgaaactgagcactcgccggcagcaccagcaccagcactccagcagcaatgggtatcgatttggtagctggcggtaagagtaagggttccaagcgaactgcccccaaatctgacgatatctacctgaagctcctggtcaagttgtaccggtttctggtgaggaggactggtagcaacttcaatgccgtgatattgaaacgtctcttcatgagcaaggtcaacaaggcacctctatcgctctctcggctcatccgtttcatggagggaaaggagggcaagattgctgtggttgttgggactgtaacagacgatgttagagtgtatgaagtcccagctcttaaggttactgcattgaggttcaccgagactgcaagagcaaggattgagaaggctggtggggagtgtttaacatttgatcaactggcccttcgtgctcctcttgggcagaacacggttttactccgtggtcctaagaatgcccgtgaggccgtgaagcactttggaccagctcctggtgtgcctcatagccacaccaaaccctatgtacgatcaaagggaagaaaatttgagagggctagaggtagaagaaacagcaaaggcttcagggtttaagttggattcttggaaggaaaaagcaaaccatgcaaacgacacctatccaagcagagagagatctataaatttgcaattgccttttggtttttttttctcaaatctttgtgtaagagtgttattttgtcaggttttaacctataactttggactgtgtatttttgggttggaaacgttgaagttactatctagtttcttggagataagttcaaaagaaattgttttaatttcttaatttgtaaattttggagagatatttgcaaaattaaaaatttctggg

SEQ ID NO: 4256 - DNA, 798 bp, Cleome gynandra
tcgggggtcttctaccgcagtcgaaggtcctgaaccgcttcgccagtccctgcagcaatgggtatcgatttgaaagccggaggtaagagcaaaaagacgaagcgcactgcgcctaagtccgatgatgtatatctcaagctcctcgtcaagctgtatcggtttctagtgaggagaacgggaagcaagttcaatgctgtgatattgaagcgcctgttcatgagtaaagtgaacaagccaccgttgtctctctctcgtttgatccggtatatgcagggaaaggaggagaacattggtgtgattgttggcactgttactgatgatgtaagagcgtatgaagtcccagctcttaagatcgcggctttgagattcacagagagggcaagagccaggatcgagaaggcaggtggggagtgcctcacatttgatcagctggctctacgtgcccctcttggccagaacacggttctcttgagaggtcctaagaatgcccgtgaagctgtgaagcactttggatctgctcctggtgttccacacagccacaccaaaccatacgtgcgctctaagggcagaaaatttgagaaagccagaggaagaagaaagagtagaggtttcaaggtataagtcagaacagcactgtgacaaaatcatcgcgtttaaacgtggtaactcccatttccttttacggtcagtaaacttatgtttatctttgtccaagacctgcttttattttatttttgttgaatcacatgacttgttcttatcatgaatggtatttagttggaacttgtttgtcctcaa

SEQ ID NO: 4257 - DNA, 616 bp, Cleome spinosa
ggcttcttcagcagtcgaaggtcccgagccgcttcgccactccctgcaacaatgggtatcgatttgaaggccggaggtaagagcaagaagacgaagcgcactgcgcctaagtctgacgatgtctatctcaagctcctcgtcaagctgtatcggtttctagtgaggagaaccggaagcaagttcaatgctgtgattctgaagcgcttgttcatgagtaaagtgaacaagccgccattgtctctctcacgtttgatccggtacatggagggaaaggaggacaatattggcgttatcgttggcactgttacagatgatgctagagtgtatgaagtcccagctcttaagatcactgcattgagattcacggagagggcgagagccaggatcgagaaggctggtggggagtgcctcacatttgatcagctggctcttcgcgcccctcttggccagaacacggttctactgagaggcccgaagaatgcacgtgaagccgtgaagcactttggacctactcctggtgttcctcacagccacaccaaaccctacgttcgttcaaagggcagaaagtttgagagagctcgaggtaggagaaagagccgaggtttcaaggtttaag

SEQ ID NO: 4258 - DNA, 797 bp, Cucumis sativus
attctttaaaaaccctaagaaccatttgcttcactcttagccgtcgccgtcgctcaagacaagggtttctccaccaaaagctccaatgggtatcgatctggtagccggaggtaagagcaagaagaccaaaaggactgcccccaagtccgatgatatctacctcaagctcctcgttaagctgtaccggtttcttgtccgaagaactggaagcaatttcaatgcagtgatcctcaagcgcttgttcatgagcaaggtgaacaagccaccaatttcactatccagacttatcaagtacatgaatggaaaggaagggagaattgctgtcattgttggaaccgtgacagatgacatccgtgtttacgaagtcccagcattgaaagttacagccttgaggttcactgagaccgcaagggccagaattgagaaggcaggtggtgagtgtttgacattcgaccagcttgccttgagggctcctcttggccagaatacggttcttcttcgtggaccgaagaactctcgtgaggctgtgaaacacttcggtcctgctcctggtgtgcctcacagccacacgaaaccgtacgtgaggtcaaagggaaggaagtttgagagagccagaggaaagagaaacagcaggggataccgagtttaatttgttcaaccctttttgtgagagaaaaaaaattcacgttttgctagacttgaagaaatattattatgtgagactctatcatgtcttagtacaagtttttcttcttataaaaaccaaaatcggattcggtgaaagatattgtttcaag

SEQ ID NO: 4259 - DNA, 711 bp, Musa acuminata
  misc_feature (24)..(24): n is a, c, g, or t
  misc_feature (27)..(27): n is a, c, g, or t
  misc_feature (50)..(50): n is a, c, g, or t
  misc_feature (80)..(80): n is a, c, g, or t
  misc_feature (95)..(95): n is a, c, g, or t
  misc_feature (104)..(104): n is a, c, g, or t
  misc_feature (254)..(254): n is a, c, g, or t
  misc_feature (437)..(437): n is a, c, g, or t
  misc_feature (455)..(455): n is a, c, g, or t
  misc_feature (465)..(465): n is a, c, g, or t
  misc_feature (482)..(482): n is a, c, g, or t
  misc_feature (539)..(539): n is a, c, g, or t
  misc_feature (546)..(546): n is a, c, g, or t
  misc_feature (590)..(590): n is a, c, g, or t
gctagaaaaaacgaagcgaccgcnggnagcaggagcagcagagagcggcnatgggcatcgatctcgtcgcgggcggccgnagcaagaaggcgagncgcacagcnccaaggtccgacgatgtctacctcaagctcctcgtcaagctctataggttcttggtgcgaaggacggggagcaagttcaacgcggtgatactgaagaggctgttcatgagcaagagcaacaggcctccgatctccctcaagaggctcatnactttcatgaatgggaaggacaacaagattgctgttattgtcgggacggttaccgacgataagagggtttatgaggttccagcgctcaaggtgacggctctgaggttcacggagacggcaagagctaggattctaaaggccggtggcgaatgcttgacgttcgatcagcttgctctgcgggcncctctcgggcagaacacngtactccttnggggtccaaagaatgcnagggaagctgtgaggcactttggtaaagcgcccggtgttccacatagccacactaanccttacntccggtccaaggggaggaagtttgagagggctagaggaaggagnaacagcaggggttttagggtttaagtcagttgtccctttctcttagaactatttactcctgctgtagcattaagaggtcctatcatcattgcttctattgctcatttcaatttagaaagca

SEQ ID NO: 4260 - DNA, 886 bp, Manihot esculenta
aaaggacattggccttgcagcagtcgcccgccgagaagcaggagcaagagcaacaagaatgggtatcgatttgaaggccggaggcaagaggaaaaaaaccaagcgcactgcccccaagtccgatgatatctacctcaagcttctcgtcaagttgtaccgatttctggtgagaaggaccgggagtaaattcaatgcagtgattctgaagcggctcttcatgagcaagattaacaagcctcctctttcgctctctcgtttgattcgtttcatgaagggcaaggaggataagattgctgtggttgttggtactgtaactgatgatatccgggtgtatgaagtcccttctctgaaggttactgcgctcaggttcacagagactgcaagggcaaggattgagaaggcaggtggggagtgcttgacttttgaccagcttgctcttagagctccacttggtcagaatacggttctcctccggggtcctaagaacgctcgtgaagctgtgaagcactttggaccagcacctggtgtaccacacagccataccaaaccttacgtccgagcaaagggaaggaaatttgagagggctagaggaaggaggaacagcaggggatttagggtttgagtgcttaaatatgggcaaaaaatatggatcagccatccaaatccgagcagatgcatccatattatccaacattcaatttgggtttgtcttatttcaatttttctcatactctagaacgaaacatttgcattgtcttggcaggctaatgttatgcagtttattctgtattttgatctgaagaatggactttgctttgtcgacttttgaatgtcaagtgatggtatgttatagttgcaattatttcttacaaaagatatattgaat

SEQ ID NO: 4261 - DNA, 888 bp, Manihot esculenta
gaaaaggacattggccttgcagcagtcgcccgccgagaagcaggagcaagagcaacaagaatgggtatcgatttgaaggccggaggcaagaggaaaaaaaccaagcgcactgcccccaagtccgatgatatctacctcaagcttctcgtcaagttgtaccgatttctggtgagaaggaccgggagtaaattcaatgcagtgattctgaagcggctcttcatgagcaagattaacaagcctcctctttcgctctctcgtttgattcgtttcatgaagggcaaggaggataagattgctgtggttgttggtactgtaactgatgatatccgggtgtatgaagtcccttctctgaaggttactgcgctcaggttcacagagactgcaagggcaaggattgagaaggcaggtggggagtgcttgacttttgaccagcttgctcttagagctccacttggtcagaatacggttctcctccggggtcctaagaacgctcgtgaagctgtgaagcactttggaccagcacctggtgtaccacacagccataccaaaccttacgtccgagcaaagggaaggaaatttgagagggctagaggaaggaggaacagcaggggatttagggtttgagtgcttaaatatgggcaaaaaatatggatcagccatccaaatccgagcagatgcatccatattatccaacattcaatttgggtttgtcttatttcaatttttctcatactctagaacgaaacatttgcattgtcttggcaggctaatgttatgcagtttattctgtattttgatctgaagaatggactttgctttgtcgacttttgaatgtcaagtgatggtatgttatagttgcaattatttcttacaaaagatatattgaat

SEQ ID NO: 4262 - DNA, 935 bp, Coffea canephora
tacgatcgagatccaagtggtctgtaataaacagcatcaccagcttgtcacgggagccaattccccaggcaaataccctatcccatttctaccctaataagaaaacctccaaaactatagaggagcagccgtcgagtactccattagcagccaagcccgcggcctcctacagaaatctcgtcttcgccaagacttcgaaaaagaagaaatgggtattgatttgaaagccggcggcaaagttaagaagactaagcgtaccgcccccaaatctcatgacatctacctcaagctcctagtcaagttgtaccgatttttggtgaggaggacagggagcaggttcaatgctgtactgctgaagaggttgttcatgagtaagaccaataagcctcctctgtcactctccaggcttgtcaagttcatggaaggaaaggaggacaaaattgcagtgcttgttggaacagtaactgatgatactagagtgtacgaagtgccaactttgaaggtggctgctttgaggttcacagagagggccagagcaagaattgagaaggctggaggagagtgcttgacctttgatcagttggccctgagggcacctcttggtcagaacacggttttacttagaggtccaaagaatgcacgcgaggccgtgaaacattttggcccagctcctggtgtgcctcatagccacaccaaaccatatgttagggccacgggtaggaaatttgagagagctaggggaagaagaaatagcagaggctttagagtttgaaggggtgtgtctccttgttttggtggtgctatctatagccgaactggcaatttttgcgagacaattttgtcatacttcatgttttggagacaaccagttagcttttctgttgttaccttattgttgaattagaaattctgaacatgcggcaatgttttctttt

SEQ ID NO: 4263 - DNA, 859 bp, Coffea canephora
agaaaacctccaaaactatagaggagcagccgtcgagtactccattagcagccaagcccgcggcctcctacagaaatctcgtcttcgccaagacttcgaaaaagaagaaatgggtattgatttgaaagccggcggcaaagttaagaagactaagcgtaccgcccccaaatctcatgacatctacctcaagctcctagtcaagttgtaccgatttttggtgaggaggacagggagcaggttcaatgctgtactgctgaagaggttgttcatgagtaagaccaataagcctcctctgtcactctccaggcttgtcaagttcatggaaggaaaggaggacaaaattgcagtgcttgttggaacagtaactgatgatactagagtgtacgaagtgccaactttgaaggtggctgctttgaggttcacagagagggccagagcaagaattgagaaggctggaggagagtgcttgacctttgatcagttggccctgagggcacctcttggtcagaacacggttttacttagaggtccaaagaatgcacgcgaggccgtgaaacattttggcccagctcctggtgtgcctcatagccacaccaaaccatatgttagggccacgggtaggaaatttgagagagctaggggaagaagaaatagcagaggctttagagtttgaaggggtgtgtctccttgttttggtggtgctatctatagccgaactggcaatttttgcgagacaattttgtcatacttcatgttttggagacaaccagttagcttttctgttgttaccttattgttgaattagaaattctgaacatgcggcaatgttttcttttttctttaatcccattcttgtttt

SEQ ID NO: 4264 - DNA, 769 bp, Gossypium hirsutum
aaggccatttgttctttcagcagcgccgcccacccccttcccccgaagcagcagtgatcaccggcaatgggtatcgatttggtcgccggcggcaagagcaagaagacaaagcgaactgctccgaagtctgatgatatctacctcaagctcctcgtcaagctttacaggtttctagtaaggaggactgggagcaaattcaatgccgtgattttgaagcggcttttcatgagcaaagtcaacaaaccgccattgtctctctccagattgattcaatacatgaagggcaaggaggataagatcgctgtggtagttgggaccgtcaccgatgacattcgagtgtatgaagttccggcactgaaggttactgcattaaggttcactgagacggcgagggcaaggatcgagaaggccggtggggaatgtttaacgtttgaccaacttgctcttcgagcacctcttgggcagaacacggttctcctccgaggtccaaagaatgctcgtgaagctgtgaagcacttcggaccagctcctggtgtgccacacagccacaccaagccctacgtgcggtcaaatggaaggaaattcgagagagctagaggaagaaggaacagcaaaggcttcagggtttgagttcaccgctatcaacctatcatcaccgaaatgggtattttcccttttttttttagtgtgattgaacatgtttttctattttggatatccatccattgtttccattttcagaattaaatatgagagattatgttgcccc

SEQ ID NO: 4265 - DNA, 925 bp, Gossypium hirsutum
  misc_feature (432)..(432): n is a, c, g, or t
  misc_feature (683)..(683): n is a, c, g, or t
  misc_feature (731)..(731): n is a, c, g, or t
  misc_feature (763)..(763): n is a, c, g, or t
  misc_feature (781)..(781): n is a, c, g, or t
  misc_feature (789)..(790): n is a, c, g, or t
gtcgcggcgcctcttccatttcaccaccaccaccatcatcatcaagctttaccaatggggatcgatttagtcgcaggaggtaagagcaagaagaccaaaaggactgctcccaaatccgacgatatttacctcaaacttctcgtcaagatttaccgttttcttgtaagaagaactgggagcaaattcaatgctgtaatattgaaacgcttgtttatgagcaaagttaacaagcctccgctatctctctctaggcttattgagttcatgaaaggaaaggaggataagattgctgtggtagtgggtactgtgacagatgatataagggtttatgaggttccagctttgaaggttacagctcttaggtttactgagactgctagagctaggattgagaaggctggtggagaatgtttaacttttgaccaacttgcnttgagggctccattgggtcagaacacggttctcctcagaggtccgaagaatgcacgtgaagcagtcaaacactttgggccggctcctggtgtgcctcacagccacactaagccatatgtgcgctcaaggggccggaagtttgagagggccagaggacgaaggaacagcaaggggtttagggtttaagatgacttcagtgtttgttctgaggcttgtttttcatttattactgcaaacaaaattttgctatncattaggtttctctggcatttgtttacttcatgttggattttgtttanttatggagtagttttctggttgacattgactnttaattgagagtgtagtnaataattnntcttaggggacctcaaatttcaattcagggggaaattttgcaaatttcctgcacctgggggcccctttgaatttgattgaaaggggcccaattcccccaaaagggattcaaattaaattcccggggcctcctttt

SEQ ID NO: 4266 - DNA, 841 bp, Gossypium hirsutum
tgcaagtcgcggcgcctcccccaacttcaaaccaccaaagcaaaagcttcaccaatggggatcgatttagtcgcaggaggtaagagcaagaagacgaagaggacagcccccaaatccgatgatatttacctcaaactcctcgtcaagctttaccgtttccttgtaagaagaactgggagcaaattcaatgctgtgatattgaaacgcttgtttatgagcaaagttaacaagcctccactatctctctctaggcttattgaattcatgaagggaaaggaggataagattgctgtggtagtggggacagtgacagatgatattagggtttatgaggttcctgctttgaaggttactgctcttaggtttactgagactgctagagctaggattgagaaagctggtggagaatgcttgacttttgatcagcttgctttgagggctcctttgggtcaaaacacggttctcctcagaggtccaaagaattcccgtgaggcagttaaacactttggtcctgctcccggtgttcctcacagccacaccaagccatatgtgcgctcgaagggaaggaagtatgagagggctagaggaagaaggaacagcaagggatttagagtttaatattactgcactacttgattttgaggcctgtttgttatttaggttttcattttcagttgtttacttgcttatgtttgcatcttattcatggattgtttaatagcttgtttgaggaagaacctttcttatgctacgaagtggagcatgtttaagcgttttaatgttttattttactcaaacatggaattctttgtctgaatcattcttcaagcacttttttatg

SEQ ID NO: 4267 - DNA, 734 bp, Gossypium hirsutum
ccgaagcagcagtgatcaccggcaatgggtatcgatttggtcgccggcggaaagagcaagaagacaaagagaactgctccgaagtccgatgacatctacctcaagctcctcgtcaagctttacaggtttctagtaaggaggactgggagcaaattcaatgccgtgattttgaagcggcttttcatgagcaaagtcaacaaaccgccgttgtctctatccagattgattcaatacatgaagggcaaggaggataagatcgctgtggtagttgggaccgtcaccgatgatattcgagtgtatgaagttccggcactgaaagttactgcattaaggttcactgagaccgcgagggcaaggatcgagaaggccggtggggaatgtttaacgtttgaccagcttgctcttcgagcacctcttgggcagaacacggttctcctccgaggtccaaagaatgctcgtgaagctgtgaagcacttcggaccagctcctggtgtgccgcacagccacaccaagccctacgtgcggtcaaatggaaggaaattcgagagagctagaggaagaaggaacagcaaaggcttcagggtttgagttcaccactatcaacctatcatcaccggaatgggcattttcccttttttttttttttttttagtgtgattgaacatgttttttttttttggatatccatccattgtttccatttttagaattaaatatgagagattatgttgccc

SEQ ID NO: 4268 - DNA, 897 bp, Carica papaya
gttcccttggaaaaattctttctccagagtcgcggcgcctcaccagatagcttcaccacccgaagacaccaatggggattgatctgatcgcagggggtaagagcaagcagtccaaaaggactgcggccaagtccgatgatatatacctaaagcttctcgtcaagctttaccgattccttgtgaggagaacgggaagcaacttcaatgcagtgatactgaagcgcctcttcatgagcaaggtcaacaaggcccctatttctctttccaggctcgtcaaattcatgcagggaaaggaggataagattgcagtcatcgtgggaacagtgaccgatgatctgagagtctacgaggttccggctttgaaggtgacagcattgaggttcacggagactgcaagagctagaatcgagaaggctggtggagagtgcttgactttcgaccagcttgctctcagggctcctttgggccagaacacggttcttctcagaggcccaaagaatgctcgtgaagcagtcaaacatttcgggcctgctcctggtgttccacacagccacaccaagccatacgttcgatccaagggcaggaagtttgagagggctagaggaaggaggaacagcaggggattcagggtttaagatgataattttagctattgtccatgaggttgaagtacttgtttactacttttgcaattaaaattttgttagacatccttagggatcccttgcagtcttttattcggtttactgttacaaagacgaatcagttaaatgcctgtttgaacccaatttgtcaattaccttgctgttttaagtatcgtttaagaagttatcgtatctcaggtttattttccatagtgattgaaatacaaaatgacttgatttgagggttttcgtg

SEQ ID NO: 4269 - DNA, 813 bp, Jatropha curcas
attcctttcatctacaaaggtcctaaaaccctagcccctccccttaagcacatttgcctcgcaggagtcgcgcgccgagcagcaaaaggaggaacgacaatgggtatcgatttgaaggccggaggcaagagcaagaagactaagcgcactgcgcctaagtctgatgatatctacctcaagctacttgtcaagttgtatcgatttctggtgaggagaactggtagtaattcaatgcggtgattcttaagaggctcttcatgagcaagattaacaagccacctctctccctctctcgtttgattagtttcacaaagggcaaagaggataagattgctgtggttgttgggactgtaactgatgatattcgtgtgtatgaagtccctgctttgaaggttactgcactgaagttcactgagacagcaagggcaagaattgagaaggcaggtggcgagtgcttgacctttgatcaacttgctcttagagcacctcttggtcagaatacggttctcctaagaggtcctaagaatgctcgtgaggcagttaagcactttggaccagctcctggtgtaccacacagccataccaaaccctatgtacgatcaaagggaaggaaattcgagagggctagaggaagaaggaacagtaggggctttagggtttgagtgctccaagccagtgctatccataaacaaacatccaatttgcttatgttttactttcttgttctcaccctccagtttggaacaattacataatcttgcattttatattgtattttattttgatttaaacgaaagattttgcaagttgact

SEQ ID NO: 4270 - DNA, 740 bp, Cicer arietinum
gacctgtcctctgcaatgggtatcgatcttaaggctggaggtaagaacaaaaagaccaaacgaacatcacctaaatccaatgatatctacctcaagcttctcgtcaagctgtatcgcttccttgttagaaggaccgacagcaatttcaatgccgtgatactcaaacgcttgttcatgagcaaggtcaaccgacctccactctccttgtcaagattgattaagtatatgcagggaaaggaaggtaaaattggtgttgttgttggtgctgtaaccgatgatattcgagtatatgacgttccagcaataaaagttactgccctcagattcacagagacagcacgtgcaagaatagaaaaggctggcggtgaatgcttaacatttgatcaacttgctctcagggctccccttggacagaacacggttcttctaagaggcccaaagaatgctagggaagcagtgaaacattttggtcctgctcctggtgtgccacacagccataccaagccttatgttaggtcaaagggaaggaaatttgagaaggctagagggaggagaaagagcagaggatttagagtttgagttgtccaagatgtctgttttcagttttgatacttccaaattaagcttttgttatgttatattatcatccttgaagatagtttttgttatatttattttaacaaagaatcaattgcatccaaaagattattctcatggccttggtttttacaaaaaaaaaa

SEQ ID NO: 4271 - DNA, 776 bp, Cleome gynandra
cggggaatcgaaggtctccagccgcttctccagtccctgcaacaatgggtatcgatttgaaggccggaggtaagagtaagaaaacgaagcgtactgcgcctaaatccgacgatgtctatctcaagctcctcgtcaagctgtatcggtttctagtgagaagaacaggaagcaatttcaatgctgtgattctgaaacgtttgttcatgagtaaagtaaacaaaccaccattgtctctctctcgtttgatccgttacatgcagaaaaaggaggataagattggtgtaattgtgggcactgtaactgatgatgcaagagtatatgaagttccagctcttaagatcactgcattgagattcactgaaagggcaagggctaggattgagaaggctggtggtgaatgtcttacctttgatcaacttgcccttcgtgctcctcttggccagaacacggttctcttgaggggtcctaagaatgcccgtgaagctgtgaagcattttggagcagcgcctggtgttccacacagtcatactaagccatatgtgcgatccaagggccgaaaatttgagagagctagaggaagaagaaagagtagaggcttcaaggtttaagataaattcgacccctcgcgtttagatgttcttattctatatgactattagttggaacccttttcgtaagatgtatcgatcttatgaggtatctaagtttacgtgttgtaatgaatgaaatcagttggaactatgatccgttttgttgtgtctgaacctatcaaatat

SEQ ID NO: 4272 - DNA, 989 bp, Cleome spinosa
ttttgcttcattccgagccgcttcaccagtccctgcaacaatgggtattgatttgaaggccggaggtaagagtaagaagacgaagcgcacggcgccgaagtctgacgatgtctatctcaagctcctcgtcaagctgtatcggtttctagtgaggagaacgggaagcaagttcaatgctgtgattctgaagcgcttgttcatgagtaaagtgaacaagccgccattgtccctctctcgtttgatccgctatatgcagggaaagaaggacaagattggtgttattgttggaactgtgaccgatgatgcgagagtgtacgaagtgccagctcttaagatcacggcattgagattcacggagagggcaagggccaggatcgagaaggctggtggggagtgcctcacattcgatcagctcgctcttcgtgcccctcttggccagaacacggttctactgagaggccctaagaatgcacgtgaagcggtgaagcactttggccctgctcctggtgttccacacagccacaccaaaccgtacgtccgttcaaagggcagaaagtttgagagagctcgaggtaggagaaagagcagaggcttcaaggtttaagccccgaccaaatcaaaatcacttggattatgttataaactcctccagttcccttacggtcagtcaactttgtgtcatcttcctgcgttcattttgcaagcttacgactttcaagctctgttgagttacatacatggcgtaccctttatcctatatgatgggacctttttccccggtaatatttcccttttttgttcttaatcaccagtttgaatgaaatctagatgatggcattgtatactccatgcgttgatccatttttgttaagagttcctgcgtgtagtaagaaagtctctagctgcgtgtcaaaggtatgaaccgttgttgtcaacttacgattgagtatgatattctctcaatcggtccaatcttattctgttcgtat

SEQ ID NO: 4273 - DNA, 857 bp, Persea americana
gtaaccctaatcttctaccgcggagaaaaaccctaacgaggcgaagatggggatagatctagtggctggtggcaagagcaagaagacgaggaggacagctcccaaatctgatgatatctatctcaagctcattgtcaagctttacaggtttctggttcggaggacaggtagtaaattcaatgcagttatattaaagagacttttcatgagcaaggtcaataaggctccactatcgctctccaggttgattcagtttatgaagggaaaggaagataagattgcagtggtggtaggctgcgttacagatgatacccgagtttatgaagtacctgcattgaaggtgactgccttgagatttacggagacagctagagctcggatcctgaatgctggaggtgaatgtttaacctttgaccaacttgccttaagggcaccccttggacagaacacggttcttctcagggggcctaagaattctagagaggctgtgaaacattttgggaaggcgcctggagtaccccacagccacaccaaaccctatgtccgttccaagggcaggaagtttgagaaagctaggggcaggagaaatagccgtggcttcaaagcttaataacactgggttctatttgtcctactttaaatgcattgttagtgtggtagcttcttcacaatttcctttttacaaggtacaacattcgaggcagttgtctgcagtttttgttgaattattgttttttctcccctacggtttcatttcatgtgagggatcttgttgtttggagtttggacttccaactcttcttatcatccaagcatggctgatgctactgttattattagtgataatcaatgtttct

SEQ ID NO: 4274 - DNA, 857 bp, Persea americana
  misc_feature (612)..(613): n is a, c, g, or t
  misc_feature (639)..(639): n is a, c, g, or t
gtaaccctaatcttctaccgcggagaaaaaccctaacgaggcgaagatggggatagatctagtggctggtggcaagagcaagaagacgaggaggacagctcccaaatctgatgatatctatctcaagctcattgtcaagctttacaggtttctggttcggaggacaggtagtaaattcaatgcagttatattaaagagacttttcatgagcaaggtcaataaggctccactatcgctctccaggttgattcagtttatgaagggaaaggaagataagattgcagtggtggtaggctgcgttacagatgatacccgagtttatgaagtacctgcattgaaggtgactgccttgagatttacggagacagctagagctcggatcctgaatgctggaggtgaatgtttaacctttgaccaacttgccttaagggcaccccttggacagaacacggttcttctcagggggcctaagaattctagagaggctgtgaaacattttgggaaggcgcctggagtaccccacagccacaccaaaccctatgtccgttccaagggcaggaagtttgagaaagctaggggcaggagaaatagccgtggcttcaaagcttaatnncactgggttctatttgtcctactttnaatgcattgttagtgtggtagcttcttcacaatttcctttttacaaggtacaacattcgaggcagttgtctgcagtttttgttgaattattgttttttctcccctacggtttcatttcatgtgagggatcttgttgtttggagtttggacttccaactcttcttatcatccaagcatggctgatgctactgttattattagtgataatcaatgtttct

SEQ ID NO: 4275 - DNA, 773 bp, Manihot esculenta
gttttcctgaacttccccgagcagcagcggcgtgcagaggtccaccactctcgagcaacaatggggatcgatctgaaagcaggaggtaagagcaagaagaccaagcgtacagcccccaaatccgatgatatctacctcaagctcctcgtcaagctataccgatttctggtaaggagaaccggtagtaagttcaacgcggtgatcttaaagaggctgttcatgagcaaggtgaacaagtcccctctttccttgtctcggctcatcaccttcatgaagggaaaggagagtaagatcgcagtggttgtggggacagtgacaaatgatattagggtctatgaggttccagcattgaaggttaccgctttgaggttcacagagactgcaagagcaaggattgagaaagctgggggagagtgcctgacatttgaccagattgctttgagagctcctttgggacagaacacggttctcctaagaggtccaaagaatgctcgtgaagctgtgaaacactttggcccagctcctggtgtgccacacagccataccaaaccatatgtgcgatcaaagggaaggaagtttgagagagctagagggaggaggaacagcaggggatttagggtttgagttgtttgtagttcaaaattgtgaggcaattgttttatttcagactattttatcccaaatttttgttcgaatgtaggttcctctggaacttgtttatgttatttctactttgggttatcaattataagtgaatttgttttacgcttggc

SEQ ID NO: 4276 - DNA, 774 bp, Manihot esculenta
  misc_feature (598)..(598): n is a, c, g, or t
ggttttcctgaacttccccgagcagcagcggcgtgcagagttccaccactctcgagcaacaatggggatcgatctgaaagcaggaggtaagagcaagaagaccaagcgtacagcccccaaatccgatgatatctacctcaagctcctcgtcaagctataccgatttctggtaaggagaaccggtagtaagttcaacgcggtgatcttaaagaggctgttcatgagcaaggtgaacaagccccctctttccttgtctcggctcatcaccttcatgaagggaaaggagagtaagatcgcagtggttgtggggacagtgacaaatgatattagggtccatgaggttccagcattgaaggttaccgctttgaggttcacagagactgcaagagcaaggattgagaaagctgggggagagtgcctgacatttgaccagattgctttgagagctcctttgggacagaacacggttctcctaagaggtccaaagaatgctcgtgaagctgtgaaacactttggcccagctcctggtgtgccacacagccataccaaaccatatgtgcgatcaaagggaaggaagtttgagagagctagagggagnaggaacagcaggggatttagggtttgagttgtttgtagttcaaaattgtgaggcaattgttttatttcagactattttatcccaaatttttgttcgaatctaggttcctctggaacttgtttatgttatttctactttgggttatcaattacaagtgaatttgttttacgcttggc

SEQ ID NO: 4277 - DNA, 937 bp, Vitis vinifera
cctccccaaataaaacgccgtcgttccaaaaccctagcctctcttcttcacatcaacagtagcaatgggcatcgatctcgtcgccggcggcaagagcaagaggaccaagcgaacggcccccaagtccgatgatatttacctcaaactcctcgtcaagctgtaccgatttttggtgcggaggactgggagcaaattcaatgcggtgatactgaagcggctcttcatgagcaaggtcaataagccgcctttgtcactttcccgtttggttcgttacatggacggaaaggagggtaagattgctgtggttgttggaactgttaccgatgatctccgagtgtacgaagtcccttgtctgaaagtgactgccctgaggttcacagagagagcaagggcaaggattgagaaggctggtggtgaatgcttgacatttgatcagctggctctcagagctcctcttgggcagaacacggttctgctcagaggtcccaagaatgctcgtgaagctgtgaagcactttggcaaggctcctggtgtgccacacagccacaccaaaccttatgtacggtcaaagggacggaaatttgagagggccagaggaagaaggaacagcagaggtttcagggtctgacttgtcacactcattcctacaacacaaactaatctatcaatctcttgcaaaaacatttttccatcagttagccatggtggttttcccccttcattttccattccaccttgcagaacatttatattatctgtagcaggatatcttttttgcccatttataatatgttttaccattaatatatggttatgagggacagatgtgtactcctgaatatttagtagtgtcacccaaaatgttttgagggattgttttactgagatgattcttttattctaaatctgccggatatgatgctttggttttgagtta

SEQ ID NO: 4278 - DNA, 758 bp, Glycyrrhiza uralensis
ggagtcgcagcaacctgctcttccgaatcccagagctgcaatggggatcgatcttaaggctggggggaagagcaaaaagaccaaacgaacagcacccaaatccaatgatatctatctgaagcttctcgtcaagctctatcgcttccttgttcgaaggactggcagcaatttcaatgctgtagtactgaagcgcttgttcatgagcaaggtcaaccgacctccgctttcattgtcaaggctaatcaagtatacgaaggggaaggaggataaaattgctgttgttgtgggaactgtaactgatgatattagagtatatgaagttccggctttaaaagttactgcactcaggttcacagagacagcaagggcaagaatagaaaaggcgggtggtgagtgcttgacattcgatcagcttgcccttagggctcccctgggacagaacacggttcttctaagaggcccaaagaatgctcgggaagctgtgaaacactttggtccggctcctggtgtgccacacagccataccaagccttatgtaagagctaagggaaggaaattcgagaaggctagaggaaggaggaacagcagaggatttaggaattgagttgattgcgttgctcaattttttgttagtgttgttacttctgaatttcaactttttactttgtcataggcgttgaagacagaatttatgatatttcttttctgataaagatttgtcagtagtacggagatcgttatgcatggctccccttgcc

SEQ ID NO: 4279 - DNA, 773 bp, Cucumis melo
agccgtcgccgtcgctcaagagaagggtttctccaccaaaagctccaatgggtatcgatctggtagctggaggcaagagcaagaagaccaaaaggactgcccccaagtccgatgatatctacctcaagctcctcgttaagctgtaccggtttcttgttcgaagaactggaagcaatttcaatgcagtgatcctcaagcgcttgttcatgagcaaggtgaacaagccgccaatttcactatccagacttatcaagtacatgaagggaaaggaagcgaaaattgctgtcgttgttggaaccgtgacagatgacattcgcgtttacgaagtcccagcattgaaagttacagccttgaggttcactgagaccgcaagagccaggattgagaaggcaggtggtgagtgtttgacattcgaccagcttgccttgagggctcctcttggccagaatacggttcttcttcgtggaccaaagaactctcgtgaggccgtgaagcacttcggtcctgctcctggtgtgcctcacagccacacgaaaccatacgtgaggtcgaagggaaggaagttcgagagagccagaggaaagagaaacagcaggggataccgagtttaatttgttcaaccctttttgtgagacaaaaattcacgttttgctagacttgaagaaatattattatgtgagactctatcatgtcttagtacaagtttttcttcttatataaaccaaaatcggatccggtgatagatattgtttcaagactttgcaattttcccc

SEQ ID NO: 4280 - DNA, 729 bp, Allium cepa
gtagccgccagtcttccctgacgtagaagaagaaaatgggtatcgatctcattgctggaggcaggaacaagaagacgaagcgcacagcgacaaaatcagacgatatataccttaagctgctaatcaagctttataagtttttagtgagaaggaccggaagtaagtttaatgcagttattttgaagaggcttcttatgagtaggactaatcgtcctcccctttccatgagaagattggttactttcatgaaaggaaaggagagtagcgttggcgtgcttgtgggaactgtaactgatgataacagagtttatgaaatccctgcaatgaaagtggcagctttgaggtttactgaaactgctagagcaaggattttgaaagccggcggagagtgtttgactcttgatcagcttgcccttcgtgcgccacttgggcagaacacggttctattgagaggcccaaagaatgcaagggaagcagtgaagcactttggaccagcaccaggtgttcctcacagtcacaccaagccttatgtgagatccaagggcaggaaatttgaaaaggcaagaggaagaagaaacagcagaggttacagaaactgaggaacttcagccgtctgttatttatgttgttttgggcaagtctaaatcatatcattttcattttaggttgcagacattgagatttgttatgttattgttattggatcctgccgtgaacttttttgagttt

SEQ ID NO: 4281 - DNA, 855 bp, Arachis hypogaea
atagcgagcaggcgcagcgtcggagaagctcttggttccaacacacaaaacacagccaaagctgcaatggggatcgatattaaggctggcggcaagagcaaaaagaccaaaaggaccgcacccaagtccaatgatatctacctcaagctcctcgtcaagctttaccgcttcctagtgaggaggaccggcagcaatttcaatgccgtgatactgaagcgcttgttcatgagcaaggttaacaagcctccgctttctttgtcacgcttgattaagttcatgaagggcaaggaaggtaaaattgccgttgtagtgggaactgtaaccgatgatatcagagtgtatgaagttcctgcattgaaggttactgcactcaggtttacagagactgcacgtgctagaatagagaaggctggtggtgaatgcttgacatttgatcagcttgcacttagggctcctctcggacagaacacggtccttcttagaggcccaaagaactccagggaagctgtgaaacactttggtcctgctcctggtgttcctcacagccataccaagccttatgtacgatctaagggaaggaagtttgagagggctagaggaaggaggaacagcaaaggatttagggtttaagttgtattatttccgtatttttcttaagtttttagttttgaaatttaacccattctcccatatcctagtgctgaagacagttttcttatgttatgttttggtaaaaaatatttggtatggagaatggaggttgtgctgcttttctcctgttatactttgaagtctactataagtgctataatttttgttgtcgtatattatattattatgatgtttttgttccca

SEQ ID NO: 4282 - DNA, 842 bp, Arachis hypogaea
aaccctaagcaaaaacaaaaccctagctccattccctcagcagcaagcagctccatccaccatgggcatcgatttgaaagcaggaggtaagtcgaagaagaccaagcgtacagcccccaaatccaatgatatctacctcaagctcctcgtcaagctataccgtttccttgttcggaggactggtagtaacttcaacgccgtcatcctcaagcgtcttttcatgagcaaagtcaacaagccaccgctatctctctcccgcttgatccgttacatgaagggaaaggaggataagatagctgtagttgttggagctgtgacagatgatattagggtgtatgaagtgcctgcattgaaggtaactgccctgagattcactgaaactgccagagctcggattgagaaggctggtggcgagtgtcttacctttgatcagcttgctcttagagctcctcttggccagaacacagttcttcttagaggccctaagaatgcccgcgaggctgtcaagcactttggaccagcacctggtgtgccccatagtcacaccaagccctacgttcgtgcaaagggacggaaatttgagcgtgctagaggaagaaggaatagcagaggcttcagagtttgagttctggagctcaaagatgaaggattttccgatttatcatgtgaccgttctgtattgttttccttctttttgtgtcgttaaaacagttgattttagttcagttttccttccctcaaaggggaaaagggattggaactcgctcaacaattttggtttatcactactgttctaatgaactctatgaaaggattaatgagtagattttcttcatttgttg

SEQ ID NO: 4283 - DNA, 807 bp, Ananas comosus
  misc_feature (673)..(673): n is a, c, g, or t
  misc_feature (745)..(745): n is a, c, g, or t
tcgccgggggccggagcaagaaggcgaggcgcactgctcccaaatccgacgatgtctacctcaagctcctcgtcaagctctaccggttcctggtgcggagaacggggagcaagttcaatgcggttatcctgaagcggctcttcatgagcaagatcaataggccccccatctccctcaggaggctcgtcagtttcatgagcggaaagggagataagactggagtaattgttgggacggtgacagatgataagagggtgtatgaggtgccggccatgaaggtgactgcccttaggttcacggagacggcaagggcgaggattgttaatgctggtggggagtgcctgacgcttgatcagctcgctctgcgtgccccactagggcagaacacggttctcttgaggggaccgaagaatgcccgcgaagccgtgaagcactttggcaaggcgcctggggtgccgcacagccacacgaagccctatgtccgcgccaaaggcaggaagtttgagaaggccagaggtagacggaacagccgtggatttagggtctaaaaggccattacatcctcgctctttctccagaaattatcctaaacaattaccgtgtgagcgcttattctcctctctactttttgtagtctctttacatcacatctggattgtagaagtgtttgggnagttttgatcatctagctattccttgtgattgcactggttatttcatgattggtaatgttttaaaaaaaatntatgagaaatttggactcaaaatggaatttaaacagtctcttaacttttttttttttttgat

SEQ ID NO: 4284 - DNA, 891 bp, Populus trichocarpa
accgaagggtcttaaaaccctagcctcccccactcgctgcttctcttccctttcaaggacgcttgatttgcctctaccccagcagtcgagcagtaacagcacaacaacaatgggtattgatttgaaggccggtggaaagagtaagaagactaagagaacagctccaaagtccgatgatatctacctcaagctcctcgtcaagttgtaccggtttttggtgaggaggacaggcagcaagttcaatgcggtgatactgaagagactcttcatgagcaagatcaacaagcctcctctttctctctctcgtttgatcactttcatgaagggcaaggaagacaagattgccgttgttgttgggactataactgatgatattagggtttatgaggtccctgctctcaaggttactgccttgaggttcaccgaaactgctcgtgctaggattgagaaggcaggtggagaatgcttgacttttgaccaacttgctcttcgtgctcctcttggtcagaacacggttctcctcagaggtcccaagaatgctcgtgaggctgtgaaacactttggaccagctcctggtgtgccacacagccacacaaagccctacatacggtcaaagggaaggaaatttgagaaggctaggggtaaaaggaatagcaagggatttagggtttgaatgcagtacctcatgcagaaaatacagatcagccttccaaatccaaggtgcaatatgcaattggttgtttgatctcttttttccttgtcttctcatgttgaacaattacattgtctttagaaagttaaaaaggtttcagtttcttttcaatattttgatctaagcaaatgattttgtttgtcaactggtaattaatggtttacttctgaatttcagca

SEQ ID NO: 4285 - DNA, 806 bp, Arabidopsis lyrata
tttatgtacaaggtcggcggttccagcaccacaacgccggacgacaatgggtattgatctgatcgccggaggtaagagcaagaagaccaaaaggacagctccaaagtctgatgatgtctacctcaagcttactgtcaagctttaccggtttctggtaaggagaactcagagcaagttcaatgctgtgatattgaagaggcttttcatgagcaaagtcaacaaagctcctctttctctatctaggcttgtggagttcatgactggcaaggaagataagattgctgtcttggttggaactgttactgatgatttgagggtacacgagattccagcaatgaaagtgactgccctgagattcacagagagagcaagggctcgcattgagaaagctggaggtgaatgcttaacctttgaccagctcgctctcagagctccattgggccagaacacggttcttcttagaggacctaagaattcacgtgaagcagtgaagcatttcggacctgctcctggtgtgccacacagtcactccaagccatatgtgcggggcaagggaaggaagttcgagaaggccagaggaaggaggaagagtcggggattcaaggtttaagaaagttgttgctgccattggacttgattttggagtattgtcgcttcttggttgcttgtgtaatcgggtttttgttagagaactctgctttttctttgcttttcagacatgtttctaagctcgtttttactggattcatcgtgtcgttgttacactttgagctttactatgttaaacgtattcataatctttcgtt

SEQ ID NO: 4286 - DNA, 681 bp, Cleome gynandra
aagctccctagttctgcagaagcttcgacggcggcggttcctccatcaccaccactccggacgcggcgatgggtattgatttgatcgcaggaggtaagagcaagaagaccaaaagaacagccccgaaatccgatgatgtctatctcaagcttattgtcaagctttaccggttttggtgaggagaactggaagcgacttcaatgcggtgatattgaagcggctcttcatgagcaaagtcaacaaagctcctctttctctttccaggctcgccaaattcatgcagggcaaggaagacaagatcggtgtgttagttggaactgtgaccgatgatgtgagattatatgaggtacctgctatgaaggtgacagctttgaggtttacagaaacagccagagctcggattgagaaggctggtggggagtgcttgacctttgatcagctcgcactcagagctccattgggtcaaaacacggttcttcttagaggtcctaagaactctcgtgaagcagtgaaacacttcggtccagcaccaggtgtgccgcacagccacacgaagccgtatgttagatccaagggaaggaagtttgagagagcaaggggaagaagaaagagccgtggattcaaagtctaagggtttgatctttgttcaagagtgctattgctgtctttgtcttgtgattg

SEQ ID NO: 4287 - DNA, 839 bp, Cucumis sativus
acaccggcggcgcctgctgatactcggagagcatttgtaatggggatcgatctcgtagcaggaggtaagagtaagaagaccaagagggttgcacctaaatctgatgatatctacctaaagttactcgtcaagctttaccgcttccttgtccgtcgaactggaagcaatttcaatgctgtgattctcaagcgcttgtttatgagcaaggttaacaagcctccactttccctttctcggcttatccagttcacaaaaggaaaggaaagtaagattgctgtcgttgttgggactattaccgatgatattcgagtctatgaagttccagcattgaaagttgcagctctgaggttcactgagacagcaagggcaaggattgaaaaggctggtggggaatgtttgacatttgaccagcttgctttgagggctcctctgggtcagaacacggttcttcttagaggtcctaagaattcccgagaggcagtgaagcatttcggtccagcacctggtgtaccacacagccattccaagccatatgtgaggtcgaagggaaggaagtttgagagggctagaggaaagagaaacagcaggggatatagggtttgatttgatcttttacttttttccgatcctaattcgatgcaagtgtgttattttgaaattcaatatccaaattttgctagattttagttgcatgtcagttattccatttcttacggtttttggcataatattgttgattatgaatttgattaaatgttattcagcaggacttcatagagtttctttcctagatttttgtgattaccattttctgttctattcatttgagtatctaaaaa

SEQ ID NO: 4288 - DNA, 821 bp, Tropaeolum majus
tcaacgcagagtacggccggggcactccaaacccttaactacgcttgttctccctcaacgaaggcgcggcggcttcttcagagagttcaattccaaagcccgacaatgggaatcgatctgatcgcaggaggtaagaacaagaagaccaaaaggactgcacctaaatccaatgatatctacctaaagcttctcgtaaagctttaccgatttttggttaggagaaccggtagcaagtttaatgcagtggtacttaagcgtctctttatgagcaaggttaacaaggcgcctatctcactctctaggcttgtcaagaacatgactggaaaggaggaaaagattgctgtgattgtcggagctgtgactgatgatgttagagcctatgaggttccagcaatgaaggtcactgccttgaggttcacagagactgcaagggcaaggattgagaaagccggtggagagtgtttgactttcgaccaacttgctcttagggcacctttgggccaaaacacaattctcctaaggggacctaagaatgctcgtgaggcagtgaagcactttgggccagctcctggtgtgccacacagccacaccaagccctatgtgcgttccaagggtaggaagtttgagaaggctagaggaaggagaaacagcaggggtttcagaaactaagttagtcataatcttgattatgtatggcaattgttatttaaattttggtttagaccttgagttgctcttgcagtggaactgtttcaatacatttaactcttattaatgcatgttttgacaaacaatttttgatttcaatcttgagaatcata

SEQ ID NO: 4289 - DNA, 863 bp, Malus domestica
tttccctgcaaaaaaccctacaccccgcctctctgcctcaagagcgtcaaagcagcagccgcaatgggtatcgatttggtcgccggtggcaagagcaagaagaccaaacggacagccccaaagtccgatgatatctacctcaaactcctcgtcaagctgtatcggtttctggtgaggaggaccagcagcaagttcaatgccgtgattctgaagaggttgttcatgagcaaggtgaacaaggcccctttgtccctttcccgattgattaagtacatgaccggaaaggagggtaagattgccgtggtggtcgggactgtgaccgatgacattcgcgtttacgaggttccttgtctcaaagtgacggccctcaggttcaccgagaccgccagggctcggattgagaaggccggaggcgagtgcttgacttttgaccagctggctctcagagctccgcttggccagaacacgattcttcttagaggacctaagaatgctcgtgaagctgtgaagcattttggacctgctcctggtgttccacacagccacaccaaaccctatgtgcgatcaaagggcaggaagttcgagaaggcccgtggaaagagaaacagcaagggtttccgtgtttaagcttcgcaaaaggagttatatccctatttccagtcttgttttcttcactttgtgtttttggtggaactcttatgtttatctatagcttaccttcatctgtatttcgttattccctacgactgttttagcttcgagaggaagatctttagatgtttgaaggattaatggctacttaaggaatgtatgctagtagttaagattttgttgaattcgattttggttctcaccgaaaaaaa

SEQ ID NO: 4290 - DNA, 823 bp, Malus domestica
aacaaaccctacaaccccccgcctctctgcctaaagagcatcaaaggagcagccgtaatgggtatcgatttggtcgccggtggcaagagcaagaagaccaaacggacagccccaaagtccgacgatatctacctcaagctcctcgtcaagctgtatcggtttctggtgaggaggaccggcagcaagttcaatgccgtgattctgaaaagattgttcatgagcaaggtgaacaaggcccctctgtccctttcccgattgattaagtacatgactggaaaggagggtaagattgctgtggtggtcgggactgtgaccgacgacattcgggtttacgaagttccttgtttgaaagtgaccgctctcaggttcaccgagaccgccagggctcggattgagaaggccggcggcgagtgcttgactttcgaccagctggctctcagagctcctcttggccagaacacgattcttcttagaggacccaagaatgctcgtgaagctgtgaagcattttggacctgctcctggtgttccacacagccacaccaaaccctatgtgcgatcaaagggcaggaagttcgagaaggccagaggaaagagaaacagcaagggtttccgtgtttaagcatgagttatctccttattctcagtcgtgttttcttcactttttgtgtttgatgcactcttatggtatcgatagcttacctgcatctatatttcgttatgtctacgacttttttagcttcgagaggaagatgtttagatgtttgaaggagatgttaagattttgttgaattcaattttggttctcaaccgtgcttgattac

SEQ ID NO: 4291 - DNA, 717 bp, Musa acuminata
  misc_feature (58)..(58): n is a, c, g, or t
  misc_feature (76)..(76): n is a, c, g, or t
  misc_feature (683)..(683): n is a, c, g, or t
  misc_feature (685)..(685): n is a, c, g, or t
ggagagcactgcaagagctcttcgcccgaatcgaccatgggtatcgatctcgttgccngcggtcggagcaagaagnccaggcgcaccgcttccagatccgacgatgtctacctcaagcttctcgttaagctctacaggtttctggtgcggaggaccggaagcaaattcaacgcagtgatattgaggcggcttttcatgagcaagatcaaccggcctcccatctcgcttaagaggctaattacattcatgcaagggaaggatgacaaaatagccgtcatcgttgggacggttacggatgataagagagtgtacgaggtgcccgctatgaaggtaacggctctaaggttcactgagacggctagggcgaggatcctaaaggccgggggagaatgcttgactttcgaccaacttgcccttcgagcacctctggggcagaacaccgttctcttgagaggcccgaagaatgccagggaagctgtgagacactttggtaaagctcccggcgtgccgcacagccacacaaagccttatgtccgatccaaggggcggaagtatgagagggccagaggacgaagaaacagcaggggatttagggtctaagtttgataagctggtagatctcgtgtcttttcccatttgggaagcaatcacgttaccatctcgaaacattgaccttcttgttntntgattttgattgaagttggatgtgttttggac

SEQ ID NO: 4292 - DNA, 782 bp, Phaseolus coccineus
tggccggggggttatcataaattgcaggtgtagcggcagagagtgaaggcagttcgttccgagacccgaagcagcaatggggatcgatctgaaggccggaggtaagagcaaaaagaccaaaagaacagcaccaaagtccaatgatatctatctcaagctcttggttaagctttaccgcttccttgtccggagaactggcagcaatttcaatgctgtcatactcaagcgtttgttcatgagcaaagttaacaagcccccactttcattgtcaaggttgattaagtataccaagggaaaggaaggtaaaattgctgttgtggtggggactataactgatgatattcgtgtttatgaagttccatccttgaaagttacagcactaaggtttactgagaccgcgcgggcaagaattgaaaaggctggtggtgaatgcttgacatttgatcaattggctcttagggcacctcttggacagaacacggtccttcttagaggccccaagaatgcccgtgaagctgtgaagcactttggacctgctcctggtgttcctcacagcaacaccaaaccttatgttcgatctaagggaaggaagttcgagaaggctagaggaaggaggaacagccgaggatttagggtgtgatgtgatagcagttttttattctacgctggtattattacctctggaattcaaatttttcttatattttagacggttgagacagttttcttgttatttgtattctgataatgattttcagtacgaagttttcatttttttcttc

SEQ ID NO: 4293 - DNA, 870 bp, Phaseolus coccineus
ttccttatttatggccggggaggcacaattttctccctcggtgacggcagcagcagcagcggcgtcggcgagaagctccattcgcaatgggaatcgatttgaaggcaggaggtaagtccaagaagaccaagcgaaccgccccaaaatccgatgatatctacctcaagctacttgtcaagttgtaccgttttcttgttcggaggactgggagtaatttcaatgccgtcattctcaagcgtcttttcatgagcaaggtcaacaagcctccgctatccctctccagattgatccgttacaccaagggaaaggaggataagatagctgtggtggttggggctgtgaccgatgatattcgtgtgtacgaagtgcctgctctgaaggtaacagcactgaggttcactgaaactgccagagctagaattgagaaagctggcggggaatgcctcacctttgatcaactggctcttagagctccactcggccaaaacacggttcttcttagaggtcctaagaatgctcgtgaggctgtcaagcactttggaccggctcctggtgtgccccatagccattccaagccctatgtccgtgcaaagggacggaaatttgagcgggccagagggagaaggaatagcagaggctttagagtttgagttttttatctcaaacgtgaaggaattttcctcttaccctgtgatccttatgtattgttttctcgtgtttttggaacaatagttaattttagtttttacgtttccttcaaagggaaaaatattgaatatccttccccgaacaattttgttctagcagactacttttgagaggattaatgagtaattattggtctaattaaaaatttttttttataaaaaa

SEQ ID NO: 4294 - DNA, 1425 bp, Ricinus communis
atgacccgtcagcaactaggcccaacaaagttttcatcagacgaagtgtcttcacaaaatcaagtgaaagcatccgtgcagaggaaaattcgacagagtattgctgatgagtatccaggacttgagcccgtgttggatgatttgcttccaaagaagtcacctttaattgttgctaaatgtcaaaatcatctgaatcttgtgatggtgaacagtgttcctctgttttttaatattcgtgatgggccatacatgcctactctgcgtcttctccaccaatatccaaacataatgaaaaagttacaggtagacaggggtgcaataaaatttgtacttgctggtgcaaacataatgtgtcctggacttacatctccaggcggtgctttggatgaggaagtggaagcagaaactcctgtggccataatggctgaaggaaagcaacatgctcttgcaattggctttacaaaaatgtcagcaaaagatataaagacaattaacaagggaattggagtggacaacatgcattatctcaatgatggcctttggaagaaaaatccagctataaattcacttcaaaaccctagttatacttttgttccctttccacctcttcagcagcagcagcagcagcctacaagcaggagagcatcaatggggatcgatctgaaagcaggaggtaagagcaagaagaccaagcgtacagctcctaaatccgatgatatttaccttaagcttctcgtcaagctataccgatttttggtaaggagaaccggaagcaaattcaatgcagtgattttgaagaggctatttatgagcaagatcaataaggcaccgctttctctttctaggcttatcactttcatgaaaggaaaggagagtaagactgcagtggttgttggaacagtgacagatgatattagggtttatgaagttcctgctttgaaagtaacagcattgaagtttacagagactgcacgagctaggattgagaaggccggaggagagtgtcttacatttgaccagcttgctatgagagctcctttgggacagaacacggttctcttaagaggtccaaagaatgctcgagaagccgtgaaacactttggcccagctcctggtgtgcctcacagccataccaaaccatatgtgcgatcaaagggaaggaagtttgagagagctagaggaaggaggaacagcaggggttttagggtttgagttgtttttggttttgagttgtgagacagttgttttacttcttagttttgtatcccaaattttgttagactcttacaaggaatttgttattcccccctggttatcgattattagcatgaatttgttttatgtgggcaatcatacttctctgacacatgggtatgcttaatgaattcttgccatctttaaatatctttggaaattttatacttc

SEQ ID NO: 4295 - DNA, 1212 bp, Ricinus communis
atgacccgtcagcaactaggcccaacaaagttttcatcagacgaagtgtcttcacaaaatcaagtgaaagcatccgtgcagaggaaaattcgacagagtattgctgatgagtatccaggacttgagcccgtgttggatgatttgcttccaaagaagtcacctttaattgttgctaaatgtcaaaatcatctgaatcttgtgatggtgaacagtgttcctctgttttttaatattcgtgatgggccatacatgcctactctgcgtcttctccaccaatatccaaacataatgaaaaagttacaggtagacaggggtgcaataaaatttgtacttgctggtgcaaacataatgtgtcctggacttacatctccaggcggtgctttggatgaggaagtggaagcagaaactcctgtggccataatggctgaaggaaagcaacatgctcttgcaattggctttacaaaaatgtcagcaaaagatataaagacaattaacaagggaattggagtggacaacatgcattatctcaatgatggcctttggaagaaaaatccagctataaattcacttcaaaaccctagttatacttttgttccctttccacctcttcagcagcagcagcagcagcctacaagcaggagagcatcaatggggatcgatctgaaagcaggaggtaagagcaagaagaccaagcgtacagctcctaaatccgatgatatttaccttaagcttctcgtcaagctataccgatttttggtaaggagaaccggaagcaaattcaatgcagtgattttgaagaggctatttatgagcaagatcaataaggcaccgctttctctttctaggcttatcactttcatgaaaggaaaggagagtaagactgcagtggttgttggaacagtgacagatgatattagggtttatgaagttcctgctttgaaagtaacagcattgaagtttacagagactgcacgagctaggattgagaaggccggaggagagtgtcttacatttgaccagcttgctatgagagctcctttgggacagaacacggttctcttaagaggtccaaagaatgctcgagaagccgtgaaacactttggcccagctcctggtgtgcctcacagccataccaaaccatatgtgcgatcaaagggaaggaagtttgagagagctagaggaaggaggaacagcaggggttttagggtttga

SEQ ID NO: 4296 - DNA, 928 bp, Gossypium hirsutum
cctcttaatgtcatttgttctttcagcagcgccgcccacccccttcccccgaagcagcagtgatcaccggcaatgggtatcgatttggtcgccggcggcaagagcaagaagacaaagagaactgctccgaagtccgatgacatctacctcaagctcctcgtcaagctttacaggtttctagtaaggaggactgggagaaaattcaatgccgtgattttgaagcggcttttcatgagcaaagtcaacaaaccgccgttgtctctatccagattgattcaatacatgaagggcaaggaggataagatcgctgtggtagttgggacggtcaccgatgatattcgagtgtatgaagttccggcactgaaagttactgcattaaggttcactgagaccgcgagggcaaggatcgagaaggccgatggggaatgtttaacgtttgaccagcttgctcttcgagcacctcttgggcagaacacggttctcctccgaggtccaaagaatgctcgtgaagctgtgaagcactttggaccagctcctggtgtgccacatagccacaccaagccgtatgtgcggtcaaatggaaggaaattcgagagagctagaggaagaaggaacagcaaaggcttcagggtttgagttcaccactatcaacctatcatcaccgaaatgggtattttccctcttttttttagtgtgattgagcatgtttttcttttttggatatccatccattgtttccattttcagaattaaatatgagagattatgttgccccatgttgctttgaatcatgttaggatcagctaatataatggtaactttacttggaatcgtagatgttttgcaagttttttgcagattgttttcatctgggtataatcaatttgatctcaagcaagtgattctcggccgagtcttgatccacagg

SEQ ID NO: 4297 - DNA, 808 bp, Vigna unguiculata
gggagacataaccattcacaggtttgtgctgttccaacacccacagcggcaatggggatcgatcttaaggctggaggtaagagcaagaagaccaaaagaacagcacccaagtccaacgacatctacctcaaactacttgtcaagctttatcgtttccttgttcgaaggactggcagcaatttcaatgctgtgatacttaagcgcttgttcatgagcaaggtgaacaagcctccaatttctttgtcgaggttgattaagtatacaaaggggaaggaaggtaaaattgctgttttggtggggactgtaactgatgatatcagagtatatgaagttccaccattgaaaattacagcactcaggtttacagagacagcacgtgcaagaatagagaaggccggtggtgaatgtttgacatttgatcaacttgcccttagggctcctttgggtcagaatacggtccttctaagaggccccaaaaatgctcgtgaagctgtgaaacattttggtcctgctcctggtgtgccacacagccataccaaaccctatgttcggtctaagggaagaaagtttgagaaggcaagaggaaggaggaacagcagaggatttagagtttaagaagatagctttctattttttaatagtgttctgaaattcaactttttgttataggctctggtgactgtttttctcatatttttctggtaagaattcagttatggacatcgatcttggccccatattttgcattaagatgtatttactcgtttcatgaattgaaaacctaaaaaaaaaggaaaaaaaagggcgg

SEQ ID NO: 4298 - DNA, 919 bp, Vigna unguiculata
cttgctatcataaatcgcaggtgtagcggcaggcaaagagtgaaggaggttcgttccgagacccgaagcagcaatggggatcgatctgaaggccggaggtaagagcaaaaagacgaaaagaactgcaccaaagtccaatgatatctacctcaagctcttggttaagctttatcgcttccttgtccggagaactggcagcaatttcaatgctgttatactcaagcgattgttcatgagcaaggttaacaaggccccactttctttgtcaaggttgattaagtataccaaggggaaggaagaaaagattgctgttgtggtggggactgtaactgatgatattcgtgtttatgaagttccatccttgaaagttacagcactaaggtttaccgagactgcacgtgcaagaattgaaaaggctggtggtgaatgtttgacatttgatcagttggcgcttagggcacctcttggacagaacacggttcttcttagaggcccaaagaatgctcgtgaagctgtgaagcactttggtcctgctcctggtgttcctcacagccacaccaaaccttatgttcgatctaagggaaggaagttcgagagggctagaggaaggaggaacagccgaggatttagggtgtgatgtgatagataattttacgctggtattattacctctggaatgcagatttttcttatatgttagactgtggaggcagttttcttgttatttgtattctgataatgatttaagtacgaagttttcatttttggctcctttattttcctattgtgttttgtggaagctttaactcagttttgatgtcatagattggataatcgttaattatgtactttggcctctcccaaccttactacaaattacggaatttttgaacgacgagcatctattttttctcatgga

SEQ ID NO: 4299 - DNA, 824 bp, Zingiber officinale
gcaccagtggttcttcacgcaagtcggcgatgggtatcgatcttattgctggcggccggagcaagaaggtaaggcgtaccgcccccaagtccgacgatgtctacctcaagctcctcgtcaggctatacaagtttctggtgcggaggaccgggagcaaattcaacgcgataatactgaagaggcttttcatgagcaagaccaatcgaccgccgatctcccttaggaggcttatcaaattcatggacggacaggataacaagatagccgtgatcgttggcacggtgacggatgataagagagtgtatgaggtgccggctttgaaggtgacagctttgaggttcacggagactgctagggcgaggatacttaaagcaggaggagagtgcctgacatttgaccaactcgccctccgatctccccttgggcagaacacaattgtcttgagagggccaaagaatgctagagaagctgttaagcacttcggcaaagcgcctggcgtgccacacagccacacaaagccttatgttcgagccaaggggcggaagtttgagaaggccagaggaagaagaaagagcagaggtttcaaggtgtaaccttccctgatcagcaaacagaccattatcatttatcttacatcattcggaatgttacaatatcgctatgcaaggtgctgtgggaactataatttctagtgttttctttgaaatccatgatgcttttgtttgctagttttgaattaagacaagagggcagacactcgtcactgaggaattctagttaatattaattgaacttttgaaagttaagaaatttcaggtgtgttg

SEQ ID NO: 4300 - DNA, 887 bp, Vitis vinifera
aaaaccctagggttgaactgcaaatgagagcataagaggatggtataaagcccatccattattcccacctctcgagccgcggctggtaagaggatcacctttagcagtaggaggaggagcagcagcagcagccatgggtatcgatttagtcgccggcggcaaaagcaaaaagacgaagcgcaccgctcccaaatctgatgatatctacctcaagctcctagtcaagctgtatcgttttctggtacggagaaccggaagcaagttcaatgccgtgatactgaagcgtctgttcatgagcaagatcaacaaacctccgatgtctctctccaggttgattcgttatatgcaaggaaaggaggacaagattgcagtgctcgtgggaacggtaacggatgatcttcgggtctatgaggtgccgacattgaaggtaactgctctgaggttcacggagagggcgagagcaaggatcgagaaggccggtggagagtgcttgacgttcgaccaactggctctcagggctcctctcggtcagaacacggttctgctgagaggcccaaagaatgctcgtgaagcagtaaaacactttggtaaagctcctggtgtgccacacagccacactaaaccatatgttcgatcaaagggaaggaagtttgagagagccagaggaagaagaaacagcaggggttttagagtttaagttgtttgttggttgttttatcattatagacaaaaaatgtcatgtgacacattatgcatccttctacatcctgttgcatttcagtttttgttttggatcaaaagcatgttctcttttattattcccctatgctttttgtggacttgtgagcttgttaacaatgaaaatctaggtttttccggctgaaagc

SEQ ID NO: 4301 - DNA, 793 bp, Glycyrrhiza uralensis
agttttcctaccactgcgagtgccatcttaaattgcagcagcagcagtcgcagtcgcagcttgttaggctcgtccgaaacctgaagcagcaatggggatcgatcttaaggcaggaggtaagagcaaaaagacgaaaaggacagcgcccaagtccaatgatatctatctcaagctactcgtcaagctttatcgcttccttgttcggagaactggcagcaatttcaatgctgttgtactaaagcggttgttcatgagcaaggttaacaggccgccactatctttgtcaaggttgattaagtatatgcagggcaaggaaggtaagattgctgtggtggtggggactataactgatgatatacgcgtttatgaagttccgtccttgaaagttacagcactcaggtttacagagaccgcacgagcaagaatagaaaaggctggtggtgaatgtttgacatttgatcagttggctcttagggccccgctgggacagaacacggtccttcttagaggcccaaagaatgcccgtgaagctgtgaagcactttggtcctgctcctggtgtgccacacagccacaccaagccctatgttcgagcaaagggaaggaagttcgagagagctagaggaaggaggaacagccgaggatttagagtttgatgtgataatatttctttgctgctattattattgcttctgaaattcagatttttccgatatctagacgttggtgttatttctgtttgataatgattttcagtatggagattttaatcctggcccccttatcttccgtcg

SEQ ID NO: 4302 - DNA, 886 bp, Cucumis melo
acaccggcggcggctgttgaaactcggagagcatttgtaatggggatcgatctcgtagcaggaggtaagagtaagaagaccaggagggttgctcccaaatctgatgatatctacctaaagttactcgtcaagctttaccgctttcttgttcgtcgaactggaagcaatttcaatgctgtgattctcaagcgcttgtttatgagcaaggttaacaagcctccactttccctctctcggcttatccagttcatgaaaggaaaggaaagtaagattgctgtcgttgttgggactattaccgatgatattcgagtctatgaagttccagcattgaaagttgcagctttgaggttcactgagacagcaagggcaaggatcgaaaaggctggtggggaatgtttgacatttgaccagcttgctttgagggctcctctgggtcagaacacggttcttcttagaggtcctaagaattctcgagaggcagtgaagcatttcggtccagcacctggtgtgccacacagccattccaagccatatgtgaggtcgaagggaaggaagtttgagagggctagaggaaagagaaacagcaggggatatagggtttgatttgatcttttacttttttccaagcctaattcaatgcaagtgtgttatttcgaaattcaatatccaaattttgctagattttagttgcatgtcagttattccatttcttacggtttttcccatagtattgttgattatgaattcgattaaacgttattccgcgggacttcgcacagtctttttttgcttagatttgtgtgattatcattttctgttctgttcatttgagtatctataaaccatttctttaaaatcaaacaagtaagttgtaaaattgttctgc

SEQ ID NO: 4303 - DNA, 906 bp, Populus trichocarpa
accgaaggatcttaaaaccctagcctcccccactcgctgcttctcttccctttcaaggacgcttgatttgcctgtaccccagcagtcgagcagcaacagcacaacaacaatgggtattgatttgaaggccggtggaaagagtaagaagactaagagaacagctccaaagtccgatgatatctacctcaagctcctcgtcaagttgtaccggtttttggtgaggaggacaggcagcaagttcaatgcggtaatactgaagagactcttcatgagcaagatcaacaagcctcctctttctctctctcgtttgatcactttcacgaagggcaaggaagacaagattgccgttgttgttgggactataactgatgatattagggtttatgaggtccctgctctcaaggttactgccttgaggttcaccgaaactgctcgtgctaggattgagaaggcaggtggagaatgcttgacttttgaccaacttgctcttcgtgctcctcttggtcagaacacggttcttctcagaggtcccaagaatgcacgtgaggctgtgaaacactttggaccagctcctggtgtgccacacagccacaccaagccctacatacggtcaaagggaaggaaatttgagaaggctaggggtaaaaggaatagcaagggatttagggtttgaatgctgtacctcatgcagaaaatacagatcagccttccaaatccaaggtggtgcatctataagccaatatgcaattggttgtttgatctctttttttccttgtcttctcatgttgaacaattacattgtctttagaaagttaaaaaggtttcagtttcttttcaatattttgatctaagcaaatgattttgtttgtcaactggtaattaatggtttacttctgaatttcagca

SEQ ID NO: 4304 - DNA, 961 bp, Populus trichocarpa
ggacggtaaatgatgcctctgcataaacaccaatagacctcacctacacacatagattaaactatataactacttaaaaaccctagcttcgttttgttcccctttccgtctcccatcagcagcaccactagcagtagcggcgggtagctttaaagcttcaagaatggggatagatttgaaaagaggaggtaagtccaagaagaccaaacgtacagctccgaagtcggatgatatctatcttaagcttcttgttaagctgtaccggtttcttgtgaggagaactggaagcaggttcaatgctgtgatattgaagaggctgtttatgagcaagattaacaaggccccactttctctttctaggcttattacattcatgaagggaaaggaggacaagattgctgtgcttgttgggacagtaactgatgatattagagtctatgaggtgcctgcattgaaagtcactgctctgaggtttacagagacagctagggccaggattgagaaggctggaggagagtgcttgacatttgatcagcttgctttgagagctccattgggacagaacacagttctcctcagaggtccgaagaatgctcgtgaagctgtcaaacactttggcccagctccaggtgtgccacacagccataccaaaccatttgtgcgcgccaagggaaggaagtttgagaaagctagaggaaagaggaacagtaggggcttcagggtttaattttgttttagtgagagtgtgaggcagtttgttttgattgactgttccaatttttgtgcaactctaggtatccaaggatcattttcatgatattttaactttggttatctatttatctgcttggattgtttaatgcacagcaatcatgcttggtcatgcacaatgagtttttgaggatctcaattttctcaacaatatttaactaaactcatggaacatatgattctcttccta

SEQ ID NO: 4305 - DNA, 959 bp, Populus trichocarpa
ggacggtaaatgatgcctctgcataaacaccaatagacctcacctacacacatagattaaactatataactacttaaaaaccctagcttcgttttgttcccctttccgtctcccatcagcagcaccactagcagtagcggcgggtagctttaaagcttcaagaatggggatagatttgaaaagaggaggtaagtccaagaagaccaaacgtacagctccgaagtcggatgatatctatcttaagcttcttgttaagctgtaccggtttcttgtgaggagaactggaagcaggttcaatgctgtgatattgaagaggctgtttatgagcaagattaacaaggccccactttctctttctaggcttattacattcatgaagggaaaggaggacaagattgctgtgcttgttgggacagtaactgatgatattagagtctatgaggtgcctgcattgaaagtcactgctctgaggtttacagagacagctagggccaggattgagaaggctggaggagagtgcttgacatttgatcagcttgctttgagagctccattgggacagaacacagttctcctcagaggtccgaagaatgctcgtgaagctgtcaaacactttggcccagctccaggtgtgccacacagccataccaaaccatttgtgcgcgccaagggaaggaagtttgagaaagctagaggaaagaggaacagtaggggcttcagggtttaattttgttttagtgagagtgtgaggcagtttgttttgattgactgttccaatttttgtgcaactctaggtatccaaggatcattttcatgatattttaactttggttatctatttatacgcttggattgtttaatgcacagcaatcatgcttgctcatactcaatgagtttttgaggatctcaattttctcaacaatatttaactaaactcatggaacatatgattctcttcc

SEQ ID NO: 4306 - DNA, 898 bp, Populus trichocarpa
gttcttacagtacgtacagaggggtcctaaaaccctagcctccgtctcgttgcttctgtttaaggacatttgatttgcctctctcagcagcagcagcagcgaagcaccccacaacagcaatgggtatcgatttgaaggccggcggcaagagtaagaagaccaagaggacagctccaaagtctgatgatatctacctcaagctcctcgtcaagctgtaccggtttttggtgaggaggacaggcagcaagttcaatgcggtgatactgaagagactcttcatgagcaagaccaacaagcctcctcttgctctctctcgtttgatcacttacatgaagggcaaggagggtaagattgcagtggttgttgggacaataactgatgatattagggtttatgaggttcctgcactcaaggttactgccttgaggttcaccgaaactgccagggctaggattgagaaggcaggtggtgaatgcttgacttttgaccagcttgctcttcgtgctcctcttggtcagaacacggttcttctcagaggtcccaagaatgctcgtgaggctgtgaagcactttggaccagctcctggtgtgccacacagccacaccaaaccctatatacgatcaaaaggaaggaaatttgagaaggctagaggtaaaaggaacagcaagggatttagggtttgagtgtggtatctcacgcagaaaatacagccaaatccaagcagatgcatctataatccaatatgcaacttgtttgttttatcttttcttttcttatcctcacgtcttgaacaattattgtcttagaagttaaaagtttcggtttttcaatattttgatccgagcaacgattttgtttgttaactgggtgattaatggtttacttctgaatttcagca

SEQ ID NO: 4307 - DNA, 900 bp, Populus trichocarpa
gttcttacagtacgtacagaggggtcctaaaaccctagcctccgtctcgttgcttctgtttaaggacatttgatttgcctctctcagcagcagcagcagcgaagcaccccacaacagcaatgggtatcgatttgaaggccggcggcaagagtaagaagaccaagaggacagctccaaagtctgatgatatctacctcaagctcctcgtcaagctgtaccggtttttggtgaggaggacaggcagcaagttcaatgcggtgatactgaagagactcttcatgagcaagaccaacaagcctcctcttgctctctctcgtttgatcacttacatgaagggcaaggagggtaagattgcagtggttgttgggacaataactgatgatattagggtttatgaggttcctgcactcaaggttactgccttgaggttcaccgaaactgccagggctaggattgagaaggcaggtggtgaatgcttgacttttgaccagcttgctcttcgtgctcctcttggtcagaacacggttcttctcagaggtcccaagaatgctcgtgaggctgtgaagcactttggaccagctcctggtgtgccacacagccacaccaaaccctatatacgatcaaaaggaaggaaatttgagaaggctagaggtaaaaggaacagcaagggatttagggtttgagtgtggtatctcacgcagaaaatacagccaaatccaagcagatgcatctataatccaatatgcaacttgtttgttttatcttttcttttcttatcctcacgtcttgaacaattattttgtcttagaagttaaaagtttcggtttttcaatattttgatccgagcaacgattttgtttgtcaactgggtgattaatggtttacttctgaatttcagca

SEQ ID NO: 4308 - DNA, 706 bp, Papaver somniferum
cagaagaggaaggaggaggcgaaaccctaagtttgcaccaccaccagaagaagaaaatgggtatcgatttaattgcaggaggaaaaagcaagaaaaccaaaaggacagcaccaaaatccgatgatatctacttgaaacttcttgtcaagctgtaccgatttttggtacgaagaactggaagcaattttaatgctgtgatcctcaagaggttgtttatgagcaaggttaataaagctccattatctctctctagattgatcaagtttatggaaggaaaggatgaaaagattgctgtccttgttggtacagttactgatgatgttaggacttatgaagtaccaaaaatgaaggtagctgctttgaggtttacagagacaacaagagctagaattgagaaagctggtggagagtgcttgacctttgatcagcttgctctaagagctcctcttggacagaacacggttcttcttagaggtcctaagaattcacgtgaagctgtgaagcacttcggagcacctggtgttccacacagtcacagtaagccatacgtgcgatcaaagggaaggaagttcgagaaggctagaggaaagagaaacagtaggggattcagagtttaagttatattttgctgtgtcttttgttgagttaaacttaaaagtgtttcaactgagtaaggatcaaactaaatttgcctgtttgtttttca

SEQ ID NO: 4309 - DNA, 913 bp, Prunus persica
  misc_feature (899)..(899): n is a, c, g, or t
  misc_feature (903)..(903): n is a, c, g, or t
agcttctcaaaaccctagcttcatttgggtctgtccactcggcgataagcggcgtcccaaccagagcaactgagcttctgcaccaacagctccaatgggtatcgatcttgttgcaggaggtaagagcaagaagaccaagcgcactgcgcccaagtccgatgatatttatctcaagcttctcgtcaagctctaccgctttcttgtccggagaactggaagcaagttcaatgcggtcattctcaaacgtctcttcatgagcaaagtcaacaaggcaccactttctctctcaaggttgattcgttatatgcaaggaaaggacaacaagattgctgtggttgtggggactgtgacagatgatattcgcgtttatgaagttcctcaattgaaggttacagcactcagatttactgagactgcaagggccaggattgagaaggcaggaggagagtgcctaacatttgatcagcttgcattgagggcaccattgggtcagaatgtggttctcctcagaggaccaaagaatgcacgtgaagcagtgaaacactttggtccagcacctggtgtgccacacagtcacaccaaaccttatgtccgatcgaagggaaggaagtttgagaaggctagaggaaagagaaacagcaagggatttagggtttgagctaattagaattgaaagtgttatttctggaatccaattttgtttctctttaggtgtctggtatcgtgtttacttcattactctgttgggtaaatttgttttcaaccttggttagtaaaaacttgctccttttttaaacgccaatagttcctataatttcaaaatggtgtttcagttcacctgaaaaagaacgttgtttagtacatttggggaatgcattatatttctaatcccgattcangggntattttggtt

SEQ ID NO: 4310 - DNA, 860 bp, Prunus persica
gggactttcccagcaaataaaaccctagacctcttctctgcctcaagagcaacaaggagccgctatgggtatcgatttggtcgccggtggcaagagcaagaagacaaagcgcacagcgcccaagtccgatgatatctacctcaagctcctcgtgaagctgtatcggtttcttgtaaggaggactgggagtaagttcagtgcggtgattttgaagaggctgttcatgagcaaggtgaacaaggcccctctctccctttccagattgattcgttacatgaacgggaaggatggtaagatcgctgtggtcgtcgggactgtgacagacgacattcgagtttatgaagtacctgctctgaaagtgactgctcttaggttcactgaaaccgccagggctcggattgagaaggctggtggagagtgcttgacttttgaccagctggctctcagggcccctcttggccagaacacggttcttctcagaggaccaaagaatgctcgtgaagctgtgaagcactttggacctgctcctggtgtgcctcacagtcacaccaaaccctatgtacgatcaaagggtaggaaatttgagaaggctagaggcaaaaggaacagcaagggtttccgtgtttaagagttgcaaaacaagtcatctccctattttcagttgtgtttttctcactttgcgttattgttggacctattatgttatcaatagcttatcatcatctatatttccattgttccctatgactattttagcttttgagaggaagatgtttagatgtttgaaggattaatggatacttgcagaaatgtatggtagatgttgaagattttgtttaattcgattttggtttgatata

SEQ ID NO: 4311 - DNA, 907 bp, Glycine max
aagcccgtgggaaaatttgtcaaataaattcatctaaccccaaacaaaaccctagcacacttttatcgcttagtggcagcagcagtggcggcaagcaactccatccgcaatgggaatcgatttgaaggcaggaggtaagtccaagaagaccaagcgaaccgcccccaaatccgatgatatctacctcaagcttctcgtcaagctgtaccgttttcttgttcggaggactgggagtaacttcaatgctgttgtcctcaagcgccttttcatgagcaaggtcaacaagcccccgctatccctctctagattgatccgttacacgaagggaaaggaggataagatagctgtggttgttggtgccgtgaccgatgacattagggtttatgaagtccctgctctgaaggtaactgccttgaggttcactgaaactgccagagctagaattgagaaggctggtggggagtgcctcacctttgatcaactggctcttagagctccacttggccaaaacacggttcttcttagaggtcccaagaatgcgcgtgaggctgtcaagcactttggaccagctcctggtgtgccccatagccacaccaagccctatgtccgtgcaaagggaaggaaatttgagcgggccagaggaagaaggaatagcagaggctttagagtttgagttttgtaactcaaacatgaaggaattttcctcttaccttgtgatcattatgtactgttttctcgttttttggaacaatctgttaattttagtttttatttttccttctctatgggaaaaaaattgaaacgctttccccgaacaattttgttctagcacaaactacttttgagaggaggattaaagagtagctattggtctgcttcaggtgtgattttgccaagttttcatcta

SEQ ID NO: 4312 - DNA, 865 bp, Juglans hindsii x Juglans regia
  misc_feature (413)..(413): n is a, c, g, or t
  misc_feature (455)..(455): n is a, c, g, or t
  misc_feature (645)..(645): n is a, c, g, or t
  misc_feature (652)..(652): n is a, c, g, or t
tagtcgcgtcgtcgtcccccagcactagcgagacaccgcaacctcaactgccgaagcaagctccgatggggatcgatctggtcgcaggaggtaagatcaagaaatccaagcgtactgctccgaaatccgatgatatctaccttaaactcctcgtcaagctttatcggttccttgttcggagaactggcagcaagttcaatgcagtcattcttaagcgcttgttcatgagcaaaaccaacaagccaccactttctctgtccaggttgatccgttacatgaagggaaaggatggtaagattgctgtggttgtggggaccgtgaccgatgatattagggtttatgaagttcctgccttgaaggtcacagcactgagatttactgagacagctagggcgagaattgagaaggctggnggtgagtgcttgacgtttgaccaactggctctgagggctccnctgggacagaacacggttcttctcagaggtccaaagaatgctcgtgaggcagtgaaacactttggtcccgcacctggtgtgccacacagccacagcaagccctatgtacgatcaaagggaaggaagtttgagagggccagaggaaagaggaacagcaagggatttagggtttgagttgattttggtaccnttgttgnggaagaaatgttatttctgactatggtgatccaaatttttgctagactatcgtcatgtagatatggcatggcggttgtatttgtctttcttactttgatgtgggctatggacatgatcttttaatgcttgttacttcagacgtctcttttctacactattttgtctaaaaatgtatcttgggggggatgtttgatattccctccacgcaccat

SEQ ID NO: 4313 - DNA, 726 bp, Triticum aestivum
agcgcacggcgcccaagtcggacgatgtgtacctcaagctgctcgtcaagctctaccgcttcctggtgcggaggaccaagagccagttcaacgccgtgatcctgaagcgcctcttcatgagcaagaccaaccgcccgccgctctcgatgcgccgcctcgtcaggttcatggaggggaaggaggacaagatcgctgtgatcgtgggcaccatcaccgatgaccagagggtctacgagattccggcaatgaaggtggcagcgctcaggttcaccgagacggcgagggccaggattgtcaatgctggtggcgagtgccttacctttgaccagctcgccctccgtgctccgcttggacagaacacgcttctcctgaggggccccaagaacgccagggaagctgttaggcactttggcaaagctccaggagtgccacacagccacaccaagccatatgtccgctccaagggcaggaaattcgagaaggccagaggaaggaggaacagcaggggcttcaaggtttaagctgtggaatttctggcgcacttgtgtcatatcttgctatcattggtttatcgtcatctttttgggtaccagaatcataccgctttagatgtcagtgtcttgtgtcaacgagtattcagaaccagttaattcgtgttttgttgttttgcaacttgagaccatgcttgcaagccagttatgaatgtcatttctagtatcagaagtt

SEQ ID NO: 4314 - DNA, 869 bp, Unknown
  Sequence found in Organisms: Ipomoea nil, Ipomoea nil
atatagcagggccgattctctctctcagccgcacgcccccatcgacccccggaaccttttcagcggagctcaacaatgggtatcgatctcaaagccggcggtaagagcaagcagacgaagcgcactgcgccgaaatctgacgatgtttacttgaagcttctcgtgaagctgtaccggtttttggtgcgaaggaccggaagcaagttcaatgctgtgattctgaagcgtctcttcatgagcaagaccaacaagcctccggtttcactctccaggctcatcactttcatgtctggaaaggaggacaaaattgctgtgttagtgggcactattacagatgatgttagggcatatgaagtcccagcattgaaagtttgtgcactgaggttcaccaaaactgcaagggcaaggattgaaaaagctggtggagaatgcctgacatttgatcagttggctcttagggctccattgggacagaacacggttttgctgagaggtccaaagaatgcacgtgaagcagttaaacactttggtccggctcctggtgttcctcacagtcacaccaaaccgtatgtgcgtgccaagggaagaaagtttgagagggctaggggtaaaagaaacagcaggggatacaaggtttagttttatatatcaatatccgaggaactacctatttatgatttgtattgtggacttcaaattttgcaagacaagtatgagtttctctacgtagggttcttccatctctttgaatggatcatcttaaattgttgctgaatgcaagatttgttcaattcaagtttagaaatttgattttaggccctactactgtgtgctgtacttttgcattattttacaatctcacgaaaaag

SEQ ID NO: 4315 - DNA, 709 bp, Orobanche aegyptiaca
ctcttatcactccaagagcagaaaacagcggcagcagcagccaccggagccatgggtattgatttagtcgccggaggtaagagcaagaagaccaagcgcaccgcccccaaatccaatgacatttacctcaaactcctcgtcaagctctaccgatttttggtgaggagaactggaagcaggtttaatgcggtgattctgaagaggctgttcatgagtaagatcaacaggcccccgctctctctctcacgtctcagtgctctcatgaagggcaaggagaatcaaattgccgtattagttgggactgttacagatgacgttagggttgatgaaatccctgctatgaaggtgactgctttgagattcactgagacagctagggctagaattgagaaagctggaggagagtgtttgacttttgatcagcttgctctcagggctccccttggacagaatacggtactcttgagaggttcacgcaaggcccgtgaagctgtgagacactttggcccggctccaggtgttccacacagccacaccaagccctatgtgcgggccaagggaaggaagtttgagcgcgctagaggaaagagaaacagcaggggtttcagggtttaagtcatttttaatttttttcttttaccgactttgaagttatgtttgtggaatgctacatgagatattgtatgcttagtaatgactttgctttgct

SEQ ID NO: 4316 - DNA, 856 bp, Malus domestica
ctttataaagcttgtcaaaaccctagcttcactaagcggcgtcccgagcaaccgagcttcaacaccagcagcaacaatggggatcgatctcgtggcaggaggtaagagcaagaagacgaagcgcactgcgcccaagtccgatgatatctatctgaagcttctcgtcaagctgtaccgttttcttgtccggaggactgcaagcaagttcaatgcagtcattcttaaacgtttgttcatgagcaaggtcaacaaggcaccactttctctctcgaggttgattaagtatatgcaaggaaaggacaacaagattgctgttgttgtggggaccatcactgatgacattagggtttatgaagttccacaaatgaaggttacagcactgaggttcactgagactgcaagggccaggattgagaaggcaggaggagagtgcttgacatttgatcagcttgctttgagagcaccgttgggtcagaacgtggttctcctcagaggtcctaagaattctcgtgaagcagtgaagcacttcggaccagctcctggtgtaccacacagccacactaaaccttatgtgcggtccaagggaaggaagtttgagaaggctagaggaaagaggaacagcaagggctttagagtttaagccggtaggattgaaaacgctatttctggaatccaattttgctttggctctaggtgtctggtatcgtgtttactttttatttcactgttaactccaattgtctctattatttcaaaatgctgttcacttcactaaaagagaacagtgtttagtacatttgacgaatgcattatatttctaatcccgatttgcgcccaataaaacaaaaaaaaatgc

SEQ ID NO: 4317 - DNA, 1004 bp, Citrus sinensis
ggattcccgggtcgaccacgcgtccgattgctgtttagggaagcagtcgcagggagcagcagcagcagcaacaacaacaatgggtatcgatttgatagccggtggtaagagcaagaagtccaagaggactgccccgaaatcgaacgatatctatctcaagcttctcgtcaagctgtaccgatttctcgtgaggaggactgatagcaatttcgataaggtgatattgaagaggctcttcatgagcaaagtcaacaagcctcctatgtctctctctcgtttgactaaattcatgaagggcaaggaggacaagattgctgtggttgttggaacagtcactgatgatattcgtgtgtatgaagttcctgcactcaaggttactgcactgaggttcacagagacagcaagggcaagaattgagaaggcagggggagaatgcttgacatttgaccaactggctcttcgtgctcctttgggtcagaacacggttctcctgagaggtccgaagaatgctcgtgaggctgtcaagcactttggacctgctcctggtgtaccacacagccacaccaaaccctatgtgcgatctaagggaagaaaatttgagagggctagaggaaaaaggaacagcagaggcttcagggtttgagatgcagaactcattcataaggatacagagcagccgaccaccttatgcaaatgttgtgttttctttttttctccttgctattttaaatctcttgggacaatatcttagcaagttatatttggatttttggattttttttttgtttgagacagatcttggatgtccttcggggcttgatgtttagaagtgaagacaggatgcctcatttaaaagttgcccaagttctacacacatacatgcatgcctagttgaattaaaatgaaccatgagaactggttttagttttgttgtggatgttgctttgtgctaaatactgccacatttgtcgtaaaaatggcttttataaatgattgtccaatcc

SEQ ID NO: 4318 - DNA, 853 bp, Eucalyptus gunnii
  misc_feature (20)..(20): n is a, c, g, or t
cggccgggggtagcagtcgnggcagaggcgagctcggagagccagaagcagaggaagaagatggggatcgatctgaaggcagggggtaagagcaagaagaccaagaggaccgctcccaagtcggacgatatctacttgaagctcctcgtcaagctgtatcgtttccttgtccggaggaccggaagcaagttcaatgcagtcgtcttgaagcgcttgttcatgagcaaggtgaacaagcctccactgtctctctccaggctcatccgttacacgcaggggaaggaggacaaaattgccgtggtggtgggcaccattactgatgatataagggtccatgaggttccagctttgaaggttactgctttgaggtttaccgagacggcgagggcaaggattgagaaggcgggtggtgaatgcttgacatttgaccagcttgctcttcgtgctccacttggacagaacacggttcttctgaggggtcctaagaatgctagagaagcagtgaagcacttcggtcctgcacctggtgtcccacacagccacaccaagccatatgttcgctccaagggaagaaagtttgagagggctagaggcaggaggaacagcaggggattcagggtttgaacttagtttcttactcgttaaagccaatttggttttgattttcgcaatctaagttttgctgaagctagtcgaaagacttaatgtgaagacagctctatgtatctctggttttgggatcgattttcatatatttttaagtcttgctacgttacctgtgctattttttcacacccttgaaaagtgaatgccttgagatcagtgagttaaacccaggtgttcgaatttccta

SEQ ID NO: 4319 - DNA, 911 bp, Arachis hypogaea
ggagcacccatggttctttctctttctcttctactgcaatttgtttattcttttccgttttatctgtcacattttctgacccaatcttcattttgaattgcccgaagcagccatggggatcgatctgaaggctggaggtaagagcaagaagaccaaaagaacagcaccaaagtccaatgatatctaccttaagctcttggtcaagctttaccggttccttgtgaggagaactaacagcaacttcaatgctgtaatattgaagcgcttgttcatgagcaaggttaacaagcctccactatctttgtcaaggctgattaagtataccaaggggaaggaaggtaagattgcagtggtggttgggactataactgatgatattcgtgtatatgatgttccacccttgaaagttaccgcactcaggtttactgagactgctcgtgcaagaatagagaaggctggtggtgaatgcattacattcgatcagttggctcttagggcccctcttggacagaacacggtccttcttagaggcccgaagaatgctcgagaagccgtgaagcactttggtcccgcacctggtgtgccacacagccacaccaagccttatgtgcgatcaaagggaaggaagtttgagaaggctagaggaaggaggaacagcagagggtttagggtttgatatgatgatctttctatccctatttctctacttgtgctattatttttgacattcatatttttccaatatcatagacagtgataagagtgttcaagttgttgtttacattcttaacttatgatgatttttttgtttctcgccttcctctctcttgaagtgtaacgtatgcttactatcaactaagttttgatgttgagagtttggaattcagacgtaactaaacgttgacatacta

SEQ ID NO: 4320 - DNA, 862 bp, Glycine max
gatctaaccctaaacaaaaccctagcatgctttattctcgcttggttgcagcttcagcagcagcggcaagcaactccatccgcaatgggaatcgatttgaaggcaggaggtaagtccaagaagaccaaacgtacagcccccaaatccaatgatatttacctcaagctcctcgtcaagctgtaccgttttcttgttcggaggactggtagtaacttcaatgccgtcatcctcaaacgccttttcatgagcaaggtcaacaagcccccgctatccctctctagattgattcgttacaccaagggaaaggaggataagatagctgtggtagtcggggccgtgaccgatgacattagggtgtatgaagtccctgctctgaaggtaactgccctgaggttcactgaaactgccagagctagaattgagaaggctggtggcgaatgcctcacctttgatcaactggctcttagagctccactcggccagaatacggttcttcttagaggtcccaagaatgcccgtgaggctgtcaagcactttggaccagctcctggtgtgccccatagccacaccaagccctatgtccgtgcaaagggaaggaaatttgagcgggctagaggaaaaaggaatagcagaggctttagagtttgagttctggagctcaaacatgaaggagttttcattttacctcatgatcattatgtattgttttcttgtgttttggaacaatttgttaattttggtttttatttttccttatctaagggaaaaaattgaaacgctttccccgaacaattttgttcttgcacacttttcagaggattaatgagtagctattgttctacttaagtcgtgattttgacaa

SEQ ID NO: 4321 - DNA, 866 bp, Helianthus annuus
ggcgggggtggatacaccatttgtttttgcaggtaccagcagcagcagcacccgccgttaccatgggtatagatctcgttgcaggtggaaagagcaagcggaccaaaagaaccgcccctagatccgatgatatctacctcaagcttctcgtcaagctttatcggtttttagttaggagaactggaagcaatttcaatgctgtgattttgaagaggctcttcatgagcaaaatcaacaagcctccgatttcgctttctcgtttgattcgttacatgtctggcaaggaagacaagattgctgtggttgtgggcacagttaccgatgatgttagggttcatgagatcccttgcatcaaggttactgctctcaggtttacagagactgctagggcaaggattgagaaggctggcggtgaatgtttgacatttgaccagttggctctcagagctccacttggacagaacacggttttgctaagaggtccaaagaatgctcgtgaagcagtgaagcactttggaccagcgcctggtgtcccacacagtcacaccaaaccctatgtgcgatccaagggaaggaagtttgagaaggccagaggaagaagaaacagcagaggctttagaaactaagttttctttaatcgtacttcttgagttcatgccatgttctatacatttatctttatatttcatcgcagattaaggcgttagactactttttattatgaaattattgttctttaggcatctgtttggtattgttgagtgttttgaatcttcaaacattttcatttagatttctcttatgatgtttcagtataatgttgatctgcggcgtttagaatgacgcttggtcttgttttattgtac

SEQ ID NO: 4322 - DNA, 835 bp, Triphysaria pusilla
cactcccacaagagcagcttcagaaagcagctgagcagcagcagacaccgtagccatgggtatcgatttagtcgccggaggtaagaacaaaaagaccaagcgcaccgcgcctaaatccaatgatatttacctcaaactcatcgtgaagctgtatcggtttctggtgaggagaactgggagcagttttaatgctgttatcctgaagagattgttcatgagcaaggttaacaggcctccactatctctctcgcgtctcgttgctcacatgaagggcaaggacaaccaaattgctgtgttggttggaacagttactgatgatattaggcttcaggaagaagtacctgctatcaaggttactgctcttcgattcactgagacagctagagctagaattgagaaggctggtggtgaatgcttgacgttcgaccagcttgctctcagggctccacttggccagaacacggtactattgagaggttcgaggaaggctcgtgaagctgtgaagcactttggcccagctcctggtgttccacacagccacaccaagccatatgtgcgagccaagggtaggaagttcgagaaggccagaggaaagagaaacagcaagggattcagagtttgatctgtttctagcttttatgaagttttattgcaggttctttgtttgttgggtaccttatcagatatttgtatccctagtaatgacttggtctttttgtttcaaaagattttggatattcaatttgaattgtagtgctcgtttatttctggaacgatgaaaacacattttcggcaagttttggttagtcttaacatttgggcaaaagcattaaag

SEQ ID NO: 4323 - DNA, 789 bp, Triphysaria pusilla
ctcccacaagagcaggatcagaaagcggctggagcagcaccagacaccggagccatgggtatcgacttagtcgccggaggtaagaacaagaagaccaagcgtaccgcccctaaatccaatgatatttacctcaagctcatcgtgaagctttaccggtttctggtaaggagaaccgggagcagctttaatgctgttatcctgaagaggttgttcatgagcaaggttaacaggccaccgctctctctatcgcgtctcgttgctcacatgaagggcaaggataaccaaattgctgtgttggttggaactgttacggatgatattaggcttcaagaagaagttcctgctataaaggttactgctctgcgattcaccgagacagctagggctaggattgagaaggctggtggtgaatgtttgaccttcgatcagcttgctctcagggctcctcttggacagaatacggtactcttgagaggttcaaggaaggctcgtgaagctgtgaagcactttggtccagctcctggtgttccacacagccacaccaagccttatgttcgagccaagggcaggaagtttgagaaggctagaggaaagagaaacagcaagggcttcagagtttaatctgtttcttgtttttcttttgaagttgggttacatattatgtgtttgttggacaccttatgagatatttgtatccctattaatgaattggctttatttgtgctctttttgtttcaatttgaactgtagtgattttttactttttgggacaatgaaaaaatattttcg

SEQ ID NO: 4324 - DNA, 708 bp, Triphysaria pusilla
tcagaaagcggctggagcagcaccagacaccggagccatgggtatcgacttagtcgccggaggtaagaacaagaagaccaagcgcaccgcccctaaatccaatgacatttacctcaagctcattgtgaagctttatcggtttctggtgaggagaaccgggagcagctttaatgctgtaatcctgaagaggttgtttatgagcaaggttaacaggccaccgctctctctatcgcgcctcgttgctcatatgaagggcaaggataaccaaattgctgtgttggttggaactgttacggatgatattaggcttcaagaagaagttcctgctataaaggttactgctctgagattcaccgagacagctagggcaaggattgagaaggctggtggtgaatgtttgactttcgatcagcttgctctaagggctccacttggtcagaatacggtactcttgagaggttcaaggaaggctcgtgaagctgtgaagcactttggtccagctcctggtgttccacacagccacaccaagccttatgttcgagccaagggcaggaagtttgagaaggccagaggaaagagaaacagcaagggcttcagagtttaagtttaacctgtatcttgttttttttgaatttcgattgcagattttgtgtttgttggataccatatgagatatctatatctttattcgtgctctttttgtttcaa

SEQ ID NO: 4325 - DNA, 816 bp, Ipomoea nil
  misc_feature (797)..(797): n is a, c, g, or t
ggtgtaagtatagcagagccgatcatccccagtcgctctccccattccccctccccctttccccgaagccaccactccagcggcgctccaccatgggtatcgatctgaaagccggaggtaagagcaagcagacgaagcgcacagctcccaagtccgacgatgtttacttgaagcttctcgtgaagctttaccgattttttggtgaggaggaccggaagcaagttcaacgctgtgattctgaagcgtctgtttatgagcaagaccaacaagcctccactgtctctctcaaggctgatctctttcacgtctggaaaggaggacaagattgctgtcctggtgggtactatcacggatgatgtgagagcctacgaggtcccagcattgaaggtctgtgctctgaggttcaccaaaaccgcaagggctaggattgagaaggctggtggtgaatgcttgacgtttgatcagcttgctcttcgggctcctttgggacagaacacggttctgctcagaggtccaaagaattcgcgtgaagcagttaagcactttggtccagctcctggtgttccacacagtcacaccaagccatatgtgcgcgccaagggaagaaagtttgagagggcaagaggcaagagaaatagcagaggatacaaggtttaagttcattttcatacttgacaatgggaagtatcatttgtgttgtggtattcaaattttgcaagactgtagtatgcagttacgagtttcagtactgttttggttttgccgctggtacttttaactttgtttttaaatggaangtttctccattagtgtctt

SEQ ID NO: 4326 - DNA, 881 bp, Eschscholzia californica
tttgcggcaggcaggtaaggcagagcaccaaaatcaacagcaacagcaaaaatgggtattgatctagttgcaggaggaaagagcaagaaaaccaaaagaactgctcctaaatcagatgatatttacctcaagcttcttgttaagctttataggtttttggtgaggagaactgaaagcaagttcaatgctgtgatattgaagagattattcatgagcaaggttcacaaagcaccattgtctctatctaggttgatttcttacaccaagggaaaggaagggaagattgctgtgcttgttggaactattactgatgatactagggtttatgaagttccagctataaaggtggcagctttgaggtttactgagactgcaagagctagaattgaaaaggctggtggagaatgcttaacttttgatcagctcgctcttagggctcctcttggccaaaacacggtacttctcagaggtccaaagaactcgcgtgaagcagtgaagcactttggaagggctcctggtgtgccacacagccactcgaaaccatatgtgcgttcgaagggaaggaagttcgagaaggctagaggaaaaagaaacagccgaggtttcagggtttaagttatttgttgtgttttatctatctcaaggtaaagcaagtaaggatcattttgaggtacttggtcttttagcggttcgaagtttgttagacaagaatattttggtatttactttttttcctagttaaaagttaatagttttgaggttttgattcgaatttcttgtaaaaccaacttgggttatgttgttttgattggaatggaatagaagctaaggtagttaaatgattatcaacactctactttagccttcaaaaaaaaaaaaaa

SEQ ID NO: 4327 - DNA, 790 bp, Ipomoea batatas
ggaaccttttcagcggagctcaacaatgggtatcgatctcaaagccggaggtaagagcaagcagacaaagcgcacagcgccgaaatctgacgatgtttacttgaagcttctcgtgaagctgtaccgatttttggtgcgaaggaccggaagcaagttcaatgctgtgattctgaagcgtctcttcatgagcaagaccaacaagcctccggtttctctctccaggctcatcactttcatgtctggaaaggaggacaaaattgctgtgttagtgggcactattacagatgatgttagggcatatgaagtcccagcattgaaagtttgtgcactgaggttcaccaaaactgcaagggcaaggattgaaaaggctggtggagaatgcctgacatttgatcagttggctcttagggctccattgggacagaacacggttttgctgagaggtccaaagaattcacgtgaagcagttaaacactttggtccggctcctggtgttcctcacagtcacaccaaaccatatgtgcgtgccaagggaagaaagtttgagagggctaggggtaaaagaaacagcaggggatacaaggtttagttttatatatcaacatccagggacctacctatacctatttatgttttgtattatggaattcaaattttgcaagacaagtatgagtttcttgtttccgattctgatgtccagtaacgtagggttcttccatctcttcgactatggatcatcttaaattgttgctgaatgcaagatttgttgaattgaagtttagaactttga

SEQ ID NO: 4328 - DNA, 738 bp, Ipomoea nil
cccgaagccaccactccagcggcgctccaccatgggtatcgatctgaaagccggaggtaagagcaagcagacgaagcgcacagctcccaagtccgacgatgtttacttgaagcttctcgtgaagctttaccgatttttggtgaggaggaccggaagcaagttcaacgctgtgattctgaagcgtctgtttatgagcaagaccaacaagcctccactgtctctctcaaggctgatctctttcacgtctggaaaggaggacaagattgctgtcctggtgggtactatcacggatgatgtgagagcctacgaggtcccagcattgaaggtctgtgctctgaggttcaccaaaaccgcaagggctaggattgagaaggctggtggtgaatgcttgacgtttgatcagcttgctcttcgggctcctttgggacagaacacggttctgctcagaggtccaaagaattcgcgtgaagcagttaagcactttggtccagctcctggtgttccacacagtcacaccaagccatatgtgcgcgccaagggaagaaagtttgagagggcaagaggcaagagaaatagcagaggatacaaggtttaagttcattttcatacttgacaatgggaagtatcatttgtgttgtggtattcaaattttgcaagactgtagtatgcagttacgagtttcagtactgttttggttttgccgctggtacttttaactttaaatggaaggttctccat

SEQ ID NO: 4329 - DNA, 729 bp, Ipomoea nil
ggtcaggagcagctgcagtagcaatgggtatagatttggtcgccggcggcaaaagcaagcagaccaaacgcactgccccgaagtccgacgatgtctatctcaagctgctcgtcaagttgtatcgatttctggtgcggagaacggagagcaagtttaatgctgcgatactgaagaggctatttatgagcaaaaccaacaaggctccactgtctctctccaggttgattcaattcatccaaggaaaggaggataagattgctgttcttgttgggacagtgactgatgatactagagcttatgaagtgcccaaaatgaaagtagctgcactgagattcactgagacagcaagagctagaattgagaaagcagggggtgagtgcttgacttttgatcagcttgctctccgagctcctcttggccagaacacggtgcttctacggggccctaaaaactcccgtgaggccgtgaagcactttggcagagctcctggagtgccacacagccatatcaagccctatgttaggtccaagggcagaaaatttgagagagccaggggaaagagaaatagcagaggctataaaatttaggtattttaaattgcttagttcttcagctgtaagtgctgaaatttaaattttgtcatcatctcagggataatttttctgtgttatgtgagtgataggtttggacagtttagtcataaacccatagttcctttcaaaatcagat

SEQ ID NO: 4330 - DNA, 867 bp, Tropaeolum majus
acggccgggggtataatcgttcgtatattcgcgactccattgcagaagcttcaacacccaaaaatgggaatcgatctcatcgccggaggtaagagcaagaagactagaaggactgcccctaagtccgatgatatctaccttaagctgcttgtgaagctttaccgatttctggtgaggagaactggaagcaagttcaattctgttatccttaagcgtctttttatgagcaaggtcaacaagcctccaatttcaatctctaggctcgtgaaatacatggagggaaaggaagataaaattgccgtgattgttggagcagtcaccgatgacttgagggcatacgaggtccctaaaatgaaagttacagctttgaggttcactgagactgcaagagctaggatcgaaaaggctggtggagagtgtttgacatttgatcagcttgctctcagggctcctttaggccagaacacgattctcctaagaggccccaagaactcccgagaggcagttaagcactttgggccagcacctggtgtcccacacagtcacaccaagccatatgtgcgctccaagggaaggaagttcgagaaggccagaggaaggagaaacagtcgtggattcagaaactaagtcttaagttttccttcatcacaagtctcaagttcctgtttatgatatattttattcaaattttgatagaccataggcttcaatgttttgttcactgtttaaatcatttttattcaaaccttctttctgttataaatcagtgtgctactttagtaacttgaaatctaatgctttcttttgctttgtgttatctgatatataattttgagtgggtcgaaaaaaaaaaaaaaaaaaaggccg

SEQ ID NO: 4331 - DNA, 846 bp, Solanum phureja
tcttcttcatatttttccattctttgaacagaaaaatctatcagcagcaggcggcggcggaggagagtagaagcagcaggcggagcatcatcatgggtatcgatctagtggccggaggtaagtccaaaaagactaagcgcattgcaccaaaatccgacgatgtttatctcaagcttctcgtcaagttgtaccgatttcttgcacggaggactggtagtaagttcaatgctgtgatactgaagagactcttcatgagcaagatcaataaagctccattgtctctatcacgtttggttacttacatgaccggaaaggaggacaatattgctgttattgtcgggactgttaccgatgatgttcgagcttatgaagtccctaaaatcaaggttactgcattgagattcactgaaacagctagagctaggattgagaaggctggaggagaatgtttgacctttgatcagctcgctctcagagcccctcttgggcagaacacggttttacttaggggtccaaagaactcaagggaggctgttaagcactttggtaaagcacctggtgtcccgcacagccacacgaagccttatgttcgtgcaaagggaaggaagtttgagcgagcaagaggaaagagaaatagcagaggctacaaggtttgagcaagtgcagatgtttgaatgcacattgatagagtttctattagaagtatttcccaacctacttttaccattatagtttcttgttggattttcttatttcaactttgtttctcttacacactccagcatcatattgctgatttttgaatgtgtttcttatctgttttgcgaaattaatctctatttagag

SEQ ID NO: 4332 - DNA, 882 bp, Arabidopsis thaliana
ctctcgcagacgcagccatgggtatcgatcttatcgcaggaggtaagagtaagaagaccaaaaggactgctcctaagtccgatgatgtctacctaaagcttctcgtcaagctttaccggtttttggtgaggagatctaacagcaacttcaatgctgtgattctgaaaaggcttttcatgagcaaagtcaacaaagctcctctttcactctctaggcttgtagagttcatgactggcaaggatgacaagattgctgtgttggttggaactatcactgatgatttgagagttcatgagattcctgccatgaaggttactgccttgaggtttactgagagggctagggctagaattgagaaagctggtggagagtgcttaacctttgaccagcttgctctcagagctccattgggacagaacacagttcttcttagaggaccaaagaactcgcgtgaagcagtgaagcatttcggacctgctcctggtgtgccacacagtaacactaagccatatgttaggcataagggaaggaagtttgagaaagctagaggaaagcgaaagagtcgtggattcaaggtctaagaagatgttttctggtttcgttttgcttggtttaagtatcgaagttttggtagggaacgctggttcctctttaccctgttccagactttgttttaagttctgtttttctattctcaagacaattggatattttgctttgtcttttaatcttactactattagctgcaatgagattttatctagaatttggatttgatcagtatttggagttcatagtatcattatggtctatttcgttttgtatttctcttccttggaaataaaatatctgtacatgagtattaaaatgtgtaaacaaccc

SEQ ID NO: 4333 - DNA, 859 bp, Brassica oleracea
gacaaaagctagattcatcacttctcttgcagaatcttcgaccgcggcggcaccacatcctccgggaggccacaatgggaattgatttgatcgctggaggtaagagcaagaagaccaaaaggacagctcccaagtccgatgatgtctacctcaagcttaccgtcaagctttacaggtttctggtaaggagaacacagagcaagttcaatgcagtgatcttgaagaggcttttcatgagcaaagtcaacaaagctcctctttctctatctaggctcgtcgagttcatgaccggcaaggaagataagattgctgtcttggttggaaccataaccgatgatttgagggtacacgagatcccagctatcaaggttactgccttgaggttcacggagagagccagagctcgcattgagaaagctggtggtgaatgcttgacctttgaccagcttgctctcagagctcctttgggacagaacactgttcttcttagaggacctaagaactcacgtgaagctgtgaagcattttggacccgctcctggtgtgccacacagtcactccaagccttatgttcgctccaagggaaggaagttcgagaaggccagaggaaagaggaagagccgtgggttcaaggtttaaggacattgtctgcgtctttgaacttgtttctagagtgttgttgcttcttgacttttgttagagaatcgtgtgtttttttgttgcctgtgtcagacaatattttaagattgtttctactggattaattgtgtacttattgcacattgtactggggtttcttggcttatacggcacacttaaacatacaaaacccttaagtagaagcaaacattttgatctgc

SEQ ID NO: 4334 - DNA, 750 bp, Brassica rapa
gcggcggcaccaaatccccggacgctacaatgggtatcgatttgatcgctggaggtaagagcaagaagaccaaaaggacagctcccaagtccgatgatgtctacctcaagctcactgtcaagctttacaggtttctggtgaggagaactcagagcaagttcaatgcagtgatcctaaagaggcttttcatgagcaaagtcaacaaagctcctctttctctatctaggctcgtcgagttcatgactggcaaggaagataagattgctgttttggttggaaccatcaccgatgatttgagagtacacgagattccagctatcaaagtcactgccttgaggttcacggaaagagccagagctcgtattgagaaagctggtggtgaatgcttgacctttgaccagcttgctctcagagctcctttgggacagaacacggttcttcttagaggacctaagaactcacgtgaggctgtgaagcactttggtcccgctcctggtgtgccacacagtcactcgaagccatatgttcggtccaagggaaggaagttcgagaaggccagaggaaagaggaagagccgtggtttcaaggtttaagaacattgtctgtgtcactgaacttgattctgttgtgttgttgcttcttaatcactttcataatggtttttgttagagaattgtgctttttggtgccttgtttcagacaatatccagagtttttggtgccttgtttatcaaactttaaattctttcc

SEQ ID NO: 4335 - DNA, 760 bp, Brassica napus
ccaaatccccggacgctacaatgggtatcgatttgatcgctggaggtaagagcaagaagaccaaaaggacagctcccaagtccgatgatgtctacctcaagctcactgtcaagctttacaggtttctggtgaggagaactcagagcaagttcaatgcagtgatcctaaagaggcttttcatgagcaaagtcaacaaagctcctctttctctatctaggctcgtcgagttcatgactggcaaggaagataagattgctgttttggttggaaccatcaccgatgatttgagagtacacgagattccagctatcaaagtcactgccttgaggttcacggaaagagccagagctcgtattgagaaagctggtggtgaatgcttgacctttgaccagcttgctctcagagctcctttgggacagaacacggttcttcttagaggacctaagaactcacgtgaggctgtgaagcactttggtcccgctcctggtgtgccacacagtcactcgaagccatatgttcggtccaagggaaggaagttcgagaaggccagaggaaagaggaagagccgtggtttcaaggtttaagaacattgtctgtgtcactgaacttgattctgttgtgttgttgcttcttaatcactttcataatggtttttgttagagaattgtgctttttggtgccttgtttcagacaatatccagagtttttggtgccttgtttatcaaactttaaattctttcctcaaaagttcttaacgtct

SEQ ID NO: 4336 - DNA, 823 bp, Brassica napus
gatgaactgatataaaagcttagattcatcacttctcttgctgaagcttcgactgcggcggcaccaaatccccggacgctacaatgggtatcgatttgatcgctggaggtaagagcaagaagaccaaaaggacagctcccaagtccgatgatgtctacctcaagctcactgtcaagctttacaggtttctggtgaggagaactcagagcaagttcaatgcagtgatcctaaagaggcttttcatgagcaaagtcaacaaagctcctctttctctatctaggctcgtcgagttcatgactggcaaggaagataagattgctgttttggttggaaccatcaccgatgatttgagagtacacgagattccagctatcaaagtcactgccttgaggttcacggaaagagccagagctcgtattgagaaagctggtggtgaatgcttgacctttgaccagcttgctctcagagctcctttgggacagaacacggttcttcttagaggacctaagaactcacgtgaggctgtgaagcactttggtcccgctcctggtgtgccacacagtcactcgaagccatatgttcggtccaagggaaggaagttcgagaaggccagaggaaagaggaagagccgtggtttcaaggtttaagaacattgtctgtgtcactgaacttgattctgttgtgttgttgcttcttaatcactttcataatggtttttgttagagaattgtgctttttggtgccttgtttcagacaatatccagagtttttggtgccttgtttatcaaactttaaattctttcctcaaaagttcttaacgtct

SEQ ID NO: 4337 - DNA, 888 bp, Centaurea maculosa
  misc_feature (12)..(13): n is a, c, g, or t
  misc_feature (174)..(174): n is a, c, g, or t
  misc_feature (234)..(234): n is a, c, g, or t
  misc_feature (252)..(252): n is a, c, g, or t
  misc_feature (811)..(811): n is a, c, g, or t
  misc_feature (820)..(820): n is a, c, g, or t
tctaaccctagnnttccttcccccttttcccttggcacataccatttctctttgcaggtaccatcaaccgccgtccccatgggtatagatctcgttgcaggtggaaagagcaagaagaccaaaaggaccgcccctagatccgatgatatctacctcaagctcctcgtgaagctntatcggtttttggtgaggaggactggaagcaacttcaatgctgtgatattgaagaggctnttcatgagcaaaatcaanaagcctccgatttctctatctcggttggttcgttatatgtctggaaaggatgacaagatcgctgtgattgttggcacagttactgatgatgttcgtgtgcatgagatcccttgtatgaaggttactgctttgaggtttaccgagactgcaagggcaaggattgagaaggctggtggtgaatgcttgacatttgaccaacttgctcttcgtgctcctcttggacagaacactgttctactaagaggcccaaagaattgccgtgaagcagtgagacactttggaaaggctccgggtgtgccacacagccacaccaagccatatgtgcgagccaagggaaggaaattcgagaaggctagaggtagaagaaacagccgaggctttaggaactaagctctactcgaggtgggactttttcaattcagctctatactccgcctatcttcatatttggttacctattagacatacttgttgtgatgaaattttttgttagccatcctttttcggtattgttggatgctttgagtcttaacttttcagtttggattttgattaaatnaatgttggntgcatttgaaattgaagcctaacttggttgtttttggatgcattacaaggatttcaatcttttctcgc

SEQ ID NO: 4338 - DNA, 931 bp, Cryptomeria japonica
  misc_feature (38)..(38): n is a, c, g, or t
  misc_feature (46)..(46): n is a, c, g, or t
  misc_feature (704)..(704): n is a, c, g, or t
  misc_feature (707)..(707): n is a, c, g, or t
  misc_feature (711)..(711): n is a, c, g, or t
  misc_feature (717)..(717): n is a, c, g, or t
  misc_feature (723)..(723): n is a, c, g, or t
  misc_feature (725)..(726): n is a, c, g, or t
  misc_feature (729)..(729): n is a, c, g, or t
  misc_feature (734)..(734): n is a, c, g, or t
  misc_feature (746)..(746): n is a, c, g, or t
  misc_feature (749)..(749): n is a, c, g, or t
  misc_feature (774)..(774): n is a, c, g, or t
  misc_feature (802)..(802): n is a, c, g, or t
  misc_feature (816)..(816): n is a, c, g, or t
  misc_feature (823)..(823): n is a, c, g, or t
  misc_feature (834)..(834): n is a, c, g, or t
  misc_feature (856)..(856): n is a, c, g, or t
  misc_feature (871)..(871): n is a, c, g, or t
  misc_feature (915)..(915): n is a, c, g, or t
  misc_feature (926)..(926): n is a, c, g, or t
tgccggaggaggaagcggaaggagtgggaatcgaactncaggccanctacagggaaaaatgggtattgatttggtagcaggagggaagagcaagaagaccaagcgtaccgctccgaagagcgacgatatttatctcaagcttctcgtaaagctttacaggtttttagtgagaagaaccagtagcagctttaatgcggtagttttgaagaggctgtttatgagcaagattcacaaagcaccattatctctctctcgcctcgtgcgttatatggaggggaaggagggcagtactgctgtgttagttggtactgtaactgatgataaaaggctttatgagctaccagcattgaaggttgtagctcttcgattcacagaaacagcaagggctaggattttaaaggcaggaggggaatgcttgacctttgatcaacttgcgttgcttgcaccattgggacaaaacacggtccttttgcgtggacctaagagtcaccgtgaggctgttaagcattttggaaaggcacctggtgtcccacacagtcacaccaaaccttatgtccgctctaaaggaagaaaatttgagaaagctcgtggtaggagaaacagccgtggttacaaggtttaaatcatttaataggttctttggggtaattttagtaaattgtggagacataggcttactacaacttatgtggtaattgtaagcngtnatgntatatngttgtntnnagnacttnaaaggttcattntanttcatgagtattaacaattttgttngcttttaaatgcttttttactctctgtnaaacattgaattcntgtaacntttggcacagntttgccaaatttatattgtggncacttcaatgttcanggtatactgagaattatgttttttgaatggatttttaaaatgtngttcttgtggntggcc

SEQ ID NO: 4339 - DNA, 822 bp, Cynara scolymus
ccctagcttcctcccccttcccctgggcacccttttctttttgcaggtccagcaaccgccgtccccatgggtatagatctagttgcaggtggaaagagcaagaagaccaaaagaaccgcccctagatccgatgatatctacctcaagctccttgtcaagctttatcggttcttagtgaggaggacaggaagcaacttcaatgctgtgatattgaagaggctgttcatgagcaaaattaacaaacctccgatttctttatctcggttgattcgttacatgtctggcaaggaggacaagattgctgtgattgtcggtacagttactgatgatgttcgggtgcatgagatcccttgtatgaaggttactgctttgaggtttactgagactgcaagggcaagaatcgagaaagctggtggagaatgcttgacatttgaccaactggctcttagagctcctcttggacagaacactgttctgctaagaggtccaaagaattgtcgtgaagcagtgcgacactttggaaaggctcccggtgtgccacacagccacaccaagccgtatgtgcgagctaagggcaggaaattcgagaaggctagaggtagaagaaacagtcgaggctttagaaactaagctctccgaggtggtactctttgatttcagttctatactcttcctatctttaaatttggtcatctattagacgtacttgttgtgatgaaattttttgttagtcatcttttttgggtattgttggatgatttgagtgttaacatttccatttggattttgattaaaaatcaatgttggttgcacttgaaattg

SEQ ID NO: 4340 - DNA, 828 bp, Ipomoea nil
  misc_feature (41)..(41): n is a, c, g, or t
  misc_feature (95)..(95): n is a, c, g, or t
  misc_feature (110)..(110): n is a, c, g, or t
  misc_feature (119)..(119): n is a, c, g, or t
  misc_feature (198)..(198): n is a, c, g, or t
  misc_feature (335)..(335): n is a, c, g, or t
  misc_feature (726)..(726): n is a, c, g, or t
tctctcagccgcacgaccccctcaccccggaaccttttcancggagctcaacaatgggtatcgatctcaaagccggaggtaagagcaagcagacnaagcgcacagcgccnaaatctgangatgtttacttgaagcttctcgtgaagctgtaccgatttttggtgcgaaggaccggaagcaagttcaatgctgtgattntgaagcgtctcttcatgagcaagaccaacaagcctccggtttctctctccaggctcatcactttcatgtctggaaaggaggacaaaattgctgtgttagtgggcactattacagatgatgttagggcatatgaagtnccagcattgaaagtttgtgcactgaggttcaccaaaactgcaagggcaaggattgaaaaggctggtggagaatgcctgacatttgatcagttggctcttagggctccattgggacagaacacggttttgctgagaggtccaaagaattcacgtgaagcagttaaacactttggtccggctcctggtgttcctcacagtcacaccaaaccatatgtgcgtgccaagggaagaaagtttgagagggctaggggtaaaagaaacagcaggggatacaaggtttagttttatatatcaacatccagggacctacctatacctatttatgttttgtattatggaattcaaattttgcaagacaagtatgagtttcttgtttccgattctgatgtcnagtaacgtagggttcttccatctcttcgactatggatcatcttaaattgttgctgaatgcaagatttgttgaattgaagtttagaactttgattttaggccc

SEQ ID NO: 4341 - DNA, 823 bp, Liriodendron tulipifera
ttgtttcgcagaacccaccgtcgctgaggagaagagcagcagccgcgaccgttctacgcagcagcatccgaaatgggtatcgatctagtcgccggcggcagaagcaagaagacgaaaagaaccgcccccaaatccaacgatatttacctcaagcttctcgtcaagctgtataggttccttgtccgtcgcactggaagcaagttcaatgcagttatcctgaagaggcttttcatgagcaaagtcaacaaacccccgatttccctctcgaaactgatccatttcacgaagggcaaggaagataagattgccgttattgtcgggacggtcactgatgatatcaggattcatgaagtccctgcgctgaaggtgaccgcactgaggtttacggagcgagccagggcgaggattgtgaaagctgggggagagtgcctgacattcgatcagcttgccctccgggccccgctcgggcagaacacggttctccttagaggtaggaagaattcacgtgaagccgtgaagcactttggaaaagctcccggtgtgcctcacagccacaccaaaccctacgtgcgatcgaagggaaggaaattcgagagggcaagagggagaagaaacagcaggggattcagggtttgagtctcttgtcattcttcctcctgttgcaattttccctttatccatgaggatctctatctactactagttatgtttcaccatgctgtgtttcgattttgctagacaggtagtaattgcaggagtttgaatttctgtccatttgcagtggatcatttcctaaaaccatatagatacattttatttgcat

SEQ ID NO: 4342 - DNA, 823 bp, Petunia hybrida
cttaactcttggaaaccctgcgccgctcagttgctactactactccccccacatatccttgtgaactccttacattggcggaatctaatggggatagatctgaaagccggaggtaagagtaagaagacaaagcgcacagcgcctaaatctgacgatgtttacttgaaactccttgtcaagctttaccgttttttggtgcgtcgaacgggaagcaaattcaatgctgtgattcttaagcgactgttcatgagcaagatcaacaaacctccactttccctttcaaggttgataaattatgccaaaggaaaggacgataagattgcagtcattgtcggctctattacagatgatgctagagcttatgatgttccggctcttaaggtttgtgccctgaggttcacaaaaactgcaagggcaaggatcgagaaggctggaggagagtgtttgacatttgatcagcttgctcttagggctccgcttggtcagaacacggttctcctcagaggtcctaagaatgctcgtgaagcagtcaaacactttggtccagctcccggtgtgccacacagccacaccaaaccatacgttcgttcaaagggaagaaagtttgagagggcaagaggaagaagaaagagccgtggttacaaagtttaagttgattatcatatattttgtcgggttggtttaagcagttgtattgcgatagtaggaccttcgcagactagtattcagttttggaatttgctcatttctacttactggttaggatatttttatactatgaacatcaaaatcgaaatattgcttctgagtaggaaaaaaaaaa

SEQ ID NO: 4343 - DNA, 841 bp, Populus trichocarpa
ttttgttctcctctccaactcccatcagcagcaccactagcagcagcggcgggtagcgtcgaagcttcaacaatggggatagatttgaaagcaggaggtaagtccaagaaaaccaaacgtacagcaccgaagtcggatgatatctatcttaagcttcttgttaagttgtaccggtttcttgtgaggagaactcagagcaagttcaatgctgtgatactgaagaggctttttatgagcaagattaacaaggccccactctctctttcaaggcttattacgtacacaaagggaaaggagggcaagattgccgtggtcgtggggacagtaactgatgatattcgagtttatgaggtgcccacattgaaggtcactgctttgaggtttacagagacagctagggccaggattgagaaggcaggaggagagtgcttgacattcgatcagcttgcattgagagctccattgggacagaacacagttctcctcagaggcccaaagaatgctcgtgaagctgtcaaacattttggcccagctcctggtgtgccacacagccataccaaaccatatgttcgtgcaaagggaaggaagtttgagaaagctagaggaaagaggaacagcaagggcttcagggtctaattttattgtagtgataaattgtgaggcagtttgttttgattttgactctctgtgttccaatttttgttcaactttaggtttctaaagatcttgttcattttatttccatttgggttattgattaatccgcatggattgtttaatgctcagatatcatacttggttatgcgtaatgaattattgaagatctcgattttctccctca

SEQ ID NO: 4344 - DNA, 841 bp, Populus trichocarpa
tttcgttctcctctccaactcccatcagcagcaccactagcagcagcggcgggtagcgtcgaagcttcaacaatggggatagatttgaaagcaggaggtaagtccaagaaaaccaaacgtacagcaccgaagtcggatgatatctatcttaagcttcttgttaagttgtaccggtttcttgtgaggagaactcagagcaagttcaatgctgtgatactgaagaggctttttatgagcaagattaacaaggccccactctctctttcaaggcttattacgtacacaaagggaaaggagggcaagattgccgtggtcgtggggacagtaactgatgatattcgagtttatgaggtgcccacattgaaggtcactgctttgaggtttacagagacagctagggccaggattgagaaggcaggaggagagtgcttgacattcgatcagcttgcattgagagctccattgggacagaacacagttctcctcagaggcccaaagaatgctcgtgaagctgtcaaacattttggcccagctcctggtgtgccacacagccataccaaaccatatgttcgtgcaaagggaaggaagtttgagaaagctagaggaaagaggaacagcaagggcttcagggtctaattttattgtagtgataaattgtgaggcagtttgttttgattttgactctctgtgttccaatttttgttcaactttaggtttctaaagatcttgttcattttatttccatttgggttattgattaatccgcatggattgtttaatgctcagatatcatacttggttatgcgtaatgaattattgaagatctcaattttctccctca

SEQ ID NO: 4345 - DNA, 844 bp, Raphanus sativus
gggttacaaaaaataaaagctgaagattcatcacttctcttggcaggaagcttcgaccgcggcggcacgatgggaattgatttgatcgcaggaggtaagagcaagaagaccaaaaggacagctcccaagtccgacgatgtctacctcaagcttaccgtcaagctttacaggtttctggtaaggagaacacagagcaagttcaatgcagtgatcttgaagaggcttttcatgagcaaagtcaacaaagctcctctttctctttccaggctcgtcgaattcatgaccggcaaggaagacaagattgctgttttggttggaaccataaccgatgatttgagggtacacgagatcccagctatcaaggttactgccttgaggttcactgagagagccagagctcgcattgagaaagctggtggtgaatgcttaacctttgaccagcttgctctcagagctcctttgggacagaacactgttcttcttagaggacctaagaactcacgtgaggctgtgaagcactttggtcctgctcctggtgtgccacacagtcactccaagccgtatgttcggtccaagggaaggaaattcgagaaggccagaggaaagaggaagagccgtggattcaaggtttaaggaccattgtcatcgtctttttaacttgcttctcgacttttgttatagaatcgtgtttttttgtgtttgcctgtttcagacaatattttaagattgtttcgacttgattaactttgttattattgcacgttgtgctgcaccatggatacaaccaaaaatgaccttagtgttacttggtttatacgacacacgaacattttgatttgcagga

SEQ ID NO: 4346 - DNA, 874 bp, Raphanus sativus
  misc_feature (55)..(55): n is a, c, g, or t
  misc_feature (59)..(59): n is a, c, g, or t
atagatagattcatcatcatttgtcttgcgcaagcttcgacggcggcggcaccancacnacatccccggacgctacaatgggaattgatttgatcgcaggaggtaagagcaagaagaccaaaaggacagctccaaagtcggacgatgtctacctcaagcttaccgtcaagctttaccggtttctggtaaggagaacacagagcaagttcaatgcagtgatcttgaagaggcttttcatgagcaaagtcaacaaagctcccctttctctatccaggctcgtcgagttcatgaccggcaaggaagataagattgctgtcttggttggaaccatcaccgatgatttgagggtacacgagatcccagctatcaaagttactgccttgaggttcacagagagagccagagctcggattgagaaagctggtggtgaatgcttgacctttgaccagcttgctctcagagctcctttgggacagaacactgttcttcttagaggacctaagaactcacgtgaagccgtgaagcattttggtcctgctcctggtgtgccacacagtcactccaagccgtatgttcggtccaagggaaggaagttcgagaaggccagaggaaagaggaagagccgtggattcaaggtttaagaaacatcgtctctgcgtgcgtcttcgaacttgattctcgagttttgttacttctttaattaaatctatctctattcgtaaccggatctttgtttagtgaattgttgcttctcatcgcttgtttcagacaatagatttaagtttgttttctactggaatcatcgtgagttgattactcatttgtgtgcacttacatacatttaagcttttataatatgaaagtcttattcata

SEQ ID NO: 4347 - DNA, 840 bp, Raphanus sativus
ggactataaactgtaataaaaccgatattcaatacatctcttgcagcggcggcggcggcaccacatccccggaggctacaatgggtatcgatttgatcgctggaggtaagagcaagaagaccaaaaggacagctcctaagtctgacgatgtctacctcaagctcactgtcaagctttaccggtttctggtgaggagaacccagagcaagttcaatgcagtgatcttgaagaggcttttcatgagcaaagtcaacaaagctcctctttctctatctagactcgtcgagttcatggctggcaaggaagataagattgctgtcttggttggaaccatcactgatgatttgagagtacacgagattccagctatcaaagtcactgccttgaggttcacggagagagccagagctcgcattgagaaagctggtggtgaatgcttaacatttgaccagcttgctctcagagctcctctgggacagaacacggttcttcttagaggacctaagaactcacgtgaggctgtgaagcattttggtcccgcacctggtgtgccacacagtcactcgaagccatatgttcggtccaagggaaggaagttcgagaaggccagaggaaagaggaagagccgtggattcaaggtttaagaacattgtctgtgtcattgaacttgattctattgtgttgttgcttcttcatctctttcataatcggatttttgttagagaattgtgttttttttttcgtgccttgtttcagacaatatctaaagtttgtgactattgtgagcttattacaacactgagctttattatatttatcaaacttcacattctttcccca

SEQ ID NO: 4348 - DNA, 771 bp, Raphanus sativus
gcggcggcaccacatccccggaggctacaatgggtatcgatttgatcgctggaggtaagagcaagaagaccaaaaggacagctcctaagtctgacgatgtctacctcaagctcactgtcaagctttaccggtttctggtgaggagaactcagagcaagttcaatgcagtgatcttgaagaggcttttcatgagcaaagtcaacaaagctcctctttctctatctagactcgtcgagttcatggctggcaaggaagataagattgctgtcttggttggaaccatcaccgatgatttgagagtacacgagatcccagctatcaaggttacagcgttgaggttcacagagagagccagagctcgcattgagaaagctggtggtgaatgcttaacctttgaccagcttgctctcagagctcctttgggacagaacactgttcttcttagaggacctaagaactcacgtgaggctgttaagcattttggtcccgcacctggtgtgccacacagtcactcgaagccgtatgttcggtccaagggaaggaagttcgagaaggccagaggaaagaggaagagccgtggtttcaaggtttaagaacattgtctgtgtcgttgaacttgatcctattgtgttgttgcttcttcgtctctttcataatcggatttttgttagacaattgtgtttttttcagacaatatctaaagtttgtgactactgttgagcttattccaacactgagctttactatgtttatcaaacttcacattctttc

SEQ ID NO: 4349 - DNA, 810 bp, Carthamus tinctorius
cctagctttcctttccccctttttcctcccttgggcacaccatttctctttgcaggtaccaccaaccgccgtccccatgggtatagatctcgttgcaggtggaaagagcaagaagaccaaaagaaccgcccctagatccgatgatatctacctcaagctcctcgtgaagctttatcggtttttggtgaggaggactggaagcaacttcaatgccgtgatattgaagaggctcttcatgagcaaaatcaacaagcctccgatttctctatctcggttggttcgttacatgtctggcaaggatgacaagattgctgtgattgttggcacagttactgatgacgtacgtgttcatgagatcccttgtatgaaggttactgctttgaggtttaccgagactgcaagggcaaggattgagaaggctggtggtgaatgcttgacatttgaccaactggctcttagagctcctcttggacagaacactgttctacttagaggtccaaagaattgccgtgaagcagtgcgacactttggaaaggctccgggtgtgccacacagccacaccaagccatatgtgcgagccaagggaaggaaattcgagaaggctagaggtagaagaaacagccgaggctttaggaactaagctccactcgaggtgggaccttttcaattcagccctatactccgcctatcttcatatttggttatctattagacatacttgttgtgatgaaattttttgttagccatctttttttggtattgttggatgttttgagccttaacatttccattcggattttgattaaatca

SEQ ID NO: 4350 - DNA, 974 bp, Glycine max
gaggccaggaattatgcaaagcaaaaggagtcaaaaaccctagtttccttgatatctaataaattgcaggtgtagcagcagagagtgcggtaggctcttccgagacccgaagcagccatggggatcgatctcaaggccggaggtaagagcaaaaagaccaaaagaacagcacccaagtccaatgatatctatctcaagctcttggtcaagctttatcgcttccttgttcggagaactggcagcaacttcaatgctgttatacttaagagattgttcatgagcaaggttaacaaacccccattgtctttgtcaaggttgattaagtatacgaaggggaaggaagataagattgcagtggtggtggggtctataaccgatgatattcgtgtttatgaagttccaccattgaaagttacagcactcaggtttacagagactgcccgtgcaagaattgagaaggcaggcggtgaatgcttgacgtttgatcagttggctctcagggctcctctgggacagaacacggtccttcttagaggcccaaagaatgctcgcgaagctgtgaagcactttggtcctgctcctggtgtccctcacagccacaccaagccttatgttcgagcaaagggaaggaagtttgagagggctagaggaaggaggaacagccgaggatttagggtttgatgtgatagataatacgctgtattattactctggaattcaaatttttcttatatgttagactgttgaggcagttttcttgttatttgtattctgataatgattttctgtacgaagttttcatttttggctcctttattctccaatgaagtgtctttttgtcaagctttaactcagttttgatgctagaaaatggatagtcgttagttatgtgatgcatgcttgttctttaagaatcagacatgaaccttgtcttctacttacctattaacaatatgctggcatggctaaagtgt

SEQ ID NO: 4351 - DNA, 918 bp, Glycine max
atctcataaattgcaggtgcagcagcagagagtgcggtaggctcatccgagaccggaagcagcaatggggatcgatctcaaggccggaggtaaaagcaaaaaaaccaaaagaacagcacccaagtccaatgatatctatcttaagctcttggtcaagctttatcgcttccttgttcggagaactggcagcaaattcaatgccgttatactcaagagattgttcatgagcaaggttaacaagcccccattgtctttgtcaaggttgattaagtataccaaggggaaggaagataagattgctgtggtggtgggcaatataaccgatgatattcgtgtttatgaagttccagccttaaaggtcacagcactcaggtttacagagactgctcgggcaagaattgagaaggcaggtggtgaatgcttgacgtttgatcagttggctctcagggctcctctgggacagaacacggtccttcttagaggcccaaagaatgctcgtgaagctgtgaagcactttggtcctgctcctggtgtgcctcacagccacaccaagccttatgttcgagcaaagggaaggaagtttgagagggctagaggaaggaggaacagcagaggatttagggtttgatgtgataaatagtgttctattctctgaaattcaaaatttccttatatcttagacggttgaagcagttttcttgttatttgtgttctgataatatgattttcagtttgaagttgtcattcttggctcctttattctcccagtgaagtaagtgtctgtttgtgctttaactcagttttgatgctagagaattgataatcgttaattacgtgatgcatgcttgttctttatgaattagacatgaaccttgtcttctacttaatacctattaacttgcctggctaaagtgtacc

SEQ ID NO: 4352 - DNA, 865 bp, Nicotiana tabacum
gcgggggctagtactcggccatatctttctccagcagcgagctcctcaccttggcgttctctgacggaatcaaatggggatagatctgaaagcggggggtaagagcaagaagacgaagcgcacagcgcctaagtctgacgatgtttacttgaaactccttgtcaagctttaccgatttttggtgcggaggaccggaagcaagttcaatgctgtgattcttaagcggctatttatgagcaagacaaacaaaccacctctttccctttcgaggttgatatcttatgccaaaggaaaggagggtaagattgccgtcattgttggtaccattacggatgatgttagggcttatgatgttccgacactgaaggtgtgtgctttaaggttcacaaaaactgcaagggcaaggattgagaaggctggtggagagtgtttgacatttgatcagcttgctcttagggccccacttggtcagaacacgcttctcctcagaggtcctaagaatgctcgtgaagcggtgaagcactttggtccagcacctggtgttccacacagccacaccaaaccatatgtgcgttcaaagggaagaaagtttgagagggcacgtggaagaagaaagagcaggggttacaaagtttaagttgattttcatttgtgctgtcaggttggcttaagcaattattgcagcaatagagattttgaaaactagtatccagttttggaatttgcttatgtttacttatttttttaggatattttaatcctatgaacatccaattttgctgcttcaaggtggatttagggtgtgatttgaaaatcgaactcgactgcttttggttaatgcctactagtcttgatttgagttgtc

SEQ ID NO: 4353 - DNA, 817 bp, Nicotiana tabacum
ccggggatattatattgagtgagaggcgccgaaccctagaatcacagctcaaacaccccaatagaagcaatgggtatcgatctgaaggctggaggtaagaacaagaagacaaagcgcacagctcctaagtctgatgatgtttacttgaaactcctcgtcaagctataccgatttttggtgcggaggacgggaagcaagttcaacacagtgattcttaagcggctctttatgagcaaaaccaataaacctcccctttcactctcgaggttgatatcttataccaaaggaaaggaggataagattgctgtgattgtgggctctgttaccgatgatgttagggcctatgaagttccaacattgatggtatgtgctttgagattcacaaagactgcaagggcaaggattgagaaagctggtggtgagtgtttgacatttgatcagctggctcttagagctccacttggtcaaaacacggttcttctaagaggccctaagaatgctcgtgaagcagtgaggcactttggtccagctcctggagttccacacagccacacgaaaccgtatgtgcgttccaagggaaggaagtttgagagggccagaggaagaagaaagagcaggggttacaaggtttaagttgaattccattatcttaggtttgtttctatcattgtatacaagttttggagactacaatgcacttgtttagttggttatgctttttcaaattttgtttagaatatttgaatatcaacttgaaattaattttttcaaaattcaatatagtgttagtatgatatctttttattcatagattgct

SEQ ID NO: 4354 - DNA, 783 bp, Triphysaria pusilla
  misc_feature (85)..(85): n is a, c, g, or t
  misc_feature (754)..(754): n is a, c, g, or t
caagagcaggatcagaaagcggctggagcagcaccagacaccggagccatgggtatcgacttagtcgccggaggtaagaacaagnagaccaagcgcaccgcccctaaatccaatgatatttacctcaagctcatcgtgaagctttaccggtttctggtgaggagaaccgggagcagctttaatgctgtgatcctgaagaggttgtttatgagcaaggttaacaggccaccgctctctctctctcgcctcgttgctcatatgaagggcaaggataaccaaattgctgtgttggttggaactgttacggatgatattaggcttcaagaagaagttcctgctataaaggttactgctctgagattcaccgagacagctagggcaaggattgagaaggctggtggtgaatgtttgactttcgatcagcttgctctaagggctccacttggtcagaatacggtactcttgagaggttcaaggaaggctcgtgaagctgtgaagcactttggtccagctcctggtgttccacacagccacaccaagccttatgttcgagccaagggcaggaagtttgagaaggccagaggaaagagaaacagcaagggcttcagagtttaagtttaacctgtatcttgttttttttgaatttcgattgcagattttgtgtttgttggataccatatgagatatctatatccttttaatgatttgtggctttattcgtgctctttttgtttcaaagttgttggatattcantttgaatgtagtgtccttttactttctgg

SEQ ID NO: 4355 - DNA, 607 bp, Gerbera hybrid cultivar
cagccgtcgccgccatgggtatagatctcgtcgccggtggaaaaagcaagagaaccaaaagaaccgctcctagatctgatgatatctacctcaagctcctcgtcaagctttataggtttttggtgaggaggacaggaagcaacttcagtgcggtagtactgaagaggctttttatgagcaaagtcaacaaacctccaatttctctctctcgcttgattcgttacatgtctggcaaggaggacaagattgcagtgattgttgggactgtcacggatgatgttagggttcatgaaatcccttgtatgaaggttactgctctgaggtttactgagactgcaagggctaggattgagaaggctggtggagaatgcttgacttttgaccagctggctctacgtgctcctcttgggcagaacacggttctacttagaggtccaaagaactctcgtgaagcagtgaggcacttcgggcccgcccctggtgtgccacacagtcacaccaagccctatgtgcgttccaagggaaggaaattcgagaaggcaagaggaagaagaaatagccgtggctttagaaactaagtgttcgttaatggtggtcaggtgggtcc

SEQ ID NO: 4356 - DNA, 964 bp, Lotus japonicus
aaaaccctagccttcttctctcgctcgcaagcagcagcaggaagaagaagcacctccatctgcaatggggatcgatttgaaagcaggaggcaagtccaagaagacaaagcgaaccgccccaaaatccaatgatatttacctcaagcttctcgtcaagctctaccgttttctggttcggaggactgggagtaacttcaactctgttatcctcaagcgtcttttcatgagcaaagtcaacaaggcacctctttcactctctcggttgattcgttacaccaagggaaaggagggtaagattgctgtagttgttggggctgtcaccgatgatattcgtgtctatgaagtacctgcactgaaggttgctgctctaaggttcaccgaaactgccagagctagaattgagaaggccggtggtgagtgcctcaccttcgatcagctcgctcttatagctcctcttggccagaacacggttcttcttagaggtcctaagaatgctcgagaggctgtcaagcactttggaccagctcctggcgtgccacatagtcacaccaagccatatgtccgttctaatggaagaaaatttgagaaggcccgaggaaaaaggaatagcaaaggctttagagtttgagttatggaactcaaacatgaagggccattccttttatcttgtgatctttttgtattttcccccctttgtgctgttggaacaatttattttgcattctatatctagggaaaaaagaatgaagcgccctctgcgaacaattttgttttagcattctttctactgaacttctgagaggaattaatgagtagcttttgttctagtaaggagcaattgtacgaccatttctattgtttttagtcgttgaaccctccctgttgggctgtttgattgcatagagagattcgttgcgctgtgatcaatttacctgtcggaattgatatatttaaattgttaaaa

SEQ ID NO: 4357 - DNA, 838 bp, Pisum sativum
tgcagcaaggtgtagcagtcgtgttgttgttgaagacccgaagcagccatgggtatcgatctgaaggcaggaggtaagaacaagaagtccaagaggacagcaccaaaatccaatgatatctacctcaagctcttggtcaagctttacaggttccttgttaggagaactggcagcaacttcaatgctgttatactcaagaggttgttcatgagcaaggttaacaagcctccactatctttgtcaaggttgatcaagtataccaagggaaaggaaggtaaacttgctgtggttgtcggtactgtaactgatgatatccgggtgtatgatgttccagccatcaaagttactgcacttaggtttacagagactgcaagggcaagaattgaaaaggctggtggagaatgcttgacatttgatcagttgcctcttagggcccctctgggacaaaacacggtccttcttagaggtccaaagaatgctcgtgaagctgttaagcactttggtcgtgctcctggtgttccacacagccacaccaaaccttatgtgagagcaaagggaaggaagtttgagaaggccagaggaaagagaaacagtcgaggatttagagtttgatgtgatagtattttttttctggtattagtatctgaaattctgaatttttcctacatcctaaacactgtttcattttatgtttgataatgtttttcagaatgtggaagttttgttatgcgtaatattttggtagggctacatttgtgttttgttctgaacaaatggataatttgttaattaggtgatgcatgcttgtgttataaacctaccaggaatttgttgtttt

SEQ ID NO: 4358 - DNA, 598 bp, Malus domestica
agcaaccgagcttcagcaccagcagcaacaatggggatcgatctcgtcgcaggaggtaagagcaagaagacgaagcgcactgcgcccaagtccgatgacatctatctcaagcttctcgtcaagctataccgttttcttgtcaggagaactggaagcaagttcaatgcagtcattctcaaacgtttgttcatgagcaaagtcaacaaggcaccactttctctctcaaggttgatcaagtatatgcaaggaaaggacagcaagattgctgtggttgtggggaccgtgaccgatgatattagggtctatgaggttcctcaattgaaggttacagcactgaggttcactgagactgcaagggccaggattgagaaggcaggaggagagtgcttggcattcgatcaacttgctttgagagcaccattgggtcagaacgtggttctcctcagaggtccaaagaattcccgtgaagcagtgaagcacttcggtccagctcctggtgtaccacacagccacaccaaaccttatgtgcggtccaagggaaggaagtttgagaaggctagaggaaagaggaacagcaagggctttagagtttaacccg

SEQ ID NO: 4359 - DNA, 797 bp, Arabidopsis thaliana
tcagtattttcatgtagaaggtcggcggttccatcaccacaacgccggacgacaatgggtattgatctgatcgccggaggtaagagtaagaagaccaaaaggacagctccaaagtctgatgatgtctacctcaagcttactgtcaagctttaccggtttctggtaaggagaactaatagcaagttcaatggtgtgatattgaagaggcttttcatgagcaaagtcaacaaagctcctctttctctatctaggcttgtggagttcatgactggcaaggaagataagattgccgtcttggttggaactataactgatgatttgagggtacacgagattccagccatgaaagtgactgccttgaggttcacagagagagcaagggctcgcattgagaaagctggaggtgaatgcttaacctttgaccagctcgctctcagagctccattgggccagaacacggttcttcttagaggacctaagaattcacgtgaagcagtgaagcatttcggacctgctcctggtgtgccacacagtcactccaagccatatgttcgggccaagggaaggaagttcgagaaggccagaggaaagaggaagagtcgtggattcaaggtttaagaaagttgttgccgccattggacttgattctggagtactgttgcttcttggttgcttttgtaatcggatttttgttagggaactctgttttttctttcctctttcagacatgctactaagtttgcttctactggattcatcgtgtggttattacacttgcagctttactatgttaaact

SEQ ID NO: 4360 - DNA, 798 bp, Brassica juncea
  misc_feature (272)..(272): n is a, c, g, or t
  misc_feature (603)..(603): n is a, c, g, or t
  misc_feature (736)..(736): n is a, c, g, or t
  misc_feature (751)..(751): n is a, c, g, or t
  misc_feature (781)..(781): n is a, c, g, or t
gatataaaacctaatttcatcacttctctagcagaagcttcgaacgcggcggcaccacatccaccggccactacaatgggtatcgatttgatcgcaggaggtaagagcaagaagaccaaaaggacagctcctaagtccgacgatgtctacctcaagctcactgtcaagctttaccggtttctggtgaggagaactcagagcaagttcaatgcagtgatcttgaagaggcttttcatgagcaaagtcaacaaagctcctctctctctatctangctcgtcgagttcatgactggcaaggaagataagattgctgtcttggttggaactataaccgatgatctgagagtacacgagattccagctatcaaagttacagccttgaggttcacagagagagccagagctcgcattgagaaagctggtggtgaatgcttaacctttgaccagcttgctctcagagctccactgggacagaacactgttcttcttagaggacctaagaactcacgtgaggctgttaagcattttggtcctgctcctggtgtgccacacagtcactcgaagccatatgttcggtccaagggaaggaagttcgagaaggcnagaggaaagaggaagagccgtggtttcaaggtttaagaacattgtctgtgtcattgaacttgattatgttgtggtgttgcttcttaatctctttcttaatcggatttttgttgagaattgtgctttttggtgnttgtttcagacaatntctaaagtttttggtgcttgtttatcaaanttcacattctttcaaat

SEQ ID NO: 4361 - DNA, 635 bp, Brassica oleracea
gaagcttcgaccgcggcggcaccacatctcccggacgctacaatgggtatcgatttgatcgctggaggtaagagcaagaagaccaaaaggacagctcccaagtccgacgatgtctatctcaagctcactgtcaagctttacaggtttctggtgaggagaactcagagcaagttcaatgcagtgatcctaaagaggcttttcatgagcaaagtcaacaaagctcctctttctctatctagactcgtcgagttcatgactggcaaggaagataagattgctgtcttggttggaactataaccgatgatttgagggtacacgagattccagctatcaaagttactgccttgaggttcacggagagagccagagctcgtattgagaaagctggtggtgaatgcttgacctttgaccagcttgctctcagagctcctttgggacagaacacggttcttcttagaggacctaagaactcacgtgaggctgtgaagcattttggtcgcgctcctggtgttccacacagtcactcgaagccatatgttcggtccaagggaaggaagttcgagaaggccagaggaaagaggaagagccgtggtttcaaggtttaagaacattgtctgtgtcactgaacttgatt

SEQ ID NO: 4362 - DNA, 710 bp, Brassica rapa
ggcttcgacgcggcggcaccacatcaccggacgctacaatgggtatcgatttgatcgctggaggtaagagcaagaagaccaaaaggacagctcctaagtccgacgatgtctacctcaagcttaccgtcaagctttacaggtttctggtgaggaggactcagagcaagttcaatgcagtgatcctaaagaggcttttcatgagcaaagtcaacaaagctcctgtttctctatctaggctcgtcgagttcatgactggcaaggaagataagattgctgtcttggttggaaccatcaccgatgatttgagggtacacgagattccagctatcaaagtcactgccttgaggttcacggaaagagccagagctcgtattgagaaagctggtggtgaatgcttgacctttgaccagcttgctctcagagctcctttgggacagaacacggttcttcttagaggacctaagaactcacgtgaggctgtgaagcattttggtcctgctcctggtgtgccacacagtcactcgaagccatatgttcggtccaagggaaggaagttcgagaaggccagaggaaagaggaagagccgtggtttcaaggtttaagaacattgtctgtgtcactgaacttgattctgctgtgttgttgcttcttaatcactttcataatgggttctttgtagagaattgtgctttttggtgccttgtttcaga

SEQ ID NO: 4363 - DNA, 913 bp, Phaseolus coccineus
gagactcgccgttaagtctcagagacataaccattcataggtgtgtgctgttccaacacctaaagcagcaatggggattgatcttaaggctgggggtaagagcaaaaagacgaaaagaacagcacccaagtccaacgacatctacctcaaactacttgtcaagctttatcgctttcttgttcgaaggactggcagcaatttcaatgctgtgatactcaagcgcttgttcatgagcaaggtgaacaaacctccactttctttgtcgaggttgattaggtatacaaaggggaaggaagataaaattgctgttgtagtggggactataactgatgatatcagagtatatgaagttccgcaattgaagattacagcacttaagtttacagagagagcacgtgcaagaatagagaaggcaggcggtgaatgcttgacctttgatcagcttgcacttagggctcctttgggtcagaatacggtccttcttagaggccccaagaatgcccgggaagctgtgaagcactttggtcctgctcctggtgtgccacacagccattccaaaccctatgttcgatccaagggaagaaagtttgagaaggctagaggaaggagaaacagcagaggatttagagtttaagaaaatagctttctattttttttggtagtgttctgaaattcaacattttgtcataggcgctgggttggtgactttttcttctcatatttttgttcttacaagaattcaagtatggacatcgttcttggcccccttgtttttacattaacgtgtattaaaaacatatttgatgaattgtgaaaaaccctgtcatttatcgtgaccttttttccgtggcctgagtgggttagccttttttaatggtgcctccctctgtcactaccattttaataaacaata

SEQ ID NO: 4364 - DNA, 935 bp, Brassica napus
gactgtaaaaagaaaaaaaacaattgtttagcttattgggcatgtaaacttaagtccaaatattaaaacctatattgggcttagagttttgggcccatagtggaaatagaaaaccctacaaaatcaaagctgagtcgttacaaaagctagattcatcacttctcttgcagaagcttcgaccgcggcggcaccacatctcccggacgctacaatgggtatcgatttgatcgctggaggtaagagcaagaagaccaaaaggacagctcccaagtccgacgatgtctatctcaagctcactgtcaagctttacaggtttctggtgaggagaactcagagcaagttcaatgcagtgatcctaaagaggcttttcatgagcaaagtcaacaaagctcctctttctctatctagactcgtcgagttcatgactggcaaggaagataagattgctgtcttggttggaactataaccgatgatttgagggtacacgagattccagctatcaaagttactgccttgaggttcacggagagagccagagctcgtattgagaaagctggtggtgaatgcttgacctttgaccagcttgctctcagagctcctttgggacagaacacggttcttcttagaggacctaagaactcacgtgaggctgtgaagcattttggtcgcgctcctggtgttccacacagtcactcgaagccatatgttcggtccaagggaaggaagttcgagaaggccagaggaaagaggaagagccgtggtttcaaggtttaagaacattgtctgtgtcactgaacttgattctgttgtgttgttgcttcttaatcactttcgtaatcggatttttgttagagaattgtgctttttcgtgccttgtttcagacaatatctaaagtttgcgactactgtgagctttactgtgtttatcaaactt

SEQ ID NO: 4365 - DNA, 794 bp, Brassica napus
gaagcttcgaccgcggcggcaccacatctcccggacgctacaatgggtatcgatttgatcgctggaggtaagagcaagaagaccaaaaggacagctcccaagtccgacgatgtctatctcaagctcactgtcaagctttacaggtttctggtgaggagaactcagagcaagttcaatgcagtgatcctaaagaggcttttcatgagcaaagtcaacaaagctcctctttctctatctagactcgtcgagttcatgactggcaaggaagataagattgctgtcttggttggaactataaccgatgatttgagggtacacgagattccagctatcaaagttactgccttgaggttcacggagagagccagagctcgtattgagaaagctggtggtgaatgcttgacctttgaccagcttgctctcagagctcctttgggacagaacacggttcttcttagaggacctaagaactcacgtgaggctgtgaagcattttggtcgcgctcctggtgttccacacagtcactcgaagccatatgttcggtccaagggaaggaagttcgagaaggccagaggaaagaggaagagccgtggtttcaaggtttaagaacattgtctgtgtcactgaacttgattctgttgtgttgttgcttcttaatcactttcgtaatcggatttttgttagagaattgtgctttttcgtgccttgtttcagacaatatctaaagtttgcgactactgtgagctttactgtgtttatcaaacttcacattctttcctcaaaagttcttgacg

SEQ ID NO: 4366 - DNA, 872 bp, Castanea mollissima
gtttgttcctcacagcagtcggcgtatccacctcaacgacacagagagagctcttctagcaaaccctttaggctccaatggggattgatttagtcgcaggaggcaaggtcaagaagagcaagcgtacggctccaaagtccaatgatatataccttaaactcctcgtcaagctttaccggttccttgttcggagaactggcagcaatttcaatgcggtgattctcaagcgcttgttcatgagcaaagtaaacaagcctccactttcattgtctaagttgatccgatatatggaaggaaaggatggcaagattgctgtggttgtgggaactgtgactgatgatattcgggtttatgaagttcctgctttgaaggttacagcacttaggtttactgagactgcaagggccagaattgagaaggcaggcggtgagtgcttgacgtttgatcagctggcgctaagggctccattgggacagaacacgattcttcttagaggtccaaagaagggtcgtgaagcagtgaaacattttggtcccgctcctggtgtgccacacagccacaccaagccctatgtgcgagcaaagggaaggaagttcgagagggctagaggaaagaggaacagcaggggatttagagtttaagttgattttagtaattgttgagcaagaagtgtcatttctgactttgtcaatccaaagttttgctagactattaggtacttatggaggttatctgtcattcttattttgatatgcactttgggcaatgatcatttaatgtttgttacttaaaagacttgtttttacttttgttacaaaccggtttgtttaaaagtgtatctgggttcatctatgatattcaagttttgttaa

SEQ ID NO: 4367 - DNA, 902 bp, Gossypium hirsutum
ggggatctcaatgggaaagatttctaaaaccctaggtctctcacactaagttgctattaaggccattttccctcactaggcactgccttccccctcgtatcagcttcacaggccatgggtatcgacttggtcgccggcggcaagagcaagaagacgaagagaactgctcccaagtccgatgatatctacctcaaactcatcgtcaagctttaccgatttctggtaaggactggcagcaaattcaatgctgtgattttgaagcgtctttttatgtgcaaagtgaacaagcctcctctgcctctatccagattgattgaattcatgaagggcaaggaggataagattgcagtggtagttggaactgtcaccgatgacattcgtatatatgaagttcccgctctgaaggttactgcactaaggttcactaagacagcgagggcgagaattgacaaggctggtggggaatgtttaacatttgaccaacttgctcttcgagcacctcttggacagaacacggttctccttcgaggtccaaagaatgctcgtgaggctgtgaagcacttcggacctgctcctggtgtgccacacagccacaccaagccctatgtgcggtcaaaagcaaggaaatttgagagggctagaggaagaaggaacagcaaaggcttcagggtttgagattccaactgcactggaaaaaaaaaaaacttatcaacccatcatgataatgggaatgctcagttttgttttttttgctttccacctttcctgttctttttcttttccatgattgtaatttggaatcttttataatttgtttaacggaaaggattttagagtgactgaagaacgttgttggatgtctgtatttcttatatataaatcagaacagcattgagttccat

SEQ ID NO: 4368 - DNA, 683 bp, Adiantum capillus-veneris
gagggggttgcggcaggcggagcacctcgtcctctgcagcggtagtaggagcagccatgggtatcgacttgcctgccgggggacgcaataagaagacaaagcgcactgctcctaagagtgacaatgtctatctgaagcttattgtaaaactctacaggtttctcgttcgaaggacgggcagcccgtttaatgctgtggttttgaagcggctctttatgagcagaactaacaggccgcctctatctttatctcgtctcatacgttacatgaaggggaaggaggataagataggtgtagttgtgggaactgtgacggatgatgttagggtgtatgaagttccagcattgaaagtggccgcgctgcgctttacagagactgcccgtgcccggatcttgaaagctgggggagaatgtttcacatttgaccaacttgctttgaaggccccaactggttcaaatactatacttctgagaggtccaaagaatgctcgggaagctgtgaagcactttgggagagctccaggtgtaccgcatagtcacacaaagccttatgttcggtccaagggtcgcaagtttgagagagctcgtggtcgacgtaacagcagaggatacagagtttagttttgtagctttcggatacttttgcacagtattttatcaaacactgtgcttgtagttgggctt

SEQ ID NO: 4369 - DNA, 802 bp, Actinidia deliciosa
  misc_feature (238)..(238): n is a, c, g, or t
cattttggtaccaccagtaccaacagcagcagcagcagcagctatgggtatcgatctgaaagccggcggcaagagcaagaagaccaaacgcaccgcccccagatcccaagatatctacctcaagcttctcgtcaagctgtatagatttctggtaaggaggaccggaagcaagttcaatgcggtgatactgaagaggctgttcatgagcaaagtcaacaagcctcccatctctctctcncgcttgattcgcttcacgaagggaaaggagggtaagattgccgtgattgttgggaccattaccgatgacattagggtacatgaggttccttgtttgaaggtggctgcactgaggttcaccgagacagcgagagcaaggatcgagaaagcaggtggtgagtgcctgacatttgaccagttggctctcagagccccacttgggcagaacacggtactccttagaggaccaaagaatgctcgtgaggcagtgaaacactttggcaaggctcctggtgtgccgcacagccacactaagccttatgttcgatcaaagggaaggaagtttgagcgtgccagaggaagaagaaacagcagaggcttcagaaactgagttcttgcttatgctttcgatgcagacttatctattagattttaagcaaaagatttttaattccgccttttcgtattggggtggttccttttgtttttcgcattttccgcatttcagacacttgcaatctctgtagtggcttctcaacaatttccaatagctgtagttgtttggagcttgattttacttgtttct

SEQ ID NO: 4370 - DNA, 714 bp, Lotus japonicus
gggaagacccagagtctcagagctgcaatggggatcgatctcaaggctgggggtaagagcaagaagacaaaacgaatagcaccaaaatccaatgatatctacctcaagcttcttgtcaagctatatcgcttccttgtgcgaaggactggcagcaatttcaatgctgtgatactcaagcgattgtttatgagtaaagttaacaagcctccaatttctttgtcaagattgattaagtatgccaaagggaaggaggataaagttgttgttatagtggggactgtaaccgatgatattagagtttatgaagttccagccctaaaagttacagcacttaggttcacagagacagcaagagcaagaattgaaaaggcaggtggtgaatgcttgacattcgatcagcttgcactcagggctcctttgggtcagaacacggtccttcttagagggccaaagaatgctcgggaagctgtgaagcactttggtcctgctcctggtgtgccacacagccataccaagccttatgtaagatctaaggggaggaaatttgagatggctagaggaaagagaaacagcaaaggatttagggtttaagttgattatgttgtgccatttttgtgttattacttctaaaatccaactttttgctctataggcattgatgtattgatgacaattttttattatatctcacaaggatttttactatggaaaaaa

SEQ ID NO: 4371 - DNA, 692 bp, Lotus japonicus
gtgcaatggggatcgatctcaaggctgggggtaagagcaagaagacaaaacgaatagcaccaaaatccaatgatatctacctcaagcttcttgtcaagctatatcgcttccttgtgcgaaggactggcagcaatttcaatgctgtgatactcaagcgattgtttatgagtaaagttaacaagcctccaatttctttgtcaagattgattaagtatgccaaagggaaggaggataaagttgttgttatagtggggactgtaaccgatgatattagagtttatgaagttccagccctaaaagttacagcacttaggttcacagagacagcaagagcaagaattgaaaaggcaggtggtgaatgcttgacattcgatcagcttgcactcagggctcctttgggtcagaacacggtccttcttagagggccaaagaatgctcgggaagctgtgaagcactttggtcctgctcctggtgtgccacacagccataccaagccttatgtaagatctaaggggaggaaatttgagatggctagaggaaagagaaacagcaaaggatttagggtttaagttgattatgttgtgccatttttgtgttattacttctaaaatccaactttttgctctataggcattgatgtattgatgacaattttttattatatctcacaaggatttttactatggaaaaaa

SEQ ID NO: 4372 - DNA, 865 bp, Quercus alba
gtttttcctcacagcagtcggcgtatccacctcaacaacgcagagagagctcttctagcaaaccctttagctccaatggggattgatttagtcgcaggaggcaaggtcaagaagagcaagcgtacggctccaaagtccaatgatatataccttaaactcctcgtcaagctttaccggttccttgttcggagaactggcagcaatttcaatgcggtgattctcaagcgcttgttcatgagcaaagtaaacaagcctccactttcattgtctaagttgatccgatatatggaaggaaaggatggtaagattgctgtggttgtggggactgtgactgatgatattcgggtttatgaagttcctgctttgaaggttacagcacttaggtttactgagactgcaagggccaggattgagaaggcaggcggtgagtgcttgacgtttgatcagctggcgctaagggctccattgggacagaacacgattcttcttagaggtccaaagaagggtcgtgaagcagtgaaacattttggtcccgctcctggtgtgccacacagccacaccaagccctatgtgcgagcaaagggaaggaagtttgagagggctagaggaaagaggaacagcaggggatttcgagtttaagttgattttagtaattgttgagcaagaagtgtcatttctgactttgtcaatccaaagttttgctagactattaggtacttatggaggttatttgtcattcttattttgatatgcactctgggcaatgatcatttaatgtttgttacttaagagacttgtttttccttttgttacaaaccggtttgtttaaaagtgtatctgggttcatctatgatattcaagtttt

SEQ ID NO: 4373 - DNA, 999 bp, Pinus taeda
cgaggccttaggaggaacaggaaggccgaggattcgatttcagcagcggcaacgatgggtatcgatttaattgccggtgggaagagcaagaagactaagcgtacagctcccaagagccaggatatttacctcaagctccttgtcaagctataccgttttttggtgaggagaaccaatagcagcttcaatgcagtgattttaaagaggctgttcatgagcaaaacgaacaagccaccgctatctctttctcgcctagttcgttacatgcaggggaaggatgacaagattgcagtggttgtggggaccatcacagatgataataggatttatgagctgcctcctgtgaaggtaactgctcttagattcacagagacagcgagagctcgaattttgaaagcaggaggcgagtgcttaaccttcgatcagcttgcacttcgtgcaccacttggacagaacacagtcttgttgcgtggccccaagagccatcgtgaggcggtcaagcactttggaagggcaccaggtgttccacacagccacactaaaccatatgttcgatccaagggtaggaaatttgagatggctcgtggtaggagaaacagtcgtggcttcaaggtctagagaaacaaggaatttatggtgatttttagtcttttcagtgagctttgcggatttcattagttctgctattatgttgccgcaaattgtaagcagcaactctagaatatagatgtttaatgttttgtttaaaacattctcagattacatggaaaaccattgggatgagatgtctgttggtttgccatcagagcttctcttcctataaaagggagaactgtcagttctgcaacttttctcttactatgaaatgagtaacttagtttttagactttggacgcttccttgacttcatgtgaaaaggggtcaccagttttacagtgtttgagtcgtatctaaaggattttttgagactataatgatatctatttttatgatgttaat

SEQ ID NO: 4374 - DNA, 793 bp, Raphanus sativus
gcggcggcggcaccacatccccggaggctacaatgggtatcgatttgatcgctggaggtaagagcaagaagaccaaaaggacagctcctaagtccgatgatgtctacctcaagcttattgtcaagctttaccggtttctggtgagaagaactcagagcaagttcgacgcagtgatcttgaagaggcttttcatgagtaaagtcaacaaagctcctctttctctgtctagactcgtcgagttcatgaccggcaaggaagataagattgctgtcttggttggaaccatcaccgatgatttgagagtacatgagatcccagctatcaaagttacagccttgaggttcacagagagagccagagctcgcattgagaaagctggtggtgaatgcttaacctttgaccagcttgctctcagagctcctttgggacagaacactgttcttcttagaggacctaagaactcacgtgaggctgtgaagcattttggtccagcacctggtgtgccacacagtcactccaagccatatgttcggtccaagggaaggaagttcgagaaagccagaggaaagaggaagagccgtggattcaaggtttaagaacattgtctgtgtcattgaacttgatcctattgtgttgttgcttcttcatctctttcataatcggatttttgttagagaattgtgtttttttttcagtgccttgtttcagacaatatctaaagtttgtgactactgttgagcttattacaatactgagctttactatgtttatcaagcttcacattctttcccca

SEQ ID NO: 4375 - DNA, 758 bp, Senecio madagascariensis
cttcgtcatcatgggtattgatcttgttgccggtggaaagagcaaaagaaccaaaagaacagcaccaagatccgatgatatctaccttaaactcattgtcaagctataccgttttctggtaagaaggactggaagcagcttcaatgctgtcatcttgaagaggctttttatgagcaaggtcaacaggccaccaatctcgctctctcgtcttgttcgttacatgtctgctaaggaggacaagattgctgtgattgttggaacggttactgacgatgtgagggttcatgaaattccttgtatgaaagttactgcattgaggtttacagagactgctagggccagaattgaaaaggctggtggagagtgtttgacctttgatcagctcgctcttcgtgctcctcttggacagaacactgttcttcttagaggtccaaagaattctcgtgaagcagtgaggcatttcggtaaggctcctggtgtaccacacagtcacaccaagccctatgttagatcaaagggaagaaagtttgagaaggctagaggtagaagaaacagcaggggatttagaaactaatctatcatcattattttccatgaaaccgtttcaaagttgtatttcccggatttcaaatattctgttttttataaaacttttagctcttcttgtttgcatacttgctatgatgaaaattttgttaacatctgtcatttcttttgagaaatgaaattcgagttttttgaattgtttcctctttatt

SEQ ID NO: 4376 - DNA, 855 bp, Glycine max
aaatttgaggtaaagctttgataggagtgtgctgttccaagtcccatagcagcgatgggaatcgatcttaaggctgggggtaagagcaaaaagaccaaaagaacagcaccaaaatccaatgacatctacctcaaattacttgtcaagctttatcggttccttgttcgaaggactggcagcaatttcaatgctgttatactcaagcgcttgttcatgagcaaggttaacaagcctccaatttctttgtcaaggttaattaagtatacaaaggggaaggaggataaaattgctgtaatagtggggactgtaactgatgatatcagagtatatgaagttccagcattgaaaattacagcactcaagtttactgagagagcacgtgcaagaatagaaaaggctggtggtgaatgcttgacatttgatgagcttgcccttagggctcctttgggacagaatacggtccttcttagaggccccaagaatgctcgggaagctgtgaaacactttggtcctgctcctggtgtgccacacagccataccaagccctatgtacgagcaaagggaagaaagttcgagagggctagaggaaggaggaacagcagaggatttagagtttaagaaatataatataactttgttctattttttttttacaattgttcacttctgaaattaaactgtttgctctaggcgtcggtgacagtttttatgatatttctgttctgataacatatcgtggctcccatgttttacattgacgtgtattacaaaaaactagcatttgattttttgattccccttattgactattgagtggccactctttataatgttgcactccctgctccttttcaa

SEQ ID NO: 4377 - DNA, 925 bp, Glycine max
gaggtatagcattgacagaagtgtggtgctcgaagaagtcccattcattgcactgatagcagcgatggggatcgatcttaaggctgggggtaagagcaaaaagaccaaaagaacagcaccaaagtccaatgacatctacctcaaattacttgtcaagctttatcgattccttgttcgaaggacagacagcaatttcaatgctgtgatactcaagcgcttgttcatgagcaaggttaacaagcctccaatttctttgtcaaggttaattaagtatacgaaggggaaggaggataaaattgctgtagtagtggggactgtaactgatgatatcagagtatatgaagttccagcattgaaaattacagcactcaagtttacagagagagcacgtgcaagaatagaaaaggctggcggtgaatgcttgacatttgatcagcttgcccttagggctcctttgggacagaatacggtccttcttagaggccccaagaatgctcgggaagctgtgaaacactttggtcctgctcctggtgtgccacacagccataccaagccctatgtacgagcaaagggaaggaagttcgagagggctagaggaaggaggaacagcagaggatttagagtttaagaagatagcttttctaattttttttataagtgttcttctgaaattcaactttttgttataggctctggtgactgtttttctcatatttttctgttacaagacatcgtgagtcgttttacattgacgtgtactaaaaaaactagcattaggttttgattccccctattgaaaggctagtcattttttcgtgatctgcttgtcctccgattgattggctactctttataatgttgcaccccctgccctatctctttccaaaattctatttatatgtatttagtaagctatagattaatc

SEQ ID NO: 4378 - DNA, 1234 bp, Picea glauca
aagtcacctttacacttcatttaatttgatttgcattggcatccaaattaaaacttagagattttgaacttttacttatgcaacttaatagttttgtcaaaaccctaaacctgcacacatcgctccctatttattttcctcttttgttcttgttcagtgttcgtgaggccataggaggaacaggagggccgagagttcagcgacaatgggtatcgacttagttgccggtggaaagagcaagaagaccaagcgcactgctcccaagagcgaggatatttacctcaagctcctcgtcaagttgtaccggtttttggtgaggagaactagtagcagcttcaatgcagtgattttgaagaggctgttcatgagcaaaaccaacaagccaccgttatcgctttctcgtttggctcgttacatgcaggggaaggacgacaagattgcagtggttgtgggcaccattacagatgataatagggtttatgaactgcctcctgtgaaggtaactgctcttagatttacagagacagcgagagctcgaattttgaaagcaggaggggaatgcttaactttcgatcagcttgcactgcgtgcacctcttggacagaacacggtcttgttgcgtggccccaagagccatcgtgaggctgttaagcactttggaagggcaccaggtgttccacacagccacactaaaccatatgttcgatccaagggtaggaaatatgagatggctcgtggtaggagaaatagtcgtggcttcaaggtctagagaatcaaaggactttatggtgcttttagtctttctagtgagcttttgcggatttcattagttttgctattctgttgctggcaattgtaagcggcaactctagaatctagatgtttaatgttttgtttaaaacaatctcagattacatggcaaaccagtgggatgagatgtctgttgctttgctatcagagcttctcttcctataaaagggaggactgtcagagttttacaacttttttcttactatgaaatgagtactgaattttacaacttttgacgctgccttaactttctgtgaagggtgggtcaccggttttacaatgagtcacacctctaaagggttttttgagaccatttaatgatagctattttttgatacaatgggttgaggcttttctctcatgtccaggaaatctgcagtgttcattttattttactgatttcattagatttatcacttttgga

SEQ ID NO: 4379 - DNA, 796 bp, Euphorbia esula
  misc_feature (183)..(183): n is a, c, g, or t
ggaacatttgcctcacagcacttccgccgagcatcagcaagaacagcaatgggtatcgatttgaaggccggaggtaagagcaagaagactaagcgcactgagcctaagtccgatgatatctacctcaagcttctcgtcaagttgtaccgatttttggtgaggaggactggtagcaaattcaangcggttatcttgaagaggctctttatgagcaagattaacaagaccccgctatctctctctcgtttgattaagtacatggagggcaaggatggtaagattgctgtggttgttggtaccataactgatgacattagggtttatgaagtcccggctttgaaggtcactgcactaaggtttacagagacagcaagggcaaggattgagaaggctggtggagaatgcttgacctttgatcagcttgctcttagagctcctcttggtcaaaatacgattctcttaaggggtcccaagaattctcgtgaagcagtgaagcactttggacctgcacctggtgtgccacacagtcatacaaaaccatatgtgcgagctaagggtaggaaattcgagaaggctaggggtaaaagaaacagcagaggctttagagtgtaagcctcatctggtttgttccgaaaagacagatcattgcaccaaattggtttgtgttttatttttcttttcctttgcggtaatatcaaacagcttctttgcagtagcaggttaaaatctgtggtttaattttgtaatttttgtttcgacactagttttttttgtttcagagtgaggattttaatgc

SEQ ID NO: 4380 - DNA, 973 bp, Helianthus annuus
  misc_feature (5)..(6): n is a, c, g, or t
  misc_feature (870)..(870): n is a, c, g, or t
ttatnnggccggggtctcttctcgactcgacaccccatttttgtgcaataggaaccagcctccgccgtcgtcatgggtatcgatcttattgctggtggtaagagcaaacgcaccaaaagaaccgcccctagatccgacgatatctacctcaaactcctcgtcaagctttaccgttttctggtgaggagaaccggaagcaacttcaatgctgtcattctgaagaggttgttcatgagcaaagtcaacaagcctccgatttcactctctcgtttgatccgttacatgtccggcaaggatgataagattgctgtggttgtggggacagttacggatgatgttagggttcatgagattccttgtatgaaggtgactgcattgaggtttactgaaactgctagggctaggattgagaaggctggtggggagtgcttgacttttgatcagctcgctcttcgagctcctcttggacagaacacagttcttcttagaggaccaaagaattcacgtgaagctgtgaagcactttggtccggctcctggtgtgccgcacagtcacaccaagccatatgtgagatcaaagggaaggaagtttgagaaggccagaggtagaagaaacagcaggggatttagaaactaagttattataaatgttttccttgaatcttttccaaaggtctatttctaagattttcaatgttgtgtttttgatgaaacttctagatgatcttgtttgcatgcttgttatgatgaaaattttgttgttgacattcatttttcttctggtaatgaagttggagattatgttatatggttaaaaacaagattacaaattaagcagtaggacggtatcctctttttggggtgttttggncctagcctattttatgatttaaaccgaattttgacttggtgggcggaattccgaggtttttttggtcatttgggtcttacaagggaggaggctataacaactt

SEQ ID NO: 4381 - DNA, 828 bp, Helianthus annuus
gggggtgttcataaaccctagcctccctctccttccctttggacaccgtttctttttgcagcacccgccgtcgccatgggtatagatctagttgcaggtggaaagagcaagcggaccaaacgaaccgcccctagatccgatgatatctacctcaagcttctcgtcaagctttatcggtttttagttagaagaacaggaagcaatttcaatgctgtcattcttaagaggctcttcatgagcaaagtcaacaagcctcccatttctctttctcgtttgattcgttacatgtctgccaaggaagacaagattgctgtggttgttggcacggtaactgatgatgtacgggttcatgagattccttgtatcaaggttactgctcttaggtttacagagactgctagggcaaggattgagaaggctggtggagaatgtttgacgtttgatcagctggctcttagagctccacttggacagaacacggttctgttaagaggtccaaagaactctcgtgaggcagtgaagcacttcggaccagctcctggtgttccacacagtcacactaaaccctacgtccgatccaagggaaggaagttcgagaaggctagaggacgaagaaacagcagaggcttcagaaactaacttgttactgaggtggggccccttctatttatctcaaattatatactttcaattttttaaaaatgttttaggcatgttttttgctactgttgtttggtgttttgaatgtttttaacatttccatttagatttttggatggtggtgtttgaaagtgcatgtgtttgagcaaaaaatacggatttaaatga

SEQ ID NO: 4382 - DNA, 768 bp, Thellungiella halophila
  misc_feature (55)..(55): n is a, c, g, or t
  misc_feature (628)..(628): n is a, c, g, or t
gagcagtcactcgacagcacaaagccatgggtatcgatcttatcgcaggaggtangagcaagaaaaccaaaaggacagctccaaagtccgacgatgtctacctcaagcttctcgtcaagctctaccggtttttggtaaggagatctggaagcaagttcaatgctgtgatactgaagaggcttttcatgagcaaagtcaacaaggctcctctttctctctctcggctcgtcactttcatgaagggcaaggagggtaagattgctgtgttggttggaactataaccgatgatttgagaattcacgagattcctgccatgaaggttactgccttgaggtttacagagagggctagggctaggattgagaaagctggtggagaatgcttaacctttgaccagcttgcccttaaagctccattgggccagaacacggttctacttagaggacctaagaactcgcgtgaggcagtgaagcactttggtcttgctcctggtgtgccacacagtaacactaagccctatgttaggtctaagggaaggaagtttgagaaagctagaggaaggcgaaagagtcgtggattcaaggtctaagaaatatctgctgtttccgaagttgtgttgtttcgttntgattggcttcagaatcgaagttttgctagagaacactatgcttcctctttgcctgtttcagacattgtttcaagtttcctgtttttctgttttaatcgacttttaaatgttttgcctaatacatttttaatttactagt

SEQ ID NO: 4383 - DNA, 1237 bp, Nicotiana tabacum
gatccgtcgaggtagaagaaatcaaacatatcagcagcagccgcggggggaagcagaagcagcaggcggagcagccatgggtatcgatctagttgccgggggtaagtcgaaaaagactaaacgcactgccccaaaatccgacgatgtttatctcaagcttcttgtcaagctgtaccggtttcttgtgcggaggactgggagccagttcaatgccgtgatactgaagaggctgttcatgagcaagatcaataaagctcccttgtctctatcacgcttgattacttacatgaaaggaaaggaggacaaggttgctgtagttgtagggactgttactgatgatgttcgggcttatgaagtcccttcgctcaaggttactgcactgagattcacagaaacagctagagctaggattgagaaggctggaggagaatgcttgacctttgatcagcttgctcttagagcccctctcgggcagaacacggtactgcttaggggtccaaagaactcgcgggaagctgttaaacactttggtagagctcctggtgtcccacacagccacacgaagccttatgttcgggcaaagggaaggaagtttgagcgagcaagagggaaaagaaagagcagaggtttcaaggtttgaggaattgcgagtgtttgagtgcacgatgagagaatttcttttagaaggttttccctacctactttttaccatattagcttctttttcttgtcgaatttcttatttcacccctgtttctgtgacactccaacctatagccgattttgaatgcttttattatctattctacgaaattaagctgcctttaaagggatttcttcaacaatcaacatttacaaggctatgcaggaaaatgatacaatatgaagaccccctttttattatttaagctcttttatgctctgatagctgtgcttgcttaaaattaggtgaaaagattgaaaattagggtttatttctcagcagaggcaaaaaaaatcatggtgctttctttccatctactcgagtctttgcggacaaatttattaggtttttgtattggttggagatatcaaaatctgattggactagttgattttcatgcgagcactattgtattgaaaaacgtttgatttatagttcttagaccgtggccctgttttctatgcttctcgttgacaatcccgatgttagtaagaaattgattcgaagacagcggccgcatgaggggtaacctgt

SEQ ID NO: 4384 - DNA, 575 bp, Eschscholzia californica
cagcaacagcagaaatgggtatcgatctagttgcaggaggtaagagtaagaaaaccaaaagaactgcaccgaaatccgatgacatttacctaaagcttcttgttaagctttaccgattcttagtgagaagaactgaaagtaagttcaatgccgtcattttgaaacgattgttcatgagtaaggttcacaaagctccgttgtctctatccagattgattacctatacgaaaggaaaggaagggaagattgctgtgctagttgggacagttactgatgatactagggtttatgaagttccagcaataaaggtggcagctttgaggttcactgagactgcaagagcaaggattgagaaagctggcggagaatgtctaactttcgatcagctcgctcttcgagctcctctaggccagaatacggtactactcagaggaccaaagaattctcgtgaagcagtgaagcactttggaagggctcctggtgtgccacacagtcacagcaagccatatgttcgatcaaagggaggaaattcgaaaaggctagaggaaaaagaacagcagggggttcagggttta

SEQ ID NO: 4385 - DNA, 904 bp, Brassica napus
  misc_feature (855)..(855): n is a, c, g, or t
gactgtaaaaagaaaaaaaacaattgtttagcttattgggcatgtaaacttaagtccaaatattaaaacctatattgggcttagagttttgggcccatagtggaaatagaaaaccctacaaaatcaaagctgagtcgttacaaaagctagattcatcacttctcttgcagaatcttcgaccgcggcggcaccacatcctccgggaggccacaatgggaattgatttgatcgctggaggtaagagcaagaagaccaaaaggacagctcccaagtccgatgatgtctacctcaagcttaccgtcaagctttacaggtttctggtaaggagaacacagagcaagttcaatgcagtgatcttgaagaggcttttcatgagcaaagtcaacaaagctcctctttctctatctaggctcgtcgagtatgaccggcaaggaagataagattgctgtcttggttggaaccataaccgatgatttgagggtacacgagatcccagctatcaaggttactgccttgaggttcacggagagagccagagctcgcattgagaaagctggtggtgaatgcttgacctttgaccagcttgctctcagagctcctttgggacagaacactgttcttcttagaggacctaagaactcacgtgaagctgtgaagcattttggacctgctcctggtgtgccacacagtcactccaagccttatgttcgctccaagggaaggaagttcgagaaggccagaggaaagaggaagagccgtggattcaaggtttaaggacaccgtctgcgtctttgaacttgtttctagagtgttgttgcttcttgacttttgttagagaatcgtgtgttttttcgntgcctgtgtcagacaatattttaagattgtttctactggattaattgtg

SEQ ID NO: 4386 - DNA, 827 bp, Coffea canephora
ggcgacaacccacactctcccgattcccagttagataaaacggcagcatacaaccctagcatagtagtcttccttcccttccaggccgaaaaacatctatcgtttctgcaggcgccgcagtggggaaaaggaacagaagcagtagccatgggtatcgatctaaaggccggaggtaagagcaagaagacgaagcggaccgctcccaaatccgatgatatatacttgaagctgctggtgaagttgtaccggttccttgtgaggaggaccggtagcaagttcaatgtggtgatactgaagaggttgttcatgagcaagattaacaagcctgctctttcgctttcacggttgatcacttacaccaagggcaaggaggacaagattgcagtggttgttgggactgtcaccgatgatactcgtgtgtatgaagttccttcactgaaggtcaccgcacttagatttactgagactgcgagggctaggattgagaaggcaggaggagaatgcttgacttttgatcagctcgctctaagggctcctcttggccagaacacggtacttcttagagggcctaagaattctcgtgaagcagtgaagcacttcggaccagctcccggagtaccacacagcaacaccaagccatatgttcgatcctcgggaaggaaatttgagcgagctagaggaagaagaaatagcagaggattcagagtttaagttgttgtcaattaattgttgaaggcatactaatatacactattgagatgcgtgcttgaaacgttctgccctgcccgcctatttgcttttcttgttgtttctccttaaattaattt

SEQ ID NO: 4387 - DNA, 876 bp, Solanum melongena
ttttctacctgttgagcacaaaaacctatcagcaacagaggcggcgggaagcggaagcagcaggcggagcatccatgggtatcgatctagttgccggaggtaagtcgaaaaagactaaacgcactgctcctaaatctgacgatgtttatctcaagcttctcgtcaagttgtaccgattccttacacggaggactggtagtaagttcaatgcggtgatactgaagagactcttcatgagcaagatcaataaagctccattgtctttatcacgtttgattacttacatgaagggaaaggaggacaaggttgctgttgttgttgggactgttaccgatgatattcgggcttatgacgtcccttcactcaaggttactgcattgagattcactgaaacagctagagctaggattgagaaggctggaggagaatgtttgacctttgatcagctcgctctgagagcccctcttgggcagaacacggtattgcttaggggtccaaagaactcgagggaagctgttaagcactttggtaaagctcctggtgtcccacacagccacaccaagccttacgttcgctcaaagggaaggaagtttgagcgagcaagaggaaagagaaatagcagaggctacaaggtttgaggaagtgcagttgtttgaatgcaaaatgatagaatttcttttagaaggattttcccaacctacttttaccataatagtttcttgttggattttcttatttcttacacccccagcaacattttgctgatttttgaatgcgtttcttatctgttttgcgaagtttatagtcctattaaaagagggagtggatatctttaacatttataacaagtctatgctggattatgaattcctttcc

SEQ ID NO: 4388 - DNA, 862 bp, Ipomoea batatas
agaaaccatcagtagcacgcgcgcctgcaggtctgtcactagtacgatccaaagaattcggcacgaggcctagtcgctctttccattccccctcccccgaagccaccactccagcggcgttccaccatgggtatcgatctgaaagccggaggtaagagcaagcagacgaaacgcacagctcccaagtccgacgatgtgtacttgaagcttctcgtgaagctttaccgatttttggtgaggaggacgggaagcaagttcaacgccgtgattctgaagcgtctgtttatgagcaagaccaacaagcctccactgtctctctcaaagctgatctcttacatgtgtggaaaggatgacaagattgcggtcctggtgggtactatcacggatgatgtgagagcctacgaggtcccagcattgaaggtctgcgctctgaggttcaccaaaaccgcaagggctaggattgagaaggctggtggtgaatgcttgacgtttgatcagcttgctcttcgggctcctttgggacagaacacggttctgctcagaggtccaaagaattctcgtgaagcagttaagcactttggtccagctcctggtgttccacacagtcacaccaagccttatgtgcgcgctaagggaagaaagtttgagagggcaagaggcaagagaaatagcagaggatacaaggtttaagttcattttcatacttgacaatgggacgaattgtttgtgttgtggtattcaaattttgcaagactgtagtatgcagttacgagtttcagtactgttttggtttcgccgctggcagttttaacgttgtttttaaatggaaggtttctccattaatgtcttagttacaaaaaaa

SEQ ID NO: 4389 - DNA, 1564 bp, Physcomitrella patens
ctggggctggaccactgacttctctcttcctctgtttcccagcccaacgctcacgctgcagcttctccagcgcgggatcggctccaccaacaaccatgggtatcgatttgaaggccggtggtcgcaacaagaagaccaaacgtacagctcccaagagcggtaacgtataccttaagcttctcgtgaagctgtacaggtttttggttcgaaggacggatgctcccttcaactccgtgatcttgaagcgtctgtttatgagtcgaacgaacagggctcccctttccatgagccggctggtgaagtacatggctggaaaggatgacaaaattgcagtgttggttgggacgatcactgacgatgtgaggcagttcgaggtccctgcgctgaaggttgctgctcttcggttcacggagactgctcgcgcgcgtatcttgaaggctggaggagaatgcctgacgttcgatcagctggcgctgcgcgcaccaactggagcgaacactgtgcttttgcggggtccgaagaacgcccgcgaggcagtgaagcacttcggcgctcccggcgtgccacaaagtcacgcgaagccgtacgtccgatcgaagggacggaaatttgagaaagctcgtggtcgtcgtaatagcagaggattcaaggtctaggctcgttttgccgtgtgcggaacctgaggattatttcagggaggaacgtatggggcgtatgaggtttttggctggtacgtggatagttctatgatcttgccgtggcaggtggggtgcgtggtgcgcggttggcgtagcgttgtccctggtcatggatacggatagcgtgaatgcggaagtgtgacatgggaagcagcgacgcaagtttctaagaattgtgtgattgtgactgggtgaagggagacagtcacaggcgtacaccaatgcaagggtcggtgtgttttgagagacatttggcctgttaagtggtgtgatttctttttgaatgaaatacagagttttgcgcattgcctggactgtgccgtaacgtgatcttgtgtggtggaatatttgtgccaagtagctggacctgtgtatgtagtgtccctgcagctcttcaatctgttctagggtaattggaatgattattctttatcgccactctagccgaaaatgagttcattcacagctatgcatacgttgaagcctagtctgtgcttgatgggggaagtgtggatgttgtcgttgcttagagggtaatggctactgtttgtgtcatattttgaacgataacaaggtcttgctgtggatggctccagcgtgtaggtatgtgagcatgtcaaaccggcgcttttcaatgttctgactgtcccaagtagggtgaaaaatttgagctacagtatctctacggcttgcgtgcattggcatctgaaactatgctgtgggcctgccaaacgtgggaaacatttatgggagccttttcagtcatgttgacctactttccatcttttgtggagacaacggttacttcactacaaatatggtaattttatttgcttctttaatttaaaattatctcttacatcatc

SEQ ID NO: 4390 - DNA, 957 bp, Physcomitrella patens
attggccttagggctggagttggcattcgctgaatctctttgaaccctcccgcttcgacctactgactttccaatcccttgttgcagcgatgggtatagatttgaaggccgggggtcgcaacaagaagaccaagcgtacagcgcccaagagcgacaatgtgtacctgaagcttcttgtgaagctgtatcggttcctggtcaggagaaccgatgcccctttcaattcagttgtcttgaagcgcttgtttatgagccgtatcaaccgacctcccatttctatgtctcgtcttgtgaagtacatgaccggcaaggaaggaaaaattgctgttatcgtgggtactgtcactgacgacactagaatctacgaagttccagctttgaaggtggctgctcttcgatttaccgaaacagctcgtgctcgtatcttgaagagcggaggggaggttttgactttcgaccagcttgccctgagagctccgactggatccaattgcgtattgctgaggggacctaagaatgctcgtgaagccgtgaagcacttcggggcacctggtgtaccacaaagtcatgccaagccctatgtgcgatccaaaggacgcaagtttgagaaggctcgtgggcgccgtaacagcagaggttttaaggtttaggcatggttctctcactgtttggataagatatttctacacatgctcgtgtacgctgagtttataatgatcccattacctccaactgcacgactccgtgtcctcaactgactgtttccggtgtttatctgcgatggtgaatacacagtttataatccttggcactggtcattgtttgttttactcctacatgattatcaactaaattgacacacaacatgcaaacttagtgagctctgatgctattatcaaaaaaggatatgttttttagagcagctttgttagcaaatttaatttactggtaattata

SEQ ID NO: 4391 - DNA, 776 bp, Bruguiera gymnorhiza
ggcccgggacatttggcctcgccgagaaccaacagcgtccgcgacaatgggtatagatttgaaagccggcggcaagagcaagaagaccaagcgcaccgccccgaagtccaacgatatctacctcaagctcctcgtcaagttgtaccgctttctggtgaggaggacaggaagcaagttcaatgcggtggtgctgaaacggctgttcatgagcaaggtcaacaagcctcctctttccctctctcgtttaattaggttcatgaaggacaaggagaataagattgctgtggttgttgggactgtaactgatgatattcgggtgtatgaggtccctgctttgaaggttactgcactgaggttcacagagactgccagggcaaggattgagaaggcaggtggtgaatgcttgacctttgaccaacttgctctgcgagctcctcttggtcagaacacggttctccttagaggtcccaagaatgctcgtgaggctgtgaagcactttggaccagcacctggtgtgccacacagccacacaaagccctatgtacgatcgaagggaaggaaatttgagagggctagaggaaaaaagaaaaacaagggcttttagggttttaaggttccaaaattgagggaaatttaaattgacccccccaaatccaaggcttttggctcccctggtttcaaagggcctttttaaaaaattttttctctctttgaaaatttaaacgggggggtgaacaaaatggggacccgaaaaaaggggaaaaaaccctttttgg

SEQ ID NO: 4392 - DNA, 825 bp, Cichorium intybus
gcgggggtcaccgctattctttctgcggtgaaacagccgtcgtcgtcatgggtatagatcttgttgccggtggaaagagcaagaggaccaaaaggaacgctccacgttccgatgatatctaccttaagctcctcgtcaagctttatcgatttttggtgaggaggacaggaagcaacttcaatgctgtgatactgaagaggctcttcatgagcaaagtcaacaagcccccaatttcactctctcgcttgatccgttacatggccggcaaggaagagaagattgctgtgattgttggcacagtgacggatgatgttagggtgcatgaaatcccatgtatgaaggttactgctctgaggttcaccgagactgcaagagccaggatcgagaaggctggtggtgaatgcttgacttttgaccagttggctctgcgagctcctcttggccagaacacggttcttctaagaggtccaaagaattcgagggaagcagtgaggcactttggaaaggctcctggtgtgccacacagccataccaagccatatgtgcgatcaacaggaaggaagtttgagaaggctaggggaagaagaaacagcagaggcttcagaaactaagaagcattcatcaatggtgggtgtctttaaaatcttgcttaagttctataatccttttttatgctggtgttgtttggtttaagcaatcatgaaaattttgctgtttggttatatgtagttttgagttctaatttacattccagaattgtttaatggagattaattttctgtggtctttctacttgatgttttcctttggtgagttaaaaaaata

SEQ ID NO: 4393 - DNA, 577 bp, Trifolium pratense
tcaaagcagacatgggtatcgatcttaaagcaggaggtaagagcaagaagaccaaaagaacagcaccaaagtccaatgatatctatctcaagcttttggtcaagctttatcggttccttggtcggagaactggcagcaatttcaatgctgttatcctcaagaggttgttcatgagcaaggttaacaagcctccactatctttgtcaagattgatcaagtacactaagggcaaggaaggtaaaattgctgtggtggtgggtactataactgatgatatccgtgtttatgaagttccagccataaaggttacagcactcaggtttactgagaccgcaagggcaagaattgagaaggccggtggtgaatgcttgacattcgatcagttggcccttagggcaccattgggacaaaacacggtccttcttagaggtccaaagaatgctcgtgaagctgtgaagcactttggtcgtgctcctggtgtcccacacagccacaccaaaccatatgtgagagcaagcggaaggaagtttgagaaggctagatgtaagaggaacagccgtggattcagagtttaatt

SEQ ID NO: 4394 - DNA, 823 bp, Taraxacum officinale
  misc_feature (807)..(807): n is a, c, g, or t
cggggtttttcgttgttcgttccgtcttctttctgtaggtacaagcagcagtcgccgtcatgggtatcgatcttgttgctggtggaaagagcaagaggaccaagaggaatgctccacgttccgatgatatctaccttaagctcctcgtgaagctttatcggtttttggtgaggaggacaggaagcaacttcaatgcagtgatactgaagaggctcttcatgagcaaagtcaataagcccccaatttctctctctcggttggtccgctacatggctggcaaggacgacaagattgctgtgattgttggcacagtcaccgatgatgttagggttcatgaaatcccatgtatgaaggtcactgctctaaggttcaccgagactgccagggccaggattgaaaaggctggtggtgaatgcttgacttttgaccagttggcacttcgagctccccttggccagaacactgttcttctgagaggccctaaaaattgtcgtgaagcagttaggcactttggaaaggcgccaggtgtcccacaaagtcacaccaaaccctatgtgcgatcaaagggaaggaagtttgagaaggctagaggaagaagaaacagcagaggcttcagaaactaagtgttcatcaatggtgggagtcttagaaaagttgcttaacttttataatctctttttatgctggtgttgttttgattcaaggtatgatggaaattttgatgtttggtaatatgtagtagcaaggagttttgagttgtttattaccttcaagaatttgttaaatggagatcagttttatttttcntaaagtttagttttta

SEQ ID NO: 4395 - DNA, 732 bp, Lactuca sativa
cccttaaatcatttgtttttgcaggtaccagcaaccgccgtcgccatgggtatcgatctcgttgcaggtggaaagagcaagaggaccaaaagaacagcccctagatccgatgatatctatctcaagcttctcgtcaagctttatcggttcctagttaggaggactggaagtaacttcaatgctgtgattctgaagaggctctttatgagcaaagtcaacaagcctccgatttctctatctcgtttgattcgtttcatgtctggaaaggaagacaagattgctgttgttgttggtacagttactgatgatgttagggttcatgagatcccttgcatcaaggtgactgctctgaggtttactgaaactgctagggcaaggatcgagaaggcaggaggagaatgcttgacatttgatcagcttgctcttagagctcctcttggacagaatactgttctgcttagaggcccaaagaattgtcgtgaagcagtgaggcactttggaaaggcaccaggtgttccacacagccacaccaagccttatgtgcgatctacaggaaggaaatttgagaaggctagaggaagaagaaacagcagaggcttcagaaactaggcttttcttgaggtgtcactatttgattctattatgtcaacttctatattgggatctttaaagttttgttatttacaagcctgttagacatattcttcatgatatgctttatgttattttagg

SEQ ID NO: 4396 - DNA, 761 bp, Lactuca sativa
cttcctccccctccccttaacatcatttgtttttgcaggtaccagcaaccgccgtccccatgggtatcgatctcgttgcaggtggaaagagcaagaggaccaaaagaacagcccctagatccgatgatatctacctcaagctcctcgtcaagctttatcggttcctagttaggaggactggaagtaacttcaatgctgtgattctgaagaggctcttcatgagcaaagtcaacaagcctccgatttctttatctcgtttgattcgttacatgtctggaaaggaagacaagattgctgtggttgttggtacagtgacagatgatgttagggttcatgagatcccttgcatcaaggttactgccttgaggtttactgagactgctagggcaaggatcgagaaggcaggtggagaatgcttgacatttgaccagcttgctcttagagctcctcttggacagaacactgttctgcttagaggacctaagaattgtcgtgaagcagtgaggcactttggaaaggcacctggtgttccacacagccacaccaagccctatgttcgatccaagggaaggaaatttgagaaggctagaggaagaagaaatagcagaggcttcagaaactaggcttttcttgaggtgtcactgtttggatttatatcaatttctatattgggatctttaaagttttgtcatttataaacctgttagacgtactcctccgcatgatgcatttttattattttaggcaagtttctatgggta

SEQ ID NO: 4397 - DNA, 747 bp, Lactuca sativa
cccttaaatcatttgtttttgcaggtaccagcaaccgccgtccccatgggtatcgatctcgttgcaggtggaaagagcaagaggaccaaaagaacagcccctagatccgatgatatctacctcaagctcctcgtcaagctttatcggttcctagttaggaggactggaagtaacttcaatgctgtgattctgaagaggctcttcatgagcaaagtcaacaagcctccgatttctttatctcgtttgattcgttacatgtctggaaaggaagacaagattgctgtggttgttggtacagtgacagatgatgttagggttcatgagatcccttgcatcaaggttactgccttgaggtttactgagactgctagggcaaggatcgagaaggcaggtggagaatgcttgacatttgaccagcttgctcttagagctcctcttggacagaacactgttctgcttagaggacctaagaattgtcgtgaagcagtgaggcactttggaaaggcacctggtgttccacacagccacaccaagccctatgttcgatccaagggaaggaaatttgagaaggctagaggaagaagaaatagcagaggcttcagaaactaggcttttcttgaggtgtcactgtttggatttatatcaatttctatattgggatctttaaagttttgtcatttataaacctgttagacgtactcctccgcatgatgcatttttattattttaggcaagtttctatgggta

SEQ ID NO: 4398 - DNA, 763 bp, Lactuca sativa
atcatttgtttttgcaggtaccagcaaccgccgtcgccatgggtatcgatctcgttgcaggtggaaagagcaagaggaccaaaagaacagcccctagatccgatgatatctatctcaagcttctcgtcaagctttatcggttcctagttaggaggactggaagtaacttcaatgctgtgattctgaagaggctcttcatgagcaaagtcaacaagcctccgatttctctatctcgtttgattcgtttcatgtctggaaaggaagacaagattgctgtggttgttggtacagtgactgatgatgttagggttcatgagatcccttgcatcaaggttactgctctgaggtttactgagactgctagggcaaggatcgagaaggcaggaggagaatgcttgacattcgatcagcttgctcttagagctcctcttggacaaaacactgttctgcttagaggaccaaagaattgtcgtgaagcagtgaggcactttggaaaggcaccaggtgttccacacagccacaccaagccttatgtgcgatctacaggaaggaaatttgagaaggctagaggaagaagaaacagcagaggcttcagaaactaggcttttcttgaggtgtcactatttgatgattctattatgtcaacttctatattgggatctttaaagttttgctatttataagcctgttagacatattcttcatgatgctttttgttattttaggcaagttttaatgggtattgttgggtgttttttttttt

SEQ ID NO: 4399 - DNA, 828 bp, Lotus japonicus
gtcatcctcaactgcaggtgcggctctctctctctcagcgtcggagacaacaagcagcagccatggggattgatctgaaggcaggaggtaagagcaagaagaagaacagaacagcacccaagtccaatgatatctacctcaagcttctagtcaagctttatcgcttccttgttcggagaactggaagcaagtttaatgctgtgatactcaagcgcttgttcatgagcaaggttaacaagcctccactctcattgtcaaggctggtcaagtttatgaaggggaaggatggtaagatcgctgtggtggtggggactgtaactgatgatattcgtgtttatgaggttccaaccttgaaggttaccgctcttaggtttactgagacagcacgggcaagaatagaaaaggccggtggtgaatgcttgacatttgatcagttggctcttgcagctcctctgggacagggcacggtccttcttagaggccctaagaatgctcgtgaggctgtgaggcactttggtcgtgctcctggtgtgccacacagccacaccaagccttatgtgcgatcaaagggaaggaagtttgagatggctagaggaaagaggaacagtcgaggattcaaagtttgatgcagtagtatttcttttctggtgtttacttctgaaatccagtgaaggcacttttcatgttatttcttataaggatttttaagtatgaagatttttgctctttgttcccttatttgatgttcaagtgttatgtggagcttactcttaactccattttgatgctagagaatggataatcgttaatcatgtgatgccaacagac

SEQ ID NO: 4400 - DNA, 1200 bp, Pinus taeda
tcgtcgttccttttattgttcgcgaggccttggaaggaacaggaaggccgaggatttgatttcagcagcggcaacgatgggtatcgatttaattgccggtgggaagagcaagaagactaagcgtacagctcccaagagccaggatatttacctcaagctccttgtcaagctataccgttttttggtgaggagaaccaatagcagcttcaatgcagtgattttaaagaggctgttcatgagcaaaacgaacaagccgccgctatctctttctcgcctagttcgttacatgcaggaaaaggatgacaagattgcagtggttgtggggaccatcacagatgataataggatttatgaactgcctcctttgaaggtaactgctcttagattcacagagacagcgagagctcgaattttgaaagcaggaggcgagtgcttaaccttcgatcagcttgcacttcgtgcaccacttggacagaacacagtcttgttgcgtggccccaagagccatcgtgaggctgtcaagcactttggaagggcaccaggtgttccccacagccacactaaaccatatgttcgatctaagggtaggaaatttgagatggctcgtggtaggagaaacagtcgtggcttcaaggtctagagaagcaaagggatttatggtgatttttagtcttttcagtgagctctgcggatttcattagttctactattatgttgccgcaaattgtaagcagcaactctagaatatagatgtttaatgttttgtttaaaacattctctgattacatggcaaaccattgggatgagatgtctgttggtttgccatcagagcttctcttcctatgaaagggagaactgtcagttctacaacttttctcttactatgaaatgagtacttagtttttcgactttggacgctgccttaactttgtgaaagggggtcaccagttttacagtgtttgagtcgtatctaaaggattttttgagactataatgatatctattttttgatttaatgggttgctgggtttctctcatgtctaggaaatctgcagtgtttgttttattcaatggatttcattagatttagcacttttggatgtatgtaggaaataattttattgaatccttcaactaagagaagatatcgattgataattttattgttaatatttacatgagcgactatacttttcgggt

SEQ ID NO: 4401 - DNA, 617 bp, Solanum tuberosum
  misc_feature (562)..(562): n is a, c, g, or t
  misc_feature (572)..(572): n is a, c, g, or t
gatctatcagcagcaggcggcggcggcggagagtagaagcagcaggcggagcatcatcatgggtatcgatctagtggccggaggtaagtccaaaaagactaagcgcattgcaccaaaatccgacgatgtttatctcaagcttctcgtcaagttgtaccgatttcttgcacggaggactggtagtaagttcaatgctgtgatactgaagagactcttcatgagcaagatcaataaagctccattgtctctatcacgtttggttacttacatgaccggaaaggaggacaatattgctgttattgtcgggactgttaccgatgatgttcgagcttatgaagtccctaaaatcaaggttactgcattgagattcactgaaacagctagagctaggattgagaaggctggaggagaatgtttgacctttgatcagctcgctctcagagcccctcttgggcagaacacggttttacttaggggtccaaagaactcgagggaggctgttaagcactttggtaaagcacctggtgtcccgcacagccacacgaagccttatgttcgtgcnaagggaaggnagtttgagcgagcaagaggaaagagaaatagcagaggctacaaag

SEQ ID NO: 4402 - DNA, 791 bp, Raphanus sativus
gttttcctccgtaacagacgccatgggtatcgatcttatcgccggaggtaagagcaagaagaccaaaaggacagctccaaagtccgatgatgtctacctcaagcttctcgtcaagctgtaccggtttttggtaaggagaaccggaagcaagttcgatgctgtgatcctcaagaggcttttcatgagcaaagtcaacaaggctcctctttcgctctccaagctcgttgagtttatgaatggcaaggatggtaagattgctgtgttggttgggacaatcactgatgatctgagagtgcatgagattcctgcaatgaaggttactgccttgaggtttacggagagagctagggctaggattgagaaagctggtggggagtgcttgacctttgaccagctagctctcgttgctccattgggacagaatacggttctgctaagaggacccaagaactctcgtgaggcagtgaagcactttggtccagctcctggtgtgccacacagccactccaagccttatgttaggtctaagggaaggaagtttgagaaggctagaggaaagcgaaagagtcgtggattcaaggtctaagaaagtcctcaaaactgtttcgaggttcttgtttccttatgattgttgctgttttcagaatcgaagtttttgtagaccgcttttgttactttttgccttttgcagacattggtttgagttttccgtgtttctgttctaatcgacaattgaatgttttgcttccgccaatattcttgatataaaatttagaggcaaaaaaaaaaaa

SEQ ID NO: 4403 - DNA, 751 bp, Raphanus sativus
gggggtagaagaagacactcgacagctcctcaagccatgggtatcgatcttatcgctggaggtaagagcaagaagaccaaaaggacagctcctaagtccgatgatgtctacctcaagcttctcgtcaagctataccggtttttggtaaggagaaccggaagcaagttcgatgctgtgattcttaagaggcttttcatgagcaaggtcaacaaagctcctctttcgctctctaagctcgtggagtttatgaagggcaaggatggtaagattgctgtgttggttgggactattaccgatgatttgagagtgcacgagatccctgccatgaaggttactgccttgaggtttacagagagggctagggctaggattgagaaagctggtggagagtgcttgacctttgatcagcttgctctcgttgctccattgggacagaacacagttcttcttaggggaccaaagaactcgcgtgaagcagtgaagcactttggtccagctcctggtgtgccgcacagtcactccaagccttatgttaggtctaagggaaggaagtttgagaaagccagaggaaagcgaaagagtcgtggcttcaaggtctaagattggtttcgttatggttggtttcgttatcgagattttgttgcacaactcttgttcctcttcgccttttgcagacattgttttgagctctctatctttatgttctactcgacaattaaatgtttttcctaatatcccttttaagagttta

SEQ ID NO: 4404 - DNA, 737 bp, Raphanus sativus
atctcttgcagcggcggcaccacatccccggaggttacgatgggtatcgatttgatcgctggaggtaagagcaagaagaccaaaaggacagctcctaagtccgatgatgtctacctcaagcttattgtcaagctttaccggtttctggtgagaagaactcagagcaagttcgacgcagtgatcttgaagaggcttttcatgagcaaagtcaacaaagctcctctttctctgtctagactcgtcgagttcatggctggcaaggaagataagattgctgtcttggttggaaccatcaccgatgatttgagagtacatgagatcccagctatcaaagtgactgccttgaggttcacagagagagccagagctcgcattgagaaagctggtggtgaattcttaacctttgaccagcttgctctcagagctcctttgggacagaacacggttcttcttagaggacctaagaactcacgtgaggctgtgaagcattttggtcccgcacctggtgtgccacacagtcactccaagccatatgttcggtccaagggaaggaagttcgagaaggccagaggaaagaggaagagccgtggattcaaggtttaagaacattgtctgtgtcctatcgtgttgttgcttcttcttctctttcataatcggattttttttagagaattgtgtttttttcagtgccttgtttcagacaatatctaaagtttctgactactgttgagcttatt

SEQ ID NO: 4405 - DNA, 907 bp, Raphanus sativus
  misc_feature (649)..(649): n is a, c, g, or t
  misc_feature (652)..(652): n is a, c, g, or t
gggttttcatttactacgagaagaagaaagagttataaaagctatagatagattcttcatcacttgtcttgcgcaagcttcgacggcggcggcaccaccaccacatccccggaagctacaatgggaattgatttgatcgcaggaggtaagagcaagaagaccaaaaggacagctccaaagtcggacgatgtctacctcaagcttaccgtcaagctttaccggtttctggtaaggagaacacagagcaagttcaatgcagtgatcttgaagaggcttttcatgagcaaagtcaacaaagctcccctttctctatccaggctcgtcgagttcatgaccggcaaggaagataagattgctgtcttggttggaaccatcaccgatgatttgagggtacacgagatcccagctatcaaagttactgccttgaggttcacggagagagccagagctcggattgagaaagctggtggtgaatgcttgacctttgaccagcttgctctcagagctcctttgggacagaacactgttcttcttagaggacctaagaactcacgtgaagccgtgaagcattttggccctgctcctggtgtgccacacagtcactccaagccgtatgttcggtccaagggaaggaagttcgagaaggccngangaaagaggaagagccgtggattcaaggtttaagaaacatttgtctctgcctgcgtcttcgaacttgattctcgagtgttgttgcttctttaattaaaactgtattcgtaaccggatctttgttagttaattgttgcttctcatcgcttgtttcagacaatagatttaagtttgttttctactggaatcatcgcgagtagattactcatttgtgcacttacatatacttaagctttaataatatcgaagtcttatt

SEQ ID NO: 4406 - DNA, 783 bp, Raphanus sativus
gggttttcctccgtaacagacgccatgggtatcgatcttatcgccggaggtaagagcaagaagaccaaaaggacagctccaaagtccgatgatgtctacctcaagcttctcgttaagctgtaccggtttttggtaaggagaaccggaagcaagttcgacgcagtgatcctcaagaggcttttcatgagcaaagtcaacaaggctcctctctcgctctccaagctcgttgagttcatgaacggcaaggatggtaagattgctgtgttggttgggacaatcactgacgatttgagagttcatgagattcctgccatgaaggttactgccttaaggtttacggagagagctagggctaggattgagaaagctggtggagagtgcttgacctttgaccagctagctctcgttgctccgttgggacagaacacggttctcctaagaggaccgaagaactctcgtgaggcagtgaagcactttggtccagctcctggtgtgccacacagccactcgaagccttatgttaggtctaagggaaggaagtttgagaaagctagaggaaagcgaaagagtcgtggtttcaaggtctaagaaagtcctcaaaactgtttcgagcttcttgtttccttatggttgttgctgctttcagaatcgaagttttttgtagaccgcttattgttactctttgccttttgcagacattgttttgagttttctgtctttctgttctaatcgacaattgaatgttttgcttccgccaatattcttgatataaaaattagaggc

SEQ ID NO: 4407 - DNA, 754 bp, Raphanus sativus
  misc_feature (289)..(289): n is a, c, g, or t
  misc_feature (297)..(297): n is a, c, g, or t
  misc_feature (300)..(300): n is a, c, g, or t
  misc_feature (312)..(312): n is a, c, g, or t
  misc_feature (330)..(330): n is a, c, g, or t
  misc_feature (345)..(345): n is a, c, g, or t
  misc_feature (375)..(375): n is a, c, g, or t
  misc_feature (528)..(528): n is a, c, g, or t
  misc_feature (613)..(613): n is a, c, g, or t
  misc_feature (617)..(617): n is a, c, g, or t
gggttttcctccgtaacagacgccatgggtatcgatcttatcgccggaggtaagagcaagaagaccaaaaggacagctccaaagtccgatgatgtctacctcaagcttctcgttaagctgtaccggtttttggtaaggagaaccggaagcaagttcgacgcagtgatcctcaagaggcttttcatgagcaaagtcaacaaggctcctctctcgctctccaagctcgttgagttcatgaacggcaaggatggtaagattgctgtgttggttgggacaatcactgacgatntgagagtncangagattcctgcnatgaaggttactgccttnaggtttacggagagngctagggctaggattgagaaagctggtggngagtgtttgacctttgaccagctagctctcgttgctccgttgggacagaacacggttctcctaagaggaccgaagaactctcgtgaggcagtgaagcactttggtccagctcctggtgtgccacacagccactccaagccttatgttaggtcnaagggaaggaagtttgagaaagctagaggaaagcgaaagagtcgtggtttcaaggtctaagaaagtcctcaaaactgtttcgagnttgntgtgtttccttatggttgttgctgctttcagaatccaagttttttgtagaccgcttattgttactctttgccttttgcagacattgttttgagttttctgtctttctgttctaatcgacaattgaatgtttttgctt

SEQ ID NO: 4408 - DNA, 733 bp, Raphanus sativus
cagacgccatgggtatcgatcttatcgccggaggtaagagcaagaagaccaaaaggacagctccaaagtccgatgatgtctacctcaagcttctcgttaagctgtaccggtttttggtaaggagaaccggaagcaagttcgatgctgtgatcctcaagaggcttttcatgagcaaagtcaacaaggctcctctttcactctccaagctcgttgagttcatgaacggcaaggatggtaagattgctgtgttggttgggacaatcactgatgatttgagagtgcatgagattcctgcaatgaaggttactgccttgaggtttacggagcgagctagggctaggattgagaaagctggtggagagtgcttgacctttgaccagcttgctctcgttgctccattgggacagaacacggttcttcttagaggaccgaagaactctcgtgaggcagtgaagcactttggtccagctcctggtgtgccacacagccactccaagccttatgttaggtctaagggaaggaagtttgagaaagctagaggaaagcgaaagagtcgtggtttcaaggtctaagaaagtcctcaatactgtttcgaggttgttgtgtttccttatggttgctgctctcagaatccaagttttttgtagaccgcttattgttactctttgccttttgcagacattgttttgagttttctgtcttttttttttaatcgacaattgaatgttttgct

SEQ ID NO: 4409 - DNA, 793 bp, Raphanus sativus
tcgacagcacaagccatgggtatcgatcttatcgcgggaggtaagagcaagaagaccaaaaggactgctccaaagtccgatgatgtctacctcaagcttctcgtcaagctataccggtttttggtaaggagaaccggaagcaagttcgatgctgtgatccttaagaggctttttatgagcaaagtcaacaaagctcctctttccctctccaagctcgtggagttcatgaacggcaaggatggtaagattgctgtgttggttgggacgataactgatgatttgagagttcatgagattcctgctatgaaggttactgccttgaggtttaccgagagagctagggctagaattgagaaagctggtggagagtgcttaacattcgaccagcttgctctcgttgctccattgggtcagaacacggttcttcttagaggaccaaagaactctcgtgaagcagtgaagcactttggtcctgctcctggtgtgccgcacagccactccaagccctatgtcaggtctaagggaaggaagtttgagaaagctagaggaaagcgaaagagtcgtggattcaaggtctaagaagtctctctctgctgtttcgacgggtgttattttgtgttatggttgcttctttcagtgtagcaattttgctagtgaactcgtgttgttcctctttgcctgttccagacattgttttaagttatctgtctacttttcgttctaaacgacagtttaatgttttgcttaataacattttaaaaatttactgccacaaaagccttcgtttgataga

SEQ ID NO: 4410 - DNA, 799 bp, Carthamus tinctorius
  misc_feature (136)..(136): n is a, c, g, or t
  misc_feature (524)..(524): n is a, c, g, or t
accctagctcctttttctttcctcattttttttcgcaggtacaagcagccgtcgccgtcatgggtatagatctcgttgccggtggaaaaagcaagaagacgaagaggactgcacctcgatccgatgatatctaccncaagcttctcgtgaagctttatcggtttttggtgaggaggacagggagcaacttcaatgcggtgatattgaagaggctttttatgagcaaagtgaacaaacctccgatttcgctatcgcgtttggttcgttatatgtctggaaaggaggacaagattggtgtgattgttgggacagtcacagatgatgtcagggtgcatgaaatcccatgtatgaaggtgactgctttgaggtttagcgagactgcaagggctaggatcgagaaagccggcggagaatgtttgacttttgaccaacttgctcttcgagctcctcttgggcagaacacggttcttcttagaggtcccaagaattcccgagaagcggtcagacactttggaaaggcgccnggtgtgccacacagccataccaagccatatgtgcgatccaacggtaggaaattcgagaaggctagaggacgaagaaacagcagaggcttcagaaactaatctgggagtgtttgaagtaatatgttgagttctataatattgttttatgctgatgacttattgattaagctgtgatgaaaattttggtgttagcatctttctttaatgttgatgtagcagggagttttgagttttaaattaccatccacatttcttgaatggagattgaatttgtc

SEQ ID NO: 4411 - DNA, 946 bp, Camellia sinensis
tcctgatccctaccaaaataaaaaaccctaagcccttctctccctctctatatctgcacacatttttggtttcggcggagtcgcggcgtgtaacagcaacatcaagcgcagcagccatgggtatcgatctgaaagccggtggcaagagcaagaagaccaaaaggaccgcccccaaatcccaagatatctatctcaagctcctcgtcaagctgtaccgttttcttgtgaggaggacgggaagcaagttcaatgctgtgatactgaagaggttgttcatgagcaaggtcaataagcctcctatctctctctctcgcttgactcgtttcatgcagggaaagggggaaaagattgcagtcgttgttggtaccattactgatgacattagggcccatgaagttcctgccttgaaggtgactgcactgaggttcacagagacagcgagagcaaggattgagaaggccggtggtgagtgcctgacatttgatcagctggccctcagagctccacttgggcagaacacggtactccttagaggccccaagaattctcgtgaagcagtgaaacattttggcaaggctcccggtgtgccgcacagccatactaagccctatgtgcgatcaaagggaaggaaatttgagcaggctagaggaagaaggaacagccgaggctacaaggtttaagttgttgctgatgtgtgcaacagacccatctattaattactatgcaaaagattttgttccacccatttgggaccggagttgttttgtttcgtgctttcttgtatttcagacatttgcaatatcagtagtgagttttcagcatttgcaatatttttagttgttggattggagcttttaattaaatgtctatcaaggagtttttgcgttttttttctggtgccacagggctgttcgggttctaattgtatggctcacttgaaattgca

SEQ ID NO: 4412 - DNA, 910 bp, Camellia sinensis
tatcggccattacggccggggtcctgatccctaccaaaataaaaaaccctaagcccttctctccctctctatatctgcacacatttttggtttcggccggggtcgcggcgtgtaacagcaacatcaagcgcagcagccatgggtatcgatctgaaagccggtggcaagagcaagaagaccaaaaggaccgcccccaaatcccaagatatctatctcaagctcctcgtcaagctgtaccgttttcttgtgaggaggacgggaagcaagttcaatgctgtgatactgaagaggttgttcatgagcaaggtcaataagcctcctatctctctctctcgcttgactcgtttcatgcagggaaagggggaaaagattgcagtcgttgttggtaccattactgatgacattagggcccatgaagttcctgccttgaaggtgactgcactgaggttcacagagacagcgagagcaaggattgagaaggccggtggtgagtgcctgacatttgatcagctggccctcagagctccacttgggcagaacacggtactccttagaggccccaagaattctcgtgaagcagtgaaacattttggcaaggctcccggtgtgccgcacagccatactaagccctatgtgcgatcaaagggaaggaaatttgagcaggctagaggaagaaggaacagccgaggctacaaggtttaagttgttgctgatgtgtgcaacagacccatctattaattactatgcaaaagattttgttccacccatttgggaccggagttgttttgtttcgtgctttcttgtatttcagacatttgcaatatcagtagtgagttttcagcatttgcaatatttttagttgttggattggagcttttaattaaatgtctatcaaggagtttttgcgttt

SEQ ID NO: 4413 - DNA, 816 bp, Nicotiana tabacum
gatattcatataagagccgacccctgcagcagcagccatttctccatcactcgttcagcggagtccagaccctatcagccatgggtatcgatttgaaggccggaggtaagagtaagaagactaagcgtactgcccctaaatctgacgatgtttacctcaagctcctcgtcaagctttaccgattcctggtaaggaggaccggaagcaagttcaatgcggtgattcttaagaggctcttcatgagcaagatcaacaagcctccactttctctctcgaggttgatctcttatgccaaaggaaaggaggataaggttgtggtgattgtgggtactattaccgacgatgttagggcttacgaagttccagcattgaaggtgtgtgctttgaggttcactaagaccgccagggctaggattgagaaggctggtggcgagtgcttgacgttcgatcagctggctctcagggctccacttggacagaacacgcttctcctaaggggtcctaagaatgcacgtgaagcagtgaagcactttggtccagctcctggtgttccacacagccataccaaaccatttgtgcgttccaagggcagaaagtttgagagggctcgaggaagaagaaacagcaggggttacaaggcttaggttgatttcagttattaaccttggaatgttttttatcatttgtatcgctacaatacaagcttttgcaggctcctgtatgcagttgcagcaagttgcttatgtttgcttgtctttgtcaaggatatttgagctctatcaactttgatgccaaagttttggtttaaaatgaatg

SEQ ID NO: 4414 - DNA, 866 bp, Nicotiana tabacum
  misc_feature (91)..(91): n is a, c, g, or t
tcatataagagccgacccctgcagctgcagccatttctccatcactcgttcagcggagtccagacccgagcagccatgggtatcgatttgnaggccggaggtaagagtaagaagactaagcgtactgcccctaaatctgacgatgtttacctcaagctcctcgtcaagctttaccggttcctggtaaggaggaccggaagcaagttcaatgcggtgattctcaagcggctcttcatgagtaagatcaacaagcctccactttctctctcgaggttgatctcttatgccaaaggaaaggaggataaggttgtggtgattgtgggtactattaccgacgatgttagggcttatgaagttccagcattgaaggtgtgtgctttgaggttcactaagactgccagggctaggattgagaaggctggtggcgagtgcttgacattcgatcagctggctctcagggctccacttggccagaacacgcttctcctaaggggtcctaagaacgcacgtgaagcagtgaagcactttggtccagctcctggtgttccacacagccataccaaaccatttgtgcgttctaagggcagaaagtttgagagggctcgaggaagaagaaatagcaggggttacaaggcttaggttgatttcagttattaacctcagaatggtttttatcatttgtaacgctacaatgcaagtttttgcagactatagtatgcagttgcagcaagttgcttatgtttactcgtctttgtcaaggatatttgagctctatcaactttgataccaaagttttggtttaaaatgaatgtagcctatcagtttgctttagtaaatgtcaaaaattatgggcttgttaatgcact

SEQ ID NO: 4415 - DNA, 862 bp, Solanum lycopersicum
aaagaatcttcatcatatttttccattctccgaacagaaaaacctatcagcagcaggcggcggcggaggaaagtagaagcagcaggcggagcatcatgggtatcgatctagttgccggaggtaagtccaaaaagactaagcgcattgcaccaaaatccgacgatgtttatctcaagcttctcgtcaagttgtaccgatttctatcacggaggactggtagtaagttcaatgctgtgatactgaagagactcttcatgagcaagatcaataaagctccattgtctctatcacgtttggttacttacatgactggaaaggaggacaatattgctgttgttgttgggactgttaccgatgatgttcgagcttatgaagtcccaaaaatcaaggttactgcattgagattcacggaaacagctagagctaggattgagaaggctggaggagaatgtttgacctttgatcagctcgctctcagagcccctcttgggcagaacactgttttgcttaggggtccaaagaactcaagggaggccgttaagcactttggtaaagcacctggtgtcccacacagccacacaaagccttatgttcgcgcaaagggaaggaagtttgagcgagcaagaggaaagagaaatagcagaggctacaaggcttgaggaagtgctgatgtttgaatgcacattgatagagtttctattagaagtatttgccaacctacttttaccattaatagtatcttgttggattttcttatttcaactttgtttctcttacacactccagcatcatattgctgatttttgaatgtgttatctgttttgcgaaattaatctctatttagagactgaatctttacaac

SEQ ID NO: 4416 - DNA, 840 bp, Solanum lycopersicum
ccattctccgaacagaaaaacctatcagcagcaggcggcggcggaggaaagtagaagcagcaggcggagcatcatgggtatcgatctagttgccggaggtaagtccaaaaagactaagcgcattgcaccaaaatccgacgatgtttatctcaagcttctcgtcaagttgtaccgatttctatcacggaggactggtagtaagttcaatgctgtgatactgaagagactcttcatgagcaagatcaataaagctccattgtctctatcacgtttggttacttacatgactggaaaggaggacaatattgctgttgttgttgggactgttaccgatgatgttcgagcttatgaagtcccaaaaatcaaggttactgcattgagattcacggaaacagctagagctaggattgagaaggctggaggagaatgtttgacctttgatcagcttgctctcagagcccctcttgggcagaacactgttttgcttaggggtccaaagaactcaagggaggccgttaagcactttggtaaagcacctggtgtcccacacagccacacaaagccttatgttcgcgcaaagggaaggaagtttgagcgagcaagaggaaagagaaatagcagaggctacaaggcttgaggaagtgctggtgtttgaatgcacattgatagagtttctattagaagtatttgccaacctacttttaccattaatagtatcttgttggattttcttatttcaactctgtttctcttacacactccagcatcatattgctgatttttgaatgtgttatctgttttgcaaaattaatctctatttagagactgaatctttacaac

SEQ ID NO: 4417 - DNA, 719 bp, Triphysaria pusilla
  misc_feature (21)..(21): n is a, c, g, or t
  misc_feature (34)..(34): n is a, c, g, or t
  misc_feature (40)..(40): n is a, c, g, or t
caagagcagcttcagaaagcngctggagcagcancagacnccgtagccatgggtatcgatttagtcgccggaggtaagaacaaaaagaccaagcgcaccgcccctaaatcgaatgatatttacctcaaactcatcgtgaagctgtatcggtttctggtgaggagaactgggagcagttttaatgctgttatcctgaagagattgttcatgagcaaggttaacaggcctccactatctctctcgcgtctcgtttctcacatgaagggcaaggacaaccagattgctgtgttggttggaacagttactgatgatattaggcttcaggaagaagtacctgctatcaaggttactgctcttcgattcacggagacagctagagctagaattgagaaggctggtggtgaatgcttgacgttcgaccagcttgctctcagggctcctcttggccagaacacggtgctcttgagaggttctcgtaaggctcgggaagcagtgaggcattttggagcagctcctggtgttccacacagccataccaaaccgtatgtgagagctaagggaagaaagtttgagaaggctagaggaaagagaaacagcaagggtttcagggtttgagttttttattatttgtcatcatcagaatcgatttcaggttttgttttcgtcggtcattacgtgccttagtggttatattgtcccttggttcgatatctggagta

SEQ ID NO: 4418 - DNA, 827 bp, Lactuca sativa
tctccctccccttaaatcatttgtttttgcaggtaccagcaaccgccgtcgccatgggtatcgatctcgttgcaggtggaaagagcaagaggaccaaaagaacagcccctagatccgatgatatctatctcaagcttctcgtcaagctttatcggttcctagttaggaggactggaagtaacttcaatgctgtgattctgaagaggctctttatgagcaaagtcaacaagcctccgatttctctatctcgtttgattcgtttcatgtctggaaaggaagacaagattgctgtggttgttggtacagtgactgatgatgttagggttcatgagatcccttgcatcaaggttactgctctgaggtttactgagactgctagggcaaggatcgagaaggcaggaggagaatgcttgacatttgatcagcttgctcttagagctcctcttggacagaacactgttctgcttagaggcccaaagaattgtcgtgaagcagtgaggcactttggaaaggcaccaggtgttccacacagccacaccaagccttatgtgcgatctacaggaaggaaatttgagaaggctagaggaagaagaaacagcagaggcttcagaaactaggcttttcttgaggtgtcactatttgatgattctatgtcaacttctatattgggatctttaaagttttgttatttataagcctgttagacatattcttcatgatgctttttgttattttaggcaagtttttatgggtattgttgggtgttttttttttttgaattttgagacattttcaatcatattttttggattggtgttggttgccaa

SEQ ID NO: 4419 - DNA, 1208 bp, Pinus taeda
ttcggcacgaggccgttccttttattgttcgcgaggccttggaaggaacaggaaggccgaggatttgatttcagcagcggcaacgatgggtatcgatttaattgccggtgggaagagcaagaagactaagcgtacagctcccaagagccaggatatttacctcaagctccttgtcaagctataccgttttttggtgaggagaaccaatagcagcttcaatgcagtgattttaaagaggctgttcatgagcaaaacgaacaagccgccgctatctctttctcgcctagttcgttacatgcaggaaaaggatgacaagattgcagtggttgtggggaccatcacagatgataataggatttatgaactgcctcctttgaaggtaactgctcttagattcacagagacagcgagagctcgaattttgaaagcaggaggcgagtgcttaaccttcgatcagcttgcacttcgtgcaccacttggacagaacacagtcttgttgcgtggccccaagagccatcgtgaggctgtcaagcactttggaagggcaccaggtgttccccacagccacactaaaccatatgttcgatctaagggtaggaaatttgagatggctcgtggtaggagaaacagtcgtggcttcaaggtctagagaagcaaagggatttatggtgatttttagtcttttcagtgagctttgcggatttcattagttctactattatgttgccgcaaattgtaagcagcaactctagaatatagatgtttaatgttttgtttaaaacattctcagattacatggcaaaccattgggatgagatgtctgttggtttgccatcagagcttctcttcctatgaaagggagaactgtcagttctacaacttttctcttactatgaaatgagtacttagtttttcgactttggacgctgccttaactttgtgaaagggggtcaccagttttacagtgtttgagtcgtatctaaaggattttttgagactataatgatatctattttttgatttaatgggttgctgggtttctctcatgtctaggaaatctgcagtgtttgttttattcaatggatttcattagatttagcacttttggatgtatgtaggaaataattttattgaatccttcaactaagagaagatatcgattgataattttattgttaatatttacatgagcgactatacttttcggg

SEQ ID NO: 4420 - DNA, 970 bp, Physcomitrella patens
ctggggctcgaattcattcgaaatctctcttcctctgtttcccagcccaacgctcacgctgcagcttctccagcgcgggatcggctccaccaacaaccatgggtatcgatttgaaggccggtggtcgcaacaagaagaccaaacgtacagctcccaagagcggtaacgtataccttaagcttctcgtgaagctgtacaggtttttggttcgaaggacggatgctcccttcaactccgtgatcttgaagcgtctgtttatgagtcgaacgaacagggctcccctttccatgagccggctggtgaagtacatggctggaaaggatgacaaaattgcagtgttggttgggacgatcactgacgatgtgaggcagttcgaggtccctgcgctgaaggttgctgctcttcggttcacggagactgctcgcgcgcgtatcttgaaggctggaggagaatgcctgacgttcgatcagctggcgctgcgcgcaccaactggagcgaacactgtgcttttgcggggtccgaagaacgcccgcgaggcagtgaagcacttcggcgctcccggcgtgccacaaagtcacgcgaagccgtacgtccgatcgaagggacggaaatttgagaaagctcgtggtcgtcgtaatagcagaggattcaaggtctaggctcgttttgccgtgtgcggaacctgaggattatttcagggaggaacgtatggggcgtatgaggtttttggctggtacgtggatagttctatgatcttgccgtggcaggtggggtgcgtggtgcgcggttggcgtagcgttgtccctggtcatggatacggatagcgtgaatgcggaagtgtgacatgggaagcagcgacgcaagtttctaagaattgtgtgattgtgactgggtgaagggagacagtcacaggcgtacaccaatgcaagggtcggtgtgttttgagagacatttggcctgttaagtggtg

SEQ ID NO: 4421 - DNA, 609 bp, Triphysaria pusilla
gcagcttcagaaagcagctgagcagcagcacacaccgtcgccatgggtatcgatttagttgccggaggtaagaacaaaaagaccaagcgcaccgcgcctaaatctaatgatatttacctcaaactcatcgtgaagctgtatcggtttttggtgaggagaactgggagcagttttaatgctgttattcttaagagattgttcatgagtaaggttaacaggcctccgatctcactctcgcgtctcgttgctcacatgaagggcaaggacaaccaaattgctgtgttggttggaacagtcactgatgatattaggctccaagaagaagtacctgctatcaaggttactgctcttcgattcacggagacagctagagctagaattgagaaggctggtggtgaatgcttgacttttgaccagcttgctctcagggctcctcttggccagaacacggtgctcttgagaggttctcgtaaggctcgggaagcagtgaggcattttggagcagctcctggtgttccacacagccataccaaaccgtatgtgagagctaagggaagaaagtttgagaaggctagaggaaagagaaacagcaagggtttcagggtttga

SEQ ID NO: 4422 - DNA, 1231 bp, Beta vulgaris
  misc_feature (570)..(570): n is a, c, g, or t
  misc_feature (754)..(754): n is a, c, g, or t
  misc_feature (798)..(798): n is a, c, g, or t
  misc_feature (817)..(817): n is a, c, g, or t
  misc_feature (820)..(820): n is a, c, g, or t
  misc_feature (828)..(828): n is a, c, g, or t
  misc_feature (832)..(833): n is a, c, g, or t
  misc_feature (836)..(836): n is a, c, g, or t
  misc_feature (844)..(844): n is a, c, g, or t
  misc_feature (848)..(848): n is a, c, g, or t
  misc_feature (853)..(853): n is a, c, g, or t
  misc_feature (855)..(855): n is a, c, g, or t
  misc_feature (864)..(864): n is a, c, g, or t
  misc_feature (868)..(868): n is a, c, g, or t
  misc_feature (872)..(872): n is a, c, g, or t
  misc_feature (875)..(875): n is a, c, g, or t
  misc_feature (878)..(878): n is a, c, g, or t
  misc_feature (881)..(881): n is a, c, g, or t
  misc_feature (889)..(889): n is a, c, g, or t
  misc_feature (893)..(893): n is a, c, g, or t
  misc_feature (895)..(895): n is a, c, g, or t
  misc_feature (899)..(899): n is a, c, g, or t
  misc_feature (904)..(904): n is a, c, g, or t
  misc_feature (906)..(906): n is a, c, g, or t
  misc_feature (920)..(920): n is a, c, g, or t
  misc_feature (923)..(923): n is a, c, g, or t
  misc_feature (929)..(929): n is a, c, g, or t
  misc_feature (945)..(945): n is a, c, g, or t
  misc_feature (952)..(952): n is a, c, g, or t
  misc_feature (954)..(954): n is a, c, g, or t
  misc_feature (964)..(964): n is a, c, g, or t
  misc_feature (971)..(971): n is a, c, g, or t
  misc_feature (976)..(976): n is a, c, g, or t
  misc_feature (978)..(979): n is a, c, g, or t
  misc_feature (996)..(997): n is a, c, g, or t
  misc_feature (1017)..(1017): n is a, c, g, or t
  misc_feature (1055)..(1055): n is a, c, g, or t
  misc_feature (1061)..(1061): n is a, c, g, or t
  misc_feature (1065)..(1065): n is a, c, g, or t
  misc_feature (1076)..(1077): n is a, c, g, or t
  misc_feature (1085)..(1085): n is a, c, g, or t
  misc_feature (1091)..(1091): n is a, c, g, or t
  misc_feature (1102)..(1103): n is a, c, g, or t
  misc_feature (1106)..(1107): n is a, c, g, or t
  misc_feature (1112)..(1112): n is a, c, g, or t
  misc_feature (1133)..(1133): n is a, c, g, or t
  misc_feature (1141)..(1141): n is a, c, g, or t
  misc_feature (1144)..(1144): n is a, c, g, or t
  misc_feature (1158)..(1158): n is a, c, g, or t
  misc_feature (1161)..(1161): n is a, c, g, or t
  misc_feature (1166)..(1166): n is a, c, g, or t
  misc_feature (1168)..(1168): n is a, c, g, or t
  misc_feature (1186)..(1186): n is a, c, g, or t
  misc_feature (1192)..(1192): n is a, c, g, or t
  misc_feature (1195)..(1195): n is a, c, g, or t
  misc_feature (1197)..(1197): n is a, c, g, or t
  misc_feature (1204)..(1205): n is a, c, g, or t
ccataccggatcatcttcagctccccgctgcaaaaccatgggtatcgatttgaaggctggtggcaaaagcaagaaaaccaagcgcactgcgcccaaatctaacgatgtttacctaaagttactcgtcaagctctaccgtttccttgttagaagaactggtagcaagttcaatgctgtggttcttaagaggctttttatgagcaagattaacaaggctccactttctctctctaggcttgttaagtacatggagggcaaggatggaaggattgctgttttggtgggaactattacagatgatattagggtttatgaagtgcctacgatgaaggtttgtgctttgaggtttactgaaaccgccagggctcgtattgagaaaggccggtggcgagtgtatcacttttgatcagttggctttgagagctcctcttggacagaacacggttcttcttaggggtcctaagaatgctagagaggctgtcaagcactttggtaaggctcctggtgttcctcacagtcacaccaagccttatgtccgagctaatggcagaaaattcgaaagagccagangtagacgtaacagccgtggttacagagtttaagcttgaattgcggatagaagagtttgccagtgtttattgctcaagacttttgtcaatcaatgtgttaccatttggttttgtgtttcaaatatctttcttatatgttgggttagcaaaacagaatgttagttatagcaaagattgtcccgacnactatttttgtcatcacttgtggaggtaaattttgtgaagaatntttcaaaaaaaaaaaaaantcngggggggncggnnccnatccccangggngcgantnaattctggncgcntttnacnccnganggaaaacngggntnccanttaancntgaaaaatcccctnccnagtggnaaacaaaagcccaccnttccttncnaatttccccnaaggganggaantnnacctaatttgaaatccnnaattttgaaaaccttttacnaaggcaaaggaaacctttaaaaaaaaccaaaggtggtnttcttnaaancctttaaaggnncccagggnaacttngggggcccgannccnnatttnggggggaaaaaaaccaccctntttggaancanaaaaaaaaaggcgngtnacccncnccccccccgcggtgggcntttttntcnanaaaaaanntttttcaaaaaaaagaaatggcacaa

SEQ ID NO: 4423 - DNA, 841 bp, Taraxacum officinale
  misc_feature (403)..(403): n is a, c, g, or t
  misc_feature (412)..(412): n is a, c, g, or t
  misc_feature (424)..(424): n is a, c, g, or t
  misc_feature (428)..(428): n is a, c, g, or t
  misc_feature (436)..(436): n is a, c, g, or t
  misc_feature (634)..(634): n is a, c, g, or t
  misc_feature (662)..(662): n is a, c, g, or t
gctcccttacatctttctttttgcaggtaccagcaaccgccgtcgccatgggtatcgatctcgttgcaggtggaaagagcaagaggaccaaaagaaccgcccctagatccgacgatatctacctcaagcttctcgtcaagctctatcgcttcctagttaggaggaccggaagcaacttcaatgctgtgattctgaagaggctttttatgagcaaagtcaacaagcccccgatttctctatctcgtttggttcgctacatgtccggaaaggatgacaaaattgctgtggtagttggcacagttactgatgatgttagggttcatgagattccttgcatcaaagttacggctctgaggtttaccgagactgctagggcagaatcgagaaagctggtggagaatgnttgacattngaccagctggcncttngagctccncttggacagaacactgttttgcttagaggaccaaagaactgtcgtgaagcagtgaggcactttggaaaggcgccaggtgtcccacacagtcacaccaagccatatgtccgatctaagggaaggaagtttgagaaggctagaggaagaagaaacagcagaggtttcagaaactaagttgttgaggtggcactgtttgantccttgtccgctttttctatattgggancttaagttttggtcatttataaacttcgtagacaactttatttggaattgttgggtgttttgttttacaatatggagactttttcattcagatttcttggatggtgtttgaaaattttaagttagtgtttcctacgatacttgattttattgacatgatatacatcctgttgtacactg

SEQ ID NO: 4424 - DNA, 721 bp, Physcomitrella patens
agtctcttcaaaccctcaagcttctaccctgcgagatttctctccgttgttgcagccatgggtatcgacttgaaggccgggggccgcaacaagaagaccaagcgcaccgcgcccaagagtggcaatgtttatctaaagctccttgtgaagttgtaccggtttttggttagaagaacggacgctccattcaatgcagtcgtgctgaagcggctgtttatgagccgtatcaaccgacctcctatctccatgtcccgacttgtgagatatatgaagggcaaggaagacaagattgccgttatagtcgggtcagtcactgacgacaccaggatctatgaagtcccagctttgaaggtggcagctctccgcttcaccgaaactgcccgcgctcgcatcttgaagaacggaggagaggttttgacctttgatcagcttgcactgagagctccaaccggatccaactgtgtgctgttgaggggaccaaagaatgctcgtgaggcggtgaagcacttcggagcacctggtgtaccacgtagtcacgccaagccctacgtgcgttccaagggccgcaagtttgagaaggctcgtggtcgtcgtaacagcagagggtttaaggtttaaacaatgctctttctgtgatagaagaagttacttcttcacacgcttgtgtacgttgaattttaattgattcaaaccccattgcacgccctattttatgtcaaaa

SEQ ID NO: 4425 - DNA, 819 bp, Physcomitrella patens
gtcctcttctcaagccccatcgctacaacagatctgtctcccggcgggcttgtctccatcgacaaccatgggtatcgatttgaaggccggtggccgcaacaagaaaaccaagcgtaccgctcccaagagccagaatgtctacctgaagcttctcgttaagctttacaggttcttggtcaggaggactgacgctcccttcaacagtgttgtcttgaaacgtctgttcatgagtaggacgaacagggctcctctttctatgagtcgccttgtcaagtatatgactggaaaggagggcaagatcgctgtgttggttggaaccatcaccgatgatgtccgacaattcgaggtaccagcgttgaaggtatgcgcattgcgttttaccgaaactgctcgtgcccgaatcctgaaggctggtggggaatgtttgacttttgatcagcttgcgctgcgtgcaccaacagggtccaacactgtccttcttcggggtcccaagaacgctcgtgaggcagtcaagcacttcggagcacctggtgtgcctcagagtcacgctaagccctacgtgcgctctaagggacgcaagtttgagaaggctcgtggtcgtcgtaacagcagaggcttcaaggtctaaagacattgtttccgtcgtattgagtagaggagtccctccacccagattggctggagataaaattaggtttgcatacagatgttctgtgttctttcgcctgtcataccgctcttatgatatctggttggtgtactcctgtctcgaatctaatagccttcaatgcgcaaacaggaatttgcaattccaaaaaa

SEQ ID NO: 4426 - DNA, 753 bp, Arabidopsis lyrata
gggtatcgatcttatcgccggaggtaagagtaagaagacaaaaaggactgctccaaagtccgatgatgtttacctcaagcttctcgtcaagctttaccggtttttggtgaggagatctgaaagcaagttcaatgctgtgattctaaagaggcttttcatgagcaaagtcaacaaagctcctctttcactctctaggcttgtggagttcatgacgggcaaggaggacaagattgctgtgttggttggaaccatcactgatgatttgagagttcatgagattcctgccattaaagttactgccttgaggttcacagagagggctagagctagaattgagaaagctgggggagagtgcttaacctttgaccagcttgcactcaaagctccattgggccagaacacagttctccttagaggaccaaagaactctcgtgaagcagtgaagcattttggacctgctcctggtgtgccacacagtagcactaagccatatgttaggcataagggaaggaagtttgagaaagctagaggaaagcgaaagagtcgtggattcaaggtctaagataactttgttgtgtttcgttttgcttggtttcagtatcgaagttttggtagggaacactggttcctctttgccctgttccagacattgttttaagttctgtttctcttcttaagactattggatattttgctttgtcttttaatcttactactactagcctctttgagacttgtctagaattcggtttg

SEQ ID NO: 4427 - DNA, 764 bp, Brassica napus
gtcttcctccgtaacagacgccatgggtatcgatcttatcgccggaggtaagagcaagaagaccaaaaggacagctccaaagtccgatgatgtctacctcaagcttctcgtcaagctgtaccggtttttggtgaggagaaccggaagcaagttcgatgctgtgatccttaagaggctttttatgagcaaagtgaacaaggctcctctttcactctccaagctcgttgagttcatgaagggcaaggatggtaagattgctgtgttggttgggaccatcactgatgatttgagagtgcatgagattcctgccatgaaggttactgccttgaggtttacggagagggctagggctaggattgagaaagctggtggtgagtgcttgacctttgaccagcttgctctcgttgctccattgggacagaacacggttctccttagaggaccaaagaactctcgtgaagcggtgaagcactttggtaaagcacctggtgtgccacacagccacaccaagccttatgttagggctaagggaaggaagtttgagaaagctagaggaaagcgaaagagtcgtggtttcaaggtctaaggttgttgcgaggttgttgttgcttccttatggttgctgctttcagaatcgtaatttttgtagaccactcttgttactcatttgctttttgcagacattgttttgagttttccgtctttctgttctaatcgacaattgaatgttttgcttgttaactgtttaagaatttgcttaatgc

SEQ ID NO: 4428 - DNA, 736 bp, Brassica napus
gtaacagacgccatgggtatcgatcttatcgccggaggtaagagcaagaagaccaaaaggacagctccaaagtccgatgatgtctacctcaagcttctcgtcaagctataccggtttttggtaatgagaaccggaagcaagttcgatgctgtgatcctcaagaggcttttcatgagcaaagtcaacaaggctcctctttcactctccaagctcgttgagttcatgaacggcaaggatggtaagattgctgtgttggttgggacaatcactgatgatctgagagtgcatgagattcctgcaatgaaggttactgccttgaggtttacggagcgagctagggctaggattgagaaagctggtggagagtgcttgacctttgaccagcttgctcttgttgctccattgggacagaacacggttcttcttagaggaccgaagaactctcgtgaggcagtgaagcactttggtccagctcctggtgtgccacacagccactccaagccttatgttaggtctaagggaaggaagtttgagaaagctagaggaaagcgaaagagtcgtggtttcaaggtctaagaaatatctctgttgtttcgttatggttggtttcataatcgaaattttcttagagaactcgtgttcctcttcccctcttgcagacaatgttttaagctttttgttttattatgttctactcgacatttaaatgttttgcttaagaatttacttattccaa

SEQ ID NO: 4429 - DNA, 791 bp, Ipomoea batatas
agctgcagtagcaatgggtatagatttggtcgccggcggcaaaagcaagcagaccaaacgcacgtccccgaagtccgacgatgtctatctcaagctgctcgttaagttgtatcgatttctggtgaggagaacggagagcaagtttaatgctgcgatactgaagaggctgtttatgagcaaaatcaacaaggctccactgtctctctccaggttgattcaattcatgcaaggaaaggaggataagattgctgttcttgttgggacagtgactgatgatactagggcttatgaagtgcccaaaatgaaagtggttgcactgagattcactgagacagcaagagctagaattgagaaagctgggggtgagtgcttgacttttgatcagcttgctctccgaactcctcttggccagaacacggtgcttctacggggccctataaactcccgtgaggccgtgaagcactttggcagagctcctggagtgccacacagccataccaagccctatgttaggtccaagggcagaaaatttgagagagccaggggaaagagaaatagcagaggctataaaatttaggtattttaaattgcttagttcttcagctgtaagtgctgatatttaaattttgtcatcatccgagggatgattattctgtgtaatgtgagtgataggtttggacagtttagtcataaacccgtagttcctttccaaatcagactgtctttgaagtttatacatgatttgatacacccttttaaattttatttatagtatagtattatgttttgac

SEQ ID NO: 4430 - DNA, 896 bp, Orobanche aegyptiaca
gaacttaaaggaacgaacggaacttacaagaaagacaaggacacagggagccatgggtattgatttggtcgccggaggtaagagcaagaagacgaagcgcacggcgcctaaatcggacgacatctacctcaatctcctcgtcaagttgtaccggtttttggtgaggaggaccgggagcaagttcaatgaggtgattcttaagcgtttgttcatgagtaaggtcaacaaacctccggtatcactctccaagctcacagctctcatgaagggcaaggaggataagattgcagtgattgttgggactgttactgatgacattcgggtgcatgaaatccctgccattaaagttactgctctgaggttcacagaaacagcaagggctaggatcgaaaaggccggtggagaatgtttgacttttgaccagcttgcacttaaagcccctcttggacagaacacggttctcttgagagggtctccgaaggctcgtgaagcagtgaagcattttggtccagctcccggtgttccacacagccacacgaaaccttacgtgagatctaagggaaggaagtttgagaaggctagaggaagaagaaacagcaagggtttcagggtttagagttatcatgtcgtaaaacccgactccaaatgttatatttcttgtcgatttcagagagatttttgccccccgttagttattactattatatactgtcttgccacgatttttgttgttcaaactgtttttggatgcaatttttatttgtagctcacaagtacaattcaaaatttgatgttctagcttgggtttattattaattctgtttttcacagaagactttttggtctgtgtttcaattgcgacgatgaatcgtgttatggaagtttgatttttgttc

SEQ ID NO: 4431 - DNA, 720 bp, Physcomitrella patens
agtctcttcaaaccctcaagcttctaccctgcgagatttctctccgttgttgcagccatgggtatcgacttgaaggccgggggccgcaacaagaagaccaagcgcaccgcgcccaagagtggcaatgtttatctaaagctccttgtgaagttgtaccggtttttggttagaagaacggacgctccattcaatgcagtcgtgctgaagcggctgtttatgagccgtatcaaccgacctcctatctccatgtcccgacttgtgagatatatgaagggcaaggaagacaagattgccgttatagtcgggtcagtcactgacgacaccaggatctatgaagtcccagctttgaaggtggcagctctccgcttcaccgaaactgcccgcgctcgcatcttgaagaacggaggagaggttttgacctttgatcagcttgcactgagagctccaaccggatccaactgtgtgctgttgaggggaccaaagaatgctcgtgaggcggtgaagcacttcggagcacctggtgtaccacgtagtcacgccaagccctacgtgcgttccaagggccgcaagtttgagaaggctcgtggtcgtcgtaacagcagagggtttaaggtttaaacaatgctctttctgtgatagaagaagttacttcttcacacgcttgtgtacgttgaattttaattgattcaaaccccattgcacgccctattttatgtcatt

SEQ ID NO: 4432 - DNA, 865 bp, Physcomitrella patens
gtcctcttctcaagccccatcgctacaacagatctgtctcccggcgggcttgtctccatcgacaaccatgggtatcgatttgaaggccggtggccgcaacaagaaaaccaagcgtaccgctcccaagagccagaatgtctacctgaagcttctcgttaagctttacaggttcttggtcaggaggactgacgctcccttcaacagtgttgtcttgaaacgtctgttcatgagtaggacgaacagggctcctctttctatgagtcgccttgtcaagtatatgactggaaaggagggcaagatcgctgtgttggttggaaccatcaccgatgatgtccgacaattcgaggtaccagcgttgaaggtatgcgcattgcgttttaccgaaactgctcgtgcccgaatcctgaaggctggtggggaatgtttgacttttgatcagcttgcgctgcgtgcaccaacagggtccaacactgtccttcttcggggtcccaagaacgctcgtgaggcagtcaagcacttcggagcacctggtgtgcctcagagtcacgctaagccctacgtgcgctctaagggacgcaagtttgagaaggctcgtggtcgtcgtaacagcagaggcttcaaggtctaaagacattgtttccgtcgtattgagtagaggagtccctccacccagattggctggagataaaattaggtttgcatacagatgttctgtgttctttcgcctgtcataccgctcttatgatatctggttggtgtactcctgtctcgaatctaatagccttcaatgcgcaaacaggaatttgcaattccacttgggctccagttttccttagcccattgggcccttttctcttgcaaaagt

SEQ ID NO: 4433 - DNA, 738 bp, Cajanus cajan
gcggggctagcacccttgcatcgcttggtgacggcagtagcaagaaactccattcacaatgggtatcgatttgaaggcaggaggtaagtccaagaagaccaagcgcaccgctcccaaatccgatgacatctacctcaaactcgccgtcaagctgtaccgttttcttgttcggaggacttcgagtaatttcaacgccgtcatcctcaagcgccttttcatgagcaaggtcaacaagcctccgctatcgctctctaggttgatccgttacatgaaggggaaggaggacaagattgctgtggttgttggggctgtgaccgatgacattcgtgcgtacgaggttcctgcgctgaaggtaactgccctgaggttcactaaaactgccagagctagaattctgaaggctggtggggaatgtatctcctttgaggaactggctcttagagctccacttggccagaacacggttcttcttagaggtcctaagaatgcccgtgaggctgtcaagcacttcggaccagctcctggtgtgccccatagtcacaccaagccctatgtccgtgcaaagggaaggaaatttgaacgggccagaggaagaaggaatagcagaggctttagagtttgagcactggaactcaaacatgaaggaattttccttttaccatatgatcattaagcattgttttctcgtgtttttggaacaatttgttaatgttagtttaattttccttttgaaaggga

SEQ ID NO: 4434 - DNA, 870 bp, Tragopogon dubius
ccggctgtttttcataaaccctagcgtcatccccccatccaccttaacgccatttcttttttgcaggtttcagcaaccgccgtccccatgggtatcgatcttgttgcaggtggaaagagcaagaggaccaaaagaaccgcccctagatccgatgatatctacctcaagcttctcgtcaagttatatcggttcttagttaggaggacaggaagcaacttcaatgccgtgattctgaagaggctctttatgagcaaagtcaacaagccaccaatttctctttctcgtttgattcgatacatgtctggcaaggacgacaagattgctgtggttgttggtacagtcactgatgatgttagagtggatgagatcccgtgcatcaaggttactgctttgaggtttactgagactgcaagggcaagaattgagaaagctggtggagaatgcttgacctttgaccagcttgctcttagagctcctcttggacagaacactgttctgcttagaggcccaaagaattgccgtgaagcagtgaggcactttggaaaggcaccgggtgtgccacacagtcacaccaagccctatgtgcgatccaaggggaggaaatttgagaaggctagaggaagaagaaacagcagaggtttcagaaactaagctttcctcaatgttcatgaggtgggtctctttgaattcatgtcaacttttatatctggattttaaattttggtcttttatgaacctgttagacatacttgttatgatgttagcaatctttttttatattgatgggtgttttgatcttgaaacatttttattccgtttgaaatttagtgttgccatgtatgatttaatggttttgtcttggtagtttca

SEQ ID NO: 4435 - DNA, 745 bp, Tragopogon dubius
caggatgcagccagcctcgacgctgtgatgggtatcgatcttgttgccggtgggaagagcaagagaactaaaagaaccgcccctagatccgatgatatctacctgaagttgctcgtcaagctgtaccggtttttggtaaggaggacaggaagcaactttaatgcagtgatactgaagaggctgttcatgagcaaagtcaacaagcctccaatttctctttctcgtctgattcgttacatgtctggcaaggattcgaagattggtgtgatagtgggaacagttacagatgatgttagagtggatgaaatcccgtgtatgaaggtaacagctctgaggtttacggagactgctagggcaaggattgagaaggcaggtggagagtgtttgacatttgaccagctggctcttcgggctcctctcggacagaacacggtccttcttagaggtccaaagaattgtcgtgaagctgtgaggcactttggtaaggctcctggtgtaccccacagccacaccaagccgtatgtcagatcaacgggaagaaaattcgagaaggctagaggtagaagaaacagcaggggttttagaaactaaccccctaaccctttatccaattgttattcccagattcttaaacctttacttctttcttgttttgaaaattttgctgttaacatccaatcatttgttgagtaatcaagttggaggtttagaccaaatattttttattcaactagcttgttttcta

SEQ ID NO: 4436 - DNA, 567 bp, Brassica juncea
ccatgggtatcgatcttatcgcgggaggtaagagcaagaagaccaaaaggactgctccaaagtccgatgatgtctacctcaagcttctcgtcaagctataccggtttttggtaaggagaaccggcagcaagttcgatgctgtgatccttaagaggctttttatgagcaaagtcaacaaagctcctctttcactctccaagctcgtggagttcatgaacggcaaggatggtaagattgctgtgttggttgggacaatcactgatgatttgagagtgcatgagattcctgccatgaaggttactgccttgaggtttacggagagggctagggctaggattgagaaagctggtggtgagtgcttgacctttgaccagcttgctctcgttgctccattgggacagaacacggttctccttagaggaccaaagaactctcgtgaagcggtgaagcactttggtaaagcacctggtgtgccacacagccacaccaagccttatgttagggccaagggaaggaagtttgagaaagctagaggaaagcgaaagagtcgtggtttcaaggtctaag

SEQ ID NO: 4437 - DNA, 827 bp, Brassica oleracea
tcgacagcacaagccatgggtatcgatcttatcgcgggaggtaagagcaagaagaccaaaaggactgctccaaagtccgatgatgtctacctcaagcttctcgtcaagctataccggtttttggtaaggagaaccggcagcaagttcgatgctgtgatccttaagaggctttttatgagcaaagtcaacaaagcccctctttcactctccaagctcgttgagttcatgaagggaaaggatggtaagattgctgtgttggttgggacaataactgacgatttgagagtgcatgagattcctgccatgaaggttactgccttgaggtttacagagagagccagggctaggatcgagaaagctggtggagagtgcttaacattcgaccagcttgctctcgttgctccattgggacagaacacggttctacttagaggaccaaagaactctcgtgaagcagtgaagcactttggtcttgctcctggtgtgccacacagccactccaagccctatgttaggtctaagggaaggaagtttgagaaagccagaggaaagcgaaagagtcgtggattcaaggtctaagaagaggtctctgctgtttcgacgggggtgttatttcgttatggttgctttcagtatagcagttttgctagtgaactcgtgtgttcctcttttcctattccagacattgttttaagttatctgtctttccgttctaaacgacaattaaatgttttgcttaataacattttgagaatttactgccgctaagctttgtttgatatttgtcttagagtcatgagaattacatatgatatttgtgttgtttc

SEQ ID NO: 4438 - DNA, 773 bp, Brassica oleracea
gtcttcctccgtaacagacgccatgggtatcgatctcatcgccggaggtaagagcaagaagaccaaaaggacagctccaaagtccgatgatgtctacctcaagcttctcgtcaagctgtaccggtttttggtaaggagaaccggaagcaagttcgatgctgtgatccttaagaggcttttcatgagcaaagtgaacaaggctcctctttcactctccaagctcgttgagttcatgaagggcaaggatggtaagattgctgtgttggttgggactatcactgatgatttgagagtgcatgagattcctgcgatgaaggttactgccttgaggtttacggagagggctagggctaggattgagaaagctggtggagagtgcttaaccttcgaccagcttgctctcgttgctccattgggacagaacacggttctccttagaggaccgaagaactcacgtgaagcagtgaagcactttggtaaagcacctggtgtgccacacagccacaccaagccttatgttagggctaagggaaggaagtttgagaaagctagaggaaagcgaaagagtcgtggtttcaaggtctaaggttgtttcgaggttgttgttgtttccttatggttgctgctttcagaatcgaaattcttgtagaccactcttgttactcatttgctttttgcagacattgttttgagttttctgtctttctgttctaatcgacaattgaatgttttgcttgatagctgtttaagaagttgcctaatgcttgataact

SEQ ID NO: 4439 - DNA, 737 bp, Brassica rapa
  misc_feature (523)..(523): n is a, c, g, or t
ttcctccgtaacagacgccatgggtatcgatcttatcgccggaggtaagagcaagaagaccaaaaggactgctccaaagtccgatgatgtctacctcaagcttctcgtcaagctgtaccggtttttggtaaggagaaccggaagcaagttcgatgctgtgatccttaagaggctttttatgagcaaagtgaacaaggctcctctttcactctccaagctcgttgagttcatgaagggcaaggatggtaagattgctgtgttggttgggaccatcactgatgatttgagagtgcatgagattcctgccatgaaggttactgccttgaggtttacggagagggctagggctaggattgagaaagctggtggtgagtgcttgacctttgaccagcttgctctcgttgctccattgggacagaacacggttctccttagaggaccaaagaactctcgtgaagcggtgaagcactttggtaaagcacctggtgtgccacacagccacaccaagccttatgttagggcnaagggaaggaagtttgagaaagctagaggaaagcgaaagagtcgtggtttcaaggtctaaggttgttgcgagggttgttgttgcttccttatggttgctgctttcagaatcgtaatttttgtagaccactcttgttactcatttgctttttgcagacattgttttgagttttccgtctttctgttctaatcgacaattgaatgttttgcttgat

SEQ ID NO: 4440 - DNA, 764 bp, Brassica rapa
  misc_feature (99)..(99): n is a, c, g, or t
  misc_feature (695)..(695): n is a, c, g, or t
gccatgggtatcgatcttatcgccggaggtaagagcaagaagaccaaaaggactgctccaaagtccgatgatgtctacctcaagcttctcgtcaagctntaccggtttttggtaaggagaaccggaagcaagttcgatgctgtgatccttaagaggcttttcatgagcaaagtgaacaaggctcctctttcactctccaagctcgttgagttcatgaagggcaaggatggtaagattgctgtgttggttgggaccatcactgatgatttgagagtgcatgagattcctgcgatgaaggttactgccttgaggtttacggagagggctagggctaggattgagaaagctggtggtgagtgcttgacctttgaccagcttgctctcgttgctccattgggacagaacacggttctccttagaggaccaaagaactctcgtgaagcggtgaagcactttggtaaagcacctggtgtgccacacagccacaccaagccttatgttagggctaagggaaggaagtttgagaaagctagaggaaagcgaaagagtcgtggtttcaaggtctaaggttgtttcgaggttgttgttgttgcttccttatggttgctgctttcagaatcgtaatttttgtagaccactcttgttactcatttgctttttgcagacattgttttgagttttccgtctttctgttntaatcgacaattgaatgttttgcttgataactgtttaagactttgcttaatgcttgataactgtctttt

SEQ ID NO: 4441 - DNA, 807 bp, Brassica rapa
gtggttttcttccgtcgacagcacaagccatgggtatcgatcttatcgcgggaggtaagagcaagaagaccaaaaggactgctccaaagtccgatgatgtctacctcaagcttctcgtcaagctatacaggttcttggtaaggagaaccgggagcaagttcgacgctgtgatccttaagaggctttttatgagcaaagttaacaaagctcctctttcactctccaagctcgtcgagttcatgaagggcaaggatggtaagattgctgtgttggttgggacaataactgacgatttgagagtgcatgagattcctgccatgaaggttactgccttgaggtttacggagagggctagggctaggattgagaaagctggtggagagtgcttaacattcgaccagcttgctctcgttgctccattgggacagaacacggttcttctaagaggtccaaagaactctcgtgaagcagtgaagcactttggtccagctcctggtgtgccgcacagtcactccaagccctatgttagggctaagggaaggaagtttgagaaagctagaggaaagcgaaagagtcgtggattcaaggtctaagaagagtctctgctgtttcgacggtgttatttcgttatagcaattttgctagtgaactcgtgttccgctttgcttattccagacattgttttaagttatctatctttccgttctaaacgacaattaaatgttttgcttaatttaagaattttctggcaccaagcttcgattgatatttgtctaagccatgagaattacatgtgatctttttagt

SEQ ID NO: 4442 - DNA, 785 bp, Brassica rapa
gctctctccgttgcagacactcgacagctcacgccatgggtatcgatcttatcgcgggaggtaagagcaagaagaccaaaaggactgctccaaagtccgatgatgtctacctcaagcttctcgtcaagctgtaccggtttttggttaggcgaaccgggagcaagttcgatgctgtgatccttaagaggcttttcatgagtaaagtcaacaaggctcctctttcactctccaagctcgtggagtttatgaagggcaaggatggtaagattgctgtgttggttgggactattactgatgatttgagagtgcatgagatccctgcaatgaaggttactgccttgaggtttacggagagggctagggctaggattgagaaagctggtggtgagtgcttgacttttgatcagcttgctctcgttgctccattgggacagaacacggttctacttagaggaccaaagaactcgcgtgaagcagtgaagcactttggtccagctcctggtgtgccgcacagtcactccaagccctatgtgagggctaagggaaggaagtttgagaaggctagaggaaagcgaaagagtcgtggtttcaaggtctaagaaatatctctgttgtttcgttatggttggtttcataatcgaaattttcttagagaactcgtgttcctcttcccctcttgcagacaatgttttaagctttttgtttttattatgttctactcgacatttaaatgttttgcttaagaatttacttattccaaagagtcttttcagatcgtttagtgc

SEQ ID NO: 4443 - DNA, 812 bp, Brassica napus
gattgataaaccctagctgcagttccgtcttcctccgtaacagacgccatgggtatcgatcttatcgccggaggtaagagcaagaagaccaaaaggacagctccaaagtccgatgatgtctacctcaagcttctcgtcaagctgtaccggtttttggtgaggagaaccggaagcaagttcgatgctgtgatccttaagaggctttttatgagcaaagtgaacaaggctcctctttcactctccaagctcgttgagttcatgaagggcaaggatggtaagattgctgtgttggttgggaccatcactgatgatttgagagtgcatgagattcctgccatgaaggttactgccttgaggtttacggagagggctagggctaggattgagaaagctggtggtgagtgcttgacctttgaccagcttgctctcgttgctccattgggacagaacacggttctccttagaggaccaaagaactctcgtgaagcggtgaagcactttggtaaagcacctggtgtgccacacagccacaccaagccttatgttagggctaagggaaggaagtttgagaaagctagaggaaagcgaaagagtcgtggtttcaaggtctaaggttgttgcgaggttgttgttgcttccttatggttgctgctttcagaatcgtaatttttgtagaccactcttgttactcatttgctttttgcagacattgttttgagttttccgtctttctgttctaatcgacaattgaatgttttgcttgttaactgtttaagaatttgcttaatgcttgataactgtcttttagcacc

SEQ ID NO: 4444 - DNA, 768 bp, Brassica napus
ggctctccgttgcagacactcgacagctcacgccatgggtatcgatcttatcgcgggaggtaagagcaagaagaccaaaaggacagcgccaaagtctgatgatgtctacctcaagcttctcgtcaagctgtaccggtttttggttaggagaaccggaagcaagttcgatgctgtgatccttaagaggcttttcatgagtaaagtcaacaaggctcctctttcactatccaagctcgtggagtttatgaagggcaaggatggtaagattgctgtgttggttgggactattactgatgatttgagagtgcatgagattcctgcaatgaaggttactgccttgaggtttacagagagggctagggctaggattgagaaagctggtggagagtgcttgacttttgatcagcttgctctcgttgctccactgggacagaacacggttctacttagaggaccaaagaactcgcgtgaagcagtgaagcactttggtccagctcctggtgtgccgcacagtcactccaagccctatgtgagggctaagggaaggaagtttgagaaggctagaggaaagcgaaagagtcgtggtttcaaggtctaagaaatatctctgttgtttcgttatggttggtttcatgatcgaaattttcgtagagaactcgtgttcctcttcatttcttgcagacaatgttttaagttttttgtctttattatgttctactcgacatttaaatgttttgcgtaagaatttacttattccaaagagtcttt

SEQ ID NO: 4445 - DNA, 773 bp, Brassica napus
ctctccgttgcagacactcgacagctcacgccatgggtatcgatcttatcgcgggaggtaagagcaagaagaccaaaaggacagcgccaaagtctgatgatgtctacctcaagcttctcgtcaagctgtaccggtttttggttaggagaaccggaagcaagttcgatgctgtgatccttaagaggcttttcatgagtaaagtcaacaaggctcctctttcactatccaagctcgtggagtttatgaagggcaaggatggtaagattgctgtgttggttgggactattactgatgatttgagagtgcatgagattcctgcaatgaaggttactgccttgaggtttacagagagggctagggctaggattgagaaagctggtggagagtgcttgacttttgatcagcttgctctcgttgctccactgggacagaacacggttctacttagaggaccaaagaactcgcgtgaagcagtgaagcactttggtccagctcctggtgtgccgcacagtcactccaagccctatgtgagggctaagggaaggaagtttgagaaggctagaggaaagcgaaagagtcgtggtttcaaggtctaagaaatatctctgttgtttcgttatggttggtttcatgatcgaaattttcgtagagaactcgtgttcctcttcatttcttgcagacaatgttttaagttttttgtctttattatgttctactcgacatttaaatgttttgcgtaagaatttacttattccaaagagtcttttcagatc

SEQ ID NO: 4446 - DNA, 843 bp, Brassica napus
cttggtacgcacgcaggtaccggttccggattcccgcgtcgacccacgcgtccggcacaagccatgggtatcgatcttatcgcgggaggtaagagcaagaagaccaaaaggactgctccaaagtccgatgatgtctacctcaagcttctcgtcaagctatacaggttcttggtaaggagaaccgggagcaagttcgacgctgtgatccttaagaggctttttatgagcaaagttaacaaagctcctctttcactctccaagctcgtcgagttcatgaagggcaaggatggtaagattgctgtgttggttggaacaataactgacgatttgagagtgcatgagattcctgccatgaaggttactgccttgaggtttacggagagggctagggctaggattgagaaagctggtggggagtgcttaacgttcgaccagcttgctctcgttgctccattgggacagaacacggttcttctaagaggtccaaagaactctcgtgaagcagtgaagcactttggtccagctcctggtgtgccgcacagtcactccaagccctatgttagggctaagggaaggaagtttgagaaagctagaggaaagcgaaagagtcgtggattcaaggtctaagaagagtctgctgtttcgacggtgttatttcgttatagcaattttgctagtgaactcgtgttccgctttgcttattccagacattgttttaagttatctatctttccgttctaaacgacaattaaatgttttgcttaatttaagaattttctggcaccaagcttcgattgatatttgtctaagccatgagaattacatgtgatctttttagtaaaa

SEQ ID NO: 4447 - DNA, 821 bp, Brassica napus
ggttttcttccgtcgacagcacaagccatgggtatcgatcttatcgcgggaggtaagagcaagaagaccaaaaggactgctccaaagtccgatgatgtctacctcaagcttctcgtcaagctatacaggttcttggtaaggagaaccgggagcaagttcgacgctgtgatccttaagaggctttttatgagcaaagttaacaaagctcctctttcactctccaagctcgtcgagttcatgaagggcaaggatggtaagattgctgtgttggttggaacaataactgacgatttgagagtgcatgagattcctgccatgaaggttactgccttgaggtttacggagagggctagggctaggattgagaaagctggtggggagtgcttaacgttcgaccagcttgctctcgttgctccattgggacagaacacggttcttctaagaggtccaaagaactctcgtgaagcagtgaagcactttggtccagctcctggtgtgccgcacagtcactccaagccctatgttagggctaagggaaggaagtttgagaaagctagaggaaagcgaaagagtcgtggattcaaggtctaagaagagtctgctgtttcgacggtgttatttcgttatagcaattttgctagtgaactcgtgttccgctttgcttattccagacattgttttaagttatctatctttccgttctaaacgacaattaaatgttttgcttaatttaagaattttctggcaccaagcttcgattgatatttgtctaagccatgagaattacatgtgatctttttagtaaaatctccacatatgct

SEQ ID NO: 4448 - DNA, 800 bp, Brassica napus
ggataaaccctagcttcagttccgtcttcctccgtaacagacgccatgggtatcgatctcatcgccggaggtaagagcaagaagaccaaaaggacagctccaaagtccgatgatgtctacctcaagcttctcgtcaagctgtaccggtttttggtaaggagaaccggaagcaagttcgatgctgtgatccttaagaggcttttcatgagcaaagtgaacaaggctcctctttcactctccaagctcgttgagttcatgaagggcaaggatggtaagattgctgtgttggttgggactatcactgatgatttgagagtgcatgagattcctgcgatgaaggttactgccttgaggtttacggagagggctagggctaggattgagaaagctggtggagagtgcttaaccttcgaccagcttgctctcgttgctccattgggacagaacacggttctccttagaggaccgaagaactcacgtgaagcagtgaagcactttggtaaagcacctggtgtgccacacagccacaccaagccttatgttagggctaagggaaggaagtttgagaaagctagaggaaagcgaaagagtcgtggtttcaaggtctaaggttgtttcgaggttgttgttgtttccttatggttgctgctttcagaatcgaaattcttgtagaccactcttgttactcatttgctttttgcagacattgttttgagttttctgtctttctgttctaatcgacaattgaatgttttgcttgatagctgtttaagaagttgcctaatgcttgataactgtct

SEQ ID NO: 4449 - DNA, 784 bp, Brassica napus
acggccgggggtcgacagcacaagccatgggtatcgatcttatcgcgggaggtaagagcaagaagaccaaaaggactgctccaaagtccgatgatgtctacctcaagcttctcgtcaagctataccggtttttggtaaggagaaccggcagcaagttcgatgctgtgatccttaagaggctttttatgagcaaagtcaacaaagcccctctttcactctccaagctcgttgagttcatgaagggaaaggatggtaagattgctgtgttggttgggacaataactgacgatttgagagtgcatgagattcctgccatgaaggttactgccttgaggtttacagagagggctagggctaggatcgagaaagctggtggagagtgcttaacattcgaccagcttgctctcgttgctccgttgggacagaacacggttctacttagaggaccaaagaactctcgtgaagcagtgaagcactttggtcttgctcctggtgtgccacacagccactccaagccctatgttaggtctaagggaaggaagtttgagaaagccagaggaaagcgaaagagtcgtggtttcaaggtctaagaagaggtctctactgtttcgacggggtgttatttcgttatggttgctttcagtatagcagttttgctagtgaactcatgtgttcctcttttcctattccagacattgttttatctgtcttttcgtcctaaacgacaattaaatgttttgcttaataacattttgagaatttactgccgctaagctttgtttga

SEQ ID NO: 4450 - DNA, 786 bp, Brassica napus
gggtcgacagcacaagccatgggtatcgatcttatcgcgggaggtaagagcaagaagaccaaaaggactgctccaaagtccgatgatgtctacctcaagcttctcgtcaagctataccggtttttggtaaggagaaccggcagcaagttcgatgctgtgatccttaagaggctttttatgagcaaagtcaacaaagcccctctttcactctccaagctcgttgagttcatgaagggaaaggatggtaagattgctgtgttggttgggacaataactgacgatttgagagtgcatgagattcctgccatgaaggttactgccttgaggtttacagagagggctagggctaggatcgagaaagctggtggagagtgcttaacattcgaccagcttgctctcgttgctccgttgggacagaacacggttctacttagaggaccaaagaactctcgtgaagcagtgaagcactttggtcttgctcctggtgtgccacacagccactccaagccctatgttaggtctaagggaaggaagtttgagaaagccagaggaaagcgaaagagtcgtggtttcaaggtctaagaagaggtctctactgtttcgacggggtgttatttcgttatggttgctttcagtatagcagttttgctagtgaactcatgtgttcctcttttcctattccagacattgttttatctgtcttttcgtcctaaacgacaattaaatgttttgcttaataacattttgagaatttactgccgctaagctttgtttgatatttgtctt

SEQ ID NO: 4451 - DNA, 780 bp, Centaurea maculosa
  misc_feature (57)..(57): n is a, c, g, or t
  misc_feature (80)..(80): n is a, c, g, or t
  misc_feature (264)..(264): n is a, c, g, or t
  misc_feature (282)..(282): n is a, c, g, or t
  misc_feature (285)..(285): n is a, c, g, or t
  misc_feature (300)..(300): n is a, c, g, or t
  misc_feature (375)..(375): n is a, c, g, or t
  misc_feature (393)..(393): n is a, c, g, or t
  misc_feature (426)..(426): n is a, c, g, or t
  misc_feature (492)..(492): n is a, c, g, or t
  misc_feature (495)..(495): n is a, c, g, or t
  misc_feature (498)..(498): n is a, c, g, or t
  misc_feature (531)..(531): n is a, c, g, or t
  misc_feature (536)..(536): n is a, c, g, or t
  misc_feature (568)..(568): n is a, c, g, or t
  misc_feature (602)..(603): n is a, c, g, or t
  misc_feature (617)..(617): n is a, c, g, or t
  misc_feature (672)..(672): n is a, c, g, or t
  misc_feature (704)..(704): n is a, c, g, or t
  misc_feature (706)..(706): n is a, c, g, or t
  misc_feature (720)..(720): n is a, c, g, or t
  misc_feature (730)..(730): n is a, c, g, or t
ggggcagtacacaagcagccgttcgccgccatgggtatagatctcgttgccggtggnaaaagcaagaagacgaagaggantgcacctcgatccgatgatatctacctcaagcttctagtgaagctttatcggtttttggtgaggaggactggaagtaacttcaatgcggtgatattgaagaggctttttatgagcaaagtgaacaaacctccgatttcgctatcgcggttggttcgttatatgtctggaaaggaggacaagatnggtgtgattgttgggacngtnacagatgatgtcagngtgcatgaaatcccttgtatgaaggtgactgctttgaggtttagcgagactgcaagggctaggatcgagaaagcnggcggagaatgtttgacntttgaccaacttgcccttcgagctcctcttggncagaacacggttcttcttagaggtcccaagaattcccgagaagcggtcagacactttggaaaggcnccnggngtgccacacagtcataccaagccatatgtgcgntccancggtaggaaattcgagaaggctagaggacgangaaacagcagaggcttcagaaactaatcattcannaatggtgagagttnttgaagtaatattggttaagctctataatcttgttttatgccgatgacttattgnattaagctgtgatgaaaattttggtgttagcntntttctttaatgttnatgtagcagngagttttgagttttgaattaccatccacatttcttgaatggagattgaag

SEQ ID NO: 4452 - DNA, 811 bp, Centaurea maculosa
  misc_feature (86)..(86): n is a, c, g, or t
  misc_feature (155)..(155): n is a, c, g, or t
  misc_feature (437)..(437): n is a, c, g, or t
  misc_feature (512)..(512): n is a, c, g, or t
  misc_feature (566)..(566): n is a, c, g, or t
  misc_feature (661)..(661): n is a, c, g, or t
  misc_feature (802)..(802): n is a, c, g, or t
  misc_feature (806)..(806): n is a, c, g, or t
cgcgggggctcaaaccctaaattttcatttctccactcgaactctgcacctaccctaccgccgctgccgccatgggtattgatctngttgccggtggaaagagcaagaaaaccaaaagaaacgcccctagatccgatgatatctacctgaagctnctcgtgaagctttataggtttttggtgaggaggactggaagcagctttaatgctgtgatattgaagaggctgtttatgagcaaaatcaataagcctccgatttcgctatctcgtctgattcgttacatgactggaaaggacgacaagattgcagtgattgttggcacagttaccgacgatgttagggtgcatgaaatcccctgtatgaaggtaactgcacttaggttcaccgagactgcaagggctaggatcgaaaaggcaggtggagaatgcttgacgttngatcaattggctcttcgagctcctcttggacaaaacaccgttcttcttagaggaccaaagaattgccgtgaagcngttaggcacttcggtaaggctcctggtgtgccacacagccacaccaagccctangtgcgatcaaagggaaggaaatacgagaaggctagaggtagaagaaacagcaggggattcagaaactaaagcggtctctccatcaatcgtttccnaagttttatctcgtcttctctatcagtgttgtttgcatactttctatgatgaaaattttgcttttggacctctggattatgttgaaagatgtgtttggatggttttagatattaatgttgtcttcatattcagtttttacnagcnttccc

SEQ ID NO: 4453 - DNA, 887 bp, Cichorium intybus
ggttaatatcctattagggacaagtgagataacctggtgcgcgttagaatatgatcccgggtgagattcgccaggcccatccttcccctaacatattcttttgcgtaccagcaaccgccgtctccatgggtatcgatctcgttgcaggtggaaagagcaagaggaccaaaagaaccgcccctagatccgatgatatctatctcaagcttcttgtcaagctatatcggttcctagtgaggaggacaggaagcaatttcaatgctgtgattctgaagaggctctttatgagcaaagtcaacaagcctccgatttctctatcacgtttgattcgttacatgtctggaaaggaggacaagattgctgttgttgttggtacagtcactgatgatgttagggtgcacgagatcccttgcatcaaggtcactgctctgaggtttaccgagactgctagggcaaggattgagaaggctggtggagagtgcttgacatttgaccaactggctctaagggctcctcttggacagaacacggttctgcttagaggcccaaagaattcacgtgaagcagtgaggcactttggaaaggcaccaggtgtgccacatagtcacaccaagccttatgtcaggtccactggaaggaaattcgagaaggctagaggaagaagaaacagcagaggctttagaaactaagctattgaggtgggattctttaaatccatgtcagccttttctatatcgggatcttgaaatttcgtcatctataaacctgttagacatacatgttatgatgatttttttgttaggcgacttttgtttttgttattgttgggtgttctttctgaatcttaagacattttcatttagatttctttgatggtgtttgaaatt

SEQ ID NO: 4454 - DNA, 847 bp, Cynara scolymus
  misc_feature (19)..(19): n is a, c, g, or t
  misc_feature (765)..(765): n is a, c, g, or t
cgggataccctaacttgtnttcctttcctcttcgttacacattttttttgcaggtacaagcagccgtcgccgtcatgggtatagatcttgttgctggtggaaaaagcaagaagaccaagagaactgcacctcggtctgatgatatctaccttaagcttctcgtcaagctttatcgatttttggtgaggaggacaggaagcaactttaatgcggtgatcctgaagaggctttttatgagcaaagtgaacaaaccgccaatttctctctctcgcttgattcgttacatgtctggcaaggacgacaagattgctgtgattgttggtacagtcaccgatgatgtcagggtgcatgaaatcccttgtatgaaggtcactgctttgaggtttagcgagactgcaagggctaggatcgagaaggctggcggagaatgtttgacttttgatcaacttgctctccgagctcctcttggccagaacacggttctacttagaggtccaaagaattcccgtgaagcggtgaggcactttggaaaggcacctggtgtgccacacagccatacgaagccatacgtgcgagccaatggtaggaaatttgagaaggctagaggacgaagaaacagcagaggcttcagaaactaatcattcatcatcaatggtgggagtgcttcaagtgatggttaacttctataatcttgcttttatgctgctgtctttttgaattaagatatgatgaaaattttggtgttagcatctttccttttttgtngcagggagttttgagttctaaattatcatatccacatttcttgaatggagattaaatttgatattttggttgctatttttcg

SEQ ID NO: 4455 - DNA, 771 bp, Adiantum capillus-veneris
taccgctagggtctttttggtggcacatttgcgctcgtgcgaaccatgggtattgacttgcctgctggtgggcgcaacaagaagacaaagcgtactgcacctaaaagtgacaatgtctatttgaagcttgttgtgaagctatacaggtttttggtaaggaggaccggcagtcctttcaacgcagttgtcctcaagcgtttgttcatgagtagaaccaataggccccccctttcgttatctcgactgacacgatatatgaaggacaaggaagataaaattggtgtggtcgttggaactgtgacggatgatgttagactgtatgagctgcctgccttgaaaattgctgcactccgattcacagagactgcccgagctaggattttgaaagccgggggagattgcctaacattcgaccaacttgctttaaaagcaccaaccggctcaaacacggtgcttttaagaggacccaagaatgctcgcgaagctgtgaagcacttcggcagagctcctggtgtaccacacagtcacaccaagccttatgtccgctccaagggtcgtaagtttgagagggcccgtggtcgtcgtaacagcagagggtacaaggtctaaatctctaatcatgtctacctgctagagttcgagaggttttcctccggttgactagctccttggctttagagcacctgttttggaacggaaatttgtttttctagcaattgtccagcacagatgctagcagttttccaaagagatctcaaattgtctctgatg

SEQ ID NO: 4456 - DNA, 803 bp, Ipomoea nil
  misc_feature (237)..(237): n is a, c, g, or t
  misc_feature (294)..(294): n is a, c, g, or t
  misc_feature (321)..(321): n is a, c, g, or t
  misc_feature (323)..(323): n is a, c, g, or t
  misc_feature (369)..(369): n is a, c, g, or t
  misc_feature (409)..(409): n is a, c, g, or t
  misc_feature (449)..(449): n is a, c, g, or t
  misc_feature (509)..(509): n is a, c, g, or t
  misc_feature (628)..(628): n is a, c, g, or t
  misc_feature (658)..(658): n is a, c, g, or t
  misc_feature (662)..(662): n is a, c, g, or t
  misc_feature (671)..(671): n is a, c, g, or t
ggttcaggagcagctgcagtagcaatgggtatagatttggtcgccggcggcaaaagcaagcagaccaaacgcactgccccgaagtccgacgatgtctatctcaagctgctcgtcaagttgtatcgatttctggtgcggagaacggagagcaagtttaatgctgcgatactgaagaggctatttatgagcaaaaccaacaaggctccactgtctctctccaggttgattcaattcatncaaggaaaggaggataagattgctgttcttgttgggacagtgactgatgatactagngcttatgaagtgcccaaaatgaaagtngntgcactgagattcactgagacagcaagagctagaattgagaaagcngggggtgagtgcttgacttttgatcagcttgctctccganctcctcttggccagaacacggtgcttctacggggccctanaaactcccgtgaggccgtgaagcactttggcagagctcctggagtgccacacagccatancaagccctatgttaggtccaagggcagaaaatttgagagagccaggggaaagagaaatagcagaggctataaaatttaggtattttaaattgcttagttcttcagctgtaagtgctganatttaaattttgtcatcatctcgagggatnattnttctgtgtnatgtgagtgataggtttggacagtttagtcataaacccgtagttcctttccaaatcagactgtctttgaagtttatacatgatttgatacacccttttaaattttatttatagtatagtattatgttttgac

SEQ ID NO: 4457 - DNA, 771 bp, Lactuca sativa
cttcggcgggggtgttctaaccctagtcttttcaattttccccatttctgcgcaggtagcataatcctccgccgctgctatgggtatagatcttgttgccggtgggaagagcaagagaaccaaaagaaactcccccagatccgatgatatctacctgaagctccttgtcaagctctaccggtttttggtaaggaggacaggaagcaacttcaatgctgtgatactgaagaggctcttcatgagcaaagtcaacaaacccccgatatctctctctcgtctgattcgttacatgtctggaaaggatgagaagattgctgtgattgtgggcacagtgacagacgatgttagggtgcatgaaatcccttgtctaaaggtaactgcactgaggttcactgagactgcaagggcaaggattgagaacgcaggtggagaatgtttgacatttgatcagctggctcttcgagctcctcttggacagaacacggttcttcttagaggtccaaagaattcgcgagaagcggtgaggcattttggtaaggctcctggtgtaccacacagccacaccaagccttatgtgagatcaaagggaaggaaatttgagaaggccagaggtagaagaaacagcaggggatttagaaactaagtctcaccatcccatgttttgtttcccctatgttcttgattaaacctttagttcttgtttgtgtacttgctattttgacatccatcttttttttgggtaatgaagttgaaggtttggacttggatttc

SEQ ID NO: 4458 - DNA, 788 bp, Lactuca sativa
accctagtttttcaattttcccacatttctgcttaggttgcaaaatcctccgccgctgctatgggtatagatcttgttgccggtgggaagagcaagagaaccaaaagaaactcccctagatccgatgacatctacctgaagctccttgtcaagctctaccggtttttggtaaggagaacaggaagcaacttcaatgctgtgatactgaagaggctcttcatgagcaaagtcaataaacccccgatatctctctctcgtctgattcgttacatgtctggaaaggatgagaagattgctgtgattgtgggcacagtgacagacgatgttagggtgcatgaaatcccttgtatgaaggtaactgcactgaggttcactgagactgcaagggcaaggattgagaaggcaggtggagaatgtttgacatttgatcagctggcccttcgagctcctcttggacagaacacggttcttcttagaggtccaaagaattcacgagaagcggtgaggcactttggtaaggctcctggtgtaccacacagccacaccaagccttatgtgagatcaaagggaaggaagtttgagaaggccagaggtagaagaaacagcaggggatttagaaactaagtcaccattcccatgttttttttccctgtgttcttgattatatctttacttcttgtttgtgtacttgctattttgacatccatcttttttctgggtaatgaagttggagatttggacctggatttcttcaaaatgtttattgagttgaatgggtttttatgatt

SEQ ID NO: 4459 - DNA, 860 bp, Lactuca sativa
  misc_feature (20)..(20): n is a, c, g, or t
cttcggcggggctcccttanatcatttgtttttgcaggtaccagcaaccgccgtccccatgggtatcgatctcgttgcaggtggaaagagcaagaggaccaaaagaaccgcccctagatccgatgatatctatctcaagcttctcgtcaagctttatcggttcctagttaggaggacgggaagcaacttcaatgctgtgattctgaagaggctctttatgagcaaagtcaacaagcctccgatttctctatctcgtttgattcgttacatgtctggaaaggatgacaagattgctgtggttgttggtacagtgaccgatgatgttagggttcatgagatcccttgcatcaaggttactgctctgaggtttactgagactgctagggcaaggatcgagaaggcaggaggagagtgcttgacatttgatcagcttgctcttagagctcctcttggacagaacactgttctgcttagaggcccaaagaattgtcgtgaagcagtgaggcactttggaaaggcaccaggtgttccacacagccacaccaagccttatgtgcgatctaagggaaggaaatttgagaaggctagaggaagaagaaacagcagaggcttcagaaactaggcttttcttgaggtgtcactatttgatgattctatgtcaacttctatattgggatctttaaagttttgtcatttataagcctgttagacatattcttcatggtgctttttgttattttaggcaagtttttatgggtattgttgggtgttttttttttttgaattttgagacattttcaatcatattttttggattggtgttggttgcagagaacaaaaaatacaaaaaacaaaaaaaa

SEQ ID NO: 4460 - DNA, 722 bp, Nicotiana benthamiana
  misc_feature (696)..(696): n is a, c, g, or t
ggggatattcatataagagccgacccctgcagcagcagcaatttctccatcactcgttcagcggagtccccacccgatcagctatgggcatcgatttgaaggccggaggtaagagtaagaagactaagcgtactgcccctaaatctgacgatgtttacctcaagctcctcgtcaagctttaccgattcctggtaaggaggaccggaagcaagttcaatgcggtgattcttaagaggctcttcatgagcaagatcaacaagcctccactttctctctcgaggttgatttcttatgccaaaggaaaggaggataaggttgtggtgattgtgggtactattaccgacgatgttagggcttatgaagttccagcgttgaaggtttgtgctttgaggttcactaagactgccagggctaggattgagaaggctggtggcgagtgcttgacattcgatcagcttgctctcagggctccacttggccagaacacgcttctcctaaggggtcctaagaatgcgcgtgaagcagtgaagcactttggtgcagctcctggtgttccacacagccacaccaaaccatttgtgcgttctaagggcagaaagtttgagagggcccgaggaagaagaaacagcaggggttacaaggcttaggttgatttcagttattgacctcagaattgttttttatcatttgtattgntacaatacaagtttttgcagactcta

SEQ ID NO: 4461 - DNA, 905 bp, Quercus alba
catttttggtcagtcgcgccgagctgcagaactaaaaccctcatcaccagccatgggtatcgatttggtcgccggtggtaagaggaagaagaagatcaggactgccccaaaatcaaatgatatctacctcaagctcctcgtcaagctgtaccgttttctggtgcggaggaccgggagtaaattcaatgcggtgatactgaagaggcttttcatgagcaaggtcaacaagccacctctatctctctccaagttgattcgttacatggagggcaaggagggtaagattgctgtggttgttgggactgtgaccgatgacattagggtgtatgaggtcccagcagtgaaggttacagcccttaggttcacagagactgcaagagctaggatcgagaaggccggaggagaatgcttgacatttgatcagctggctctaagagctcctcttgggcagaacacggttctccttagaggtcataagaagcgtgaagctgtgaagcactttggacctgctcctggtgtgccacacagccacacaaaaccctatgtacgtgctaaaggaaggaaatttgagagggctagaggaaaaaggaacagcaagggcttcagagtttgatttgctaaacacatgcgtaaacacaattttacttaccaaatctgttcgaatggtgttgcaattgtggttccctttttatgtctttttcatcctctctatggatcagttatctctagagttttcttttgcctttcccttttttcatatggatatcttttccttttagaattaaaatcgtttggatttgaaatttttattgggtacttttttaagtatagtggttctaaaacatgattcttgaatagttttaatcttagattattctaaattatctttgagtcatgcaaataac

SEQ ID NO: 4462 - DNA, 1077 bp, Capsicum annuum
ggcacgagaaacatatcagcagcagaggcggcggtgggaagaagaatcagcagacgaagtatccatgggtatcgatctagttgccggaggtaagtcaaaaaagactaaacgcactgcgccaaaatctgatgatgtttatctcaagcttctcgtcaagctgtaccggtttcttgtacggaggactgggagcaagttcaatgcagtgatattgaagaggcttttcatgagcaagattaacaaggctccgttgtcgttgtcacgtttgattagttacatgaagggaaaggaggacaaggttgctgtaattgtcgggactgtcactgatgatattcgggcttatgaagtcccttcactcaaggttactgcattgagattcactgaaacagctagagccaggatcgagaaggctggaggagaatgtttgacctttgatcagctcgctctcagagcccctcttgggcagaacacagtattgcttaggggtccaaggaactctagggaagctgttaaacactttggtagagctcctggtgtcccaggcagtcactcaaagccttatgttcgctcaaagggaaggaagtttgaacgagcaagaggtaaaagaaacagcagaggctacaaggcttgaggaagtgcagatgtttgaatgcgcaatgatagaatttcatttagaaggtttcactacctacttttatcgtaatagtttcttgttggattttcttatttcacccttgtttctcttaaactccagcatcatatttgctgatttttggatgtgtttttttaatctggtttccggacttgaatctttcttaagagggagtgatatcttcaacattgacaacaaccttgtgctggatattgattgatgtgtgaagatcccgttcttttattgttccatgcaagttctcctttatgccatgactgaaattgaatagcgataagataagattttcatgttattagcctcgtaaaattagaagaatcaaaagattgtccgaaggaaagaatttgcaacatttgtagtagttttcctgtactagaatcactattacaatgaaagcttcttttcttatt

SEQ ID NO: 4463 - DNA, 841 bp, Capsicum annuum
cctttcagcaatctccaaaccctaccagccatgggtatcgatttgaaggccggaggtaagagtaagaagaccaaacgtactgctcctaagtccgatgatgtttaccttaagctcctcgtcaagctttaccgatttttggtgaggaggaccggaagcaaattcaatgcagtgattctcaagcgcctctttatgagcaagaccaacaaacctccactttctctctcgagattgatttcttttgccaaaggaaaggaggacaagactgttgccattgtgggtactattaccgacgatgttagggcgtatgaagttcctaagttgaaggtgtgtgccttgaggttcacaaagacagccagggcaaggattgagaaggctggtggtgagtgtttgacattcgatcagttggctctcagggctccacttggccagaacacgcttctcctcagaggtcctaagaatgcacgtgaagcagtgaagcactttggtccagctcctggtgttccgcacagccactccaagccatatgtgcgttccaagggacgaaagtttgagagagctagaggaaagagaaagagcaggggttacaaggtttaagttatctgtgtcggtggtttgtcatttgtatcgtggcagtataatttttgcagactctagtatgctgttgcttatgtttactcccttcttgttaaggatatttgatttctatctactctgaaaccaagttttagtttaaaatgactgcagtgcttcagtttatttgctttagcaaatgtcaggaattttgactaattgtattttaatacactccccatcttcatgttctgtggatttgagggtttta

SEQ ID NO: 4464 - DNA, 752 bp, Petunia hybrida
tcgagacactgttggcctactggtataagagccgtctaagcagcaaccatttttccccatctccaaaaaaaccccaaatcagccatgggtatagatctcaaagcaggaggtaagtgcaagaagaccaggcgtaccgcacctaaatctgatgatgtttacctcaaactcctcgtcaagctgtaccgattcctggtaaggaggactggtagcaagttcaatgcagtgattttgaaaaggctctttatgagtaagatcaacaaggccccactttctctatcaaggatgattaattatgctaaaggaaaggaggataaggttgttgtgatagtgggaactattaccgacgacgctagggcttatgatgtaccagcactgaaggtgtgtgctttgaggttcactaagactgctagggctaggattgagaaggctggtggtgagtgcttgacgttcgatcaacttgctcttagggctccacttggacagaacacgcttcttctcagaggtcctaagaatgcacgtgaagcagtgaagcactttggtccagctcctggtgttccacacagccataccaagccatatgtccgttccaaaggcagaaagtttgagagggctagaggaagaagaaatagcaggggttacaaggtttaaattgatatttgtattagtctcgggatggtttttaccagttgtaccgtgggcatacaagtttttgcagactctagtatgcagttgcagcatgttgcttatgttaa

SEQ ID NO: 4465 - DNA, 730 bp, Petunia hybrida
gtatcgatttgaaagcgggaggtaagtgcaagaagacaaagcgtacagcacctaagtctgatgatgtttacttgaaactcctcgtcaagctttaccgatttttggtgcggaggacgggaagcaagttcaatgcagtgattctcaagcggctctttatgagcaaaaccaacaaacctcccctatcactgtcgaggttgatatcttatactaaaggaaaggaggataagaccgccgttattgttggctctattaccgacgatgccagggcctatgaagttccaaagttgaaggtatgtgctttgaggttcacaaagactgcaagggcaaggattgagaaagctggtggtgagtgctcgacatttgatcagctggctcttagggctccacttggtcagaacacggttctcctcagaggccctaagaatgctcgtgaagctgtgaagcacttcggtccagctcctggagttccacacagccacacgaaaccgtatgtgcgttccaagggaaggaagtttgagagggctagaggaagaagaaagagcagaggttacaaggtttaagttttttcccatgatcgatcttaggtttgttgctttcatttttatggtggcaaatgcagtttttggggactactgctcaattgttgtagttgcttgtgcttctttttctcttgtttagaatattcggagttttatgaaaatttgattgcaactttttttttttccatttc

SEQ ID NO: 4466 - DNA, 753 bp, Raphanus sativus
ggggttttcctccgtaacagacgccatgggtatcgatcttatcgccggaggtaagagcaagaagaccaaaaggacagctccaaagtccgatgatgtctacctcaagcttctcgtcaagctgtaccggtttttggtaaggagaaccggaagcaagttcgatgctgtgatcctcaagaggcttttcatgagcaaagtcaacaaggctcctctttctctctccaagctcgttgagtttatgaatggcaaggatggtaagattgctgtgttggttgggacaatcactgatgatttgagagtgcacgaccttcctgccatgaaggttactgccttgaggtttaccgagagggctagggctaggattgagaaagctggtggggagtgcttgacctttgaccagctagctctcgttgctccattgggacaaaacacggttctgctaagaggacccaagaactctcgtgaggcagtgaagcactttggtccagctcctggtgtgccacacagtcactccaagccttatgttaggtctaagggaaggaagtttgagaaggctagaggaaagcgaaagagtcgtggtttcaaggtctaagaaagtcctcaaaactgttttcgaggttgttgtttccttatggttgttgctgctttcagaatcgaagtttttgtagaccccgcttttgttactttttgccttttgcagacattggtttgagttttctatctttctgttctgatcgacaattgaatgttttgctt

SEQ ID NO: 4467 - DNA, 712 bp, Raphanus sativus
  misc_feature (666)..(666): n is a, c, g, or t
gatttgatcgcaggtggtaagagcaagaagaccaaaaggacagctcccaagtccgacgatgtctacctcaagcttaccgtcaagctttacaggtttctggtgaggagaacacagagcaagttcaatgcagtgatcttgaagaggcttttcatgagcaaagtcaacaaagctcctctttctctttccaggctcgtcgaattcatgaccggcaaggaagacaagattgctgttttggttggaaccataaccgatgatttgagggtacacgagatcccagctatcaaggttactgccttgaggttcacagagagagccagagctcgcattgagaaagctggtggtgaatgcttaacctttgaccagcttgctctcagagctcctttgggacagaacactgttcttcttagaggacctaagaactcacgtgaagctgtgaagcactttggccctgctcctggtgtgccacacagtcactccaagccgtatgttcggtccaagggaaggaaattcgagaaggccagaggaaagaggaagagccgtggattcaaggtttaaggaccattgtcaccgtctttgacttgcttctcgacttttgttatagaatcttggtttttttttgtgtttgcctgtttcagacaatattttaagtttgtttcgactttgatnaactgtgttattattgcacgttatgtgctgcaccatggatacaacc

SEQ ID NO: 4468 - DNA, 750 bp, Raphanus sativus
  misc_feature (8)..(8): n is a, c, g, or t
  misc_feature (67)..(67): n is a, c, g, or t
  misc_feature (110)..(110): n is a, c, g, or t
  misc_feature (205)..(205): n is a, c, g, or t
  misc_feature (214)..(215): n is a, c, g, or t
  misc_feature (226)..(226): n is a, c, g, or t
  misc_feature (271)..(271): n is a, c, g, or t
  misc_feature (310)..(310): n is a, c, g, or t
  misc_feature (385)..(385): n is a, c, g, or t
  misc_feature (484)..(484): n is a, c, g, or t
  misc_feature (579)..(579): n is a, c, g, or t
  misc_feature (638)..(638): n is a, c, g, or t
agcacaanccatgggtatcgatcttatcgcaggaggtaagagcaagaagaccaaaaggactgctccnaagtccgatgatgtctacctcaagcttctcgtcaagctatacnggtttttggtaaggagaaccggcagcaagttcgatgctgtgatccttaagaggcttttcatgagcaaagtcaacaaagctcctctttcgctctcnaagctcgtnnagttcatgaanggcaaggatggtaagattgctgtgttggttgggacgataactgangatttgagagtgcatgagattcctgctatgaaggttacngccttgaggtttaccgagagagctagggctagaattgagaaagctggtggagagtgcttaaccttcgaccagctngctctcgttgctccgttgggtcagaacacggttctccttagaggaccaaagaactctcgtgaagcagtgaagcactttggtcctgctcctggtgtgccncacagccactccaagccctatgtcaggtctaagggaaggaagtttgagaaagctagaggaaagcgaaagagtcgtggattcaaggtctaagaagnctcttctgctgtttcgacgggtgttatattttgtgttatggttgctttcagtatagcanttttgctagtgaactcgtgttgttcctctttgcctgttccagacattgttttaagttatctgtctacttttcgttctaaacgacagttaaatgttttgcttaataacatttt

SEQ ID NO: 4469 - DNA, 771 bp, Carthamus tinctorius
  misc_feature (14)..(14): n is a, c, g, or t
cttttcatttttcnctcgctcgactctgaacctaaacgccgctgccatgggtatcgatcttgttgccggtggtaagagcaagaaaaccaaaagaaacgcccctagatccgatgatatctacctgaagctcctcgtcaagctttatcggtttttggtgaggaggactggaagcagcttcaatgctgtgatactgaagaggctgttcatgagcaaaatcaacaagcctccgatttcgctatctcgtctgattcgttacatggctggaaaggacgacaagattgcagtgattgttggcacagttacggacgatgttagggtgcatgaaatcccctgtatgaaggtaactgcactgaggttcactgagactgcaagggcaaggatcgaaaaggcaggtggagaatgcttgacgtttgatcaattggctcttcgagctcctcttggacaaaacacagttcttcttagaggaccaaagaattgccgtgaagcagttaggcacttcggtaaggctcctggtgtgccacacagccacaccaagccgtatgtgcgatcaaagggaaggaaatacgagaaggctagaggtagaagaaacagcaggggatttagaaactaaaacggtctctccatcaatcgtttccaaagttttatcttgtcttctctatcaatgttgtttgcatactttctatgatgaaaattttgcttttggactctggattatgttgaaagatgtgttggatggttttaggtattaatgttgtcttcatattcaatttt

SEQ ID NO: 4470 - DNA, 865 bp, Thellungiella halophila
acggcggcaccacatccccggacgctacaatgggtattgatctgatcgctggaggtaagagcaagaagaccaaaaggacagctccaaagtccgatgatgtgtaccttaagcttactgtcaagctttaccggtttttgtttaggagaacaaacagcaagttcaacggagtgatattgaagaggcttttcatgagcaaagtcaacaaagctccactttctctatctaggctcgtggaattcatgacgggcaaggaagataagattgcggtcttagttggaactataaccgatgatttgagggtacacgagattccagctatcaaagttactgccctgaggttcacagagagagccagagctcgcattgagaaagctggtggtgaatgcttaaccttcgaccaactcgctctcagagctccattgggccaaaacacggttcttcttagaggacctaagaactctcgtgaagctgtgaagcatttcggtcctgctcctggtgtgccacacagtcactcgaagccatatgttcggtccacgggaaggaaattcgagaaagccagaggaaagaggaagagtcgtggattcaaggtttaagatcattgtcagcgtctttgaacttgattttggagtattgttgcttcttaatccctttcgcgtaattggatattttgttagagaattgtggtttttcgttgcttggttcagacataatgttaagttttgttttcttcctactgaattcatggtgtgctttttacgcattgagctacaccatgataaaaacatgattcatatctatttttatgtttttgtcattgtgtgcttttcttcgaaaaagaacacgagctccaaattgatatacagat

SEQ ID NO: 4471 - DNA, 789 bp, Brassica napus
ggataaaccctagcttcagttccgtcttcctccgtaacagacgccatgggtatcgatctcatcgccggaggtaagagcaagaagaccaaaaggacagctccaaagtccgatgatgtctacctcaagcttctcgtcaagctgtaccggtttttggtaaggagaaccggaagcaagttcgatgctgtgatccttaagaggcttttcatgagcaaagtgaacaaggctcctctttcactctccaagctcgttgagttcatgaagggcaaggatggtaagattgctgtgttggttgggactatcactgatgatttgagagtgcatgagattcctgcgatgaaggttactgccttgaggtttacggagagggctagggctaggattgagaaagctggtggagagtgcttaaccttcgaccagcttgctctcgttgctccattgggacagaacacggttctccttagaggaccgaagaactcacgtgaagcagtgaagcactttggtaaagcacctggtgtgccacacagccacaccaagccttatgttagggctaagggaaggaagtttgagaaagctagaggaaagcgaaagagtcgtggtttcaaggtctaaggttgtttcgaggttgttgttgtttccttatggttgctgctttcagaatcgaaattcttgtagaccactcttgttactcatttgctttttgcagacattgttttgagttttctgtctttctgttctaatcgacaattgaatgttttgcttgatagctgtttaagaagttgcctaatgctt

SEQ ID NO: 4472 - DNA, 716 bp, Panax ginseng
gggggaaaacatttgtgtttcagtaggcgcggcgggaagcaagcagcagcagcagcagcagcagcagcagccatgggtatcgatctgaaagctggtggaaagagcaagaggacgaagcgtaccgctcccagatccgatgatatttacctgaagctcattgtcaagctgtaccgatttcttgtaaggaggacgggaagcaagttcaatgctgtgattctgaagaggctcttcatgagcaaaatcaataagcctcccatctctctttcccgtttgattcgtttcatgtctggaaaggaggacaaaattggtgtgatagttggtactattaccgatgatgttcgggtgcatgaagttccttgtatgaaggtcactgctttgaggttcactgagactgcaagggcaaggattgagaaggccggtggtgaatgtttgacatttgaccagctggctcttagagctcctctcggacaaaacacagtacttcttagaggaccaaagaattctcgtgaagcggtgaaacacttgggcaaggctcctggtgtgccagacagccacagtaagccatatgtgcgatcaaagggaaggaaatttgagaaggccagaggaagaagaaacagcagaggctttagggtttgagttggatcctcctgtctgtttacaattgaagactggtcaatcaaaatctttgtgaaagatttatccatcgaatttcttta

SEQ ID NO: 4473 - DNA, 797 bp, Physcomitrella patens
ctctctttccgagtccccaacgccatcgcagggctccttactcgcgggctcggactcatcggcaaccatgggtatcgacttgaaggccggtggtcgcaacaagaaaaccaagcgtactgctcccaagagccagaatgtctaccttaagcttcttgtgaagctctacaggtttttggtgaggaggacagatgctcccttcaacagcgtcgtcttgaaacgtctgttcatgagcagaatcaacagggctcctctctccatgagccgccttgtcaagtacatggctggaaaggacgacaagattgctgtgttggtaggaaccatcactgacgacgtcaggcagtttgaggttcccgcattgaaggtttgcgctttgcgcttcaccgagaccgctcgtgcccgcatcgtgaaggctggaggggaatgtttgactttcgatcagcttgcactgcgtgcaccaactggtgctaatactgttcttcttcggggtcccaagaatgctcgtgaggcagttaagcacttcggagcacctggtgtaccacaaagtcacgctaaaccctacgtgcgttcgaagggccgcaagtttgagaaggctcgtggtcgtcgtaacagcagaggtttcaaggtttagaaactttgttttttaaattgagtaaatgaaacatttcatccaggtggctggagatcaatttcggctgatttacggatgctgtgtcccattacacctttcagatttctgtggtgatgtttgatttgttactttccttgaatctaatagataatgaaaacgagttgcaaaa

SEQ ID NO: 4474 - DNA, 765 bp, Brassica oleracea
gctcttcctccgtagcagacagacactcgacagctcacgcaatgggtatcgatcttatcgcgggaggtaagagcaagaagaccaaaaggacagctccgaagtccgatgatgtctacctcaagcttctcgtcaagctgtaccggtttttggttaggagaaccgggagcaagttcgatgcagtgatccttaagaggcttttcatgagtaaagtcaacaaggctcctctttctctctccaagctcgctgagttcatgaagggcaaggatggtaagattgctgtgttggttgggactattactgatgatttgagagtgcacgagatccctgcaatgaaggttactgccttgaggtttacggagagggctagggctaggattgagaaagctggtggagagtgcttaacctttgatcagcttgctctcgttgctcctttgggacagaacacggttctacttagaggaccaaagaactcacgtgaagcagtgaagcactttggtctagctcctggtgtgccacacagtcactccaagccctatgttaggtctaagggaaggaagtttgagaaggctagaggaaagcgaaagagtcgtggtttcaaggtctgagaaatactctgttgtttcgttatggttggtttcataatcgaaattttcatagagaactctcgttcctcttcatttcttgcagacaatgttttaagctttttgtcgttattatgttctactcgacatttaaatgttttgcttaagaattttcttattccag

SEQ ID NO: 4475 - DNA, 753 bp, Brassica napus
gctcttcctccgtagcagacagacactcgacagctcacgcaatgggtatcgatcttatcgcgggaggtaagagcaagaagaccaaaaggacagctccgaagtccgatgatgtctacctcaagcttctcgtcaagctgtaccggtttttggttaggagaaccgggagcaagttcgatgcagtgatccttaagaggcttttcatgagtaaagtcaacaaggctcctctttctctctccaagctcgctgagttcatgaagggcaaggatggtaagattgctgtgttggttgggactattactgatgatttgagagtgcacgagatccctgcaatgaaggttactgccttgaggtttacggagagggctagggctaggattgagaaagctggtggagagtgcttgacctttgaccagcttgctctcgttgctcctttgggacagaacacggttctacttagaggaccaaagaactcgcgtgaagcagtgaagcactttggtctagctcctggtgtgccacacagtcactccaagccctatgttaggtctaagggaaggaagtttgagaaggctagaggaaagcgaaagagtcgtggtttcaaggtctaagaaatactctgttgtttcgttatggatggtttcataatcgaaattttcatagggaattctcgttcctcttcatttcttgcagacaatgttttaagctttttgtcgttattatgttctactcgacatttaaatgttttgcttaagaatt

SEQ ID NO: 4476 - DNA, 781 bp, Brassica napus
atcaacgcagagtacgcgggggtagcagacagacactcgacagctcacgcaatgggtatcgatcttatcgcgggaggtaagagcaagaagaccaaaaggacagctccgaagtccgatgatgtctacctcaagcttctcgtcaagctgtaccggtttttggttaggagaaccgggagcaagttcgatgcagtgatccttaagaggcttttcatgagtaaagtcaacaaggctcctctttctctctccaagctcgctgagttcatgaagggcaaggatggtaagattgctgtgttggttgggactattactgatgatttgagagtgcacgagatccctgcaatgaaggttactgccttgaggtttacggagagggctagggctaggattgagaaagctggtggagagtgcttgacctttgaccagcttgctctcgttgctcctttgggacagaacacggttctacttagaggaccaaagaactcgcgtgaagcagtgaagcactttggtctagctcctggtgtgccacacagtcactccaagccctatgttaggtctaagggaaggaagtttgagaaggctagaggaaagcgaaagagtcgtggtttcaaggtctaagaaatactctgttgtttcgttatggatggtttcataatcgaaattttcatagggaattctcgttcctcttcatttcttgcagacaatgttttaagctttttgtcgttattatgttctactcgacatttaaatgttttgcttaagaatttacttattccaaagagtc

SEQ ID NO: 4477 - DNA, 889 bp, Castanea mollissima
gtttttggtcagtcgcgtcgcgccgagcttcagcaccaaaaccctcgtcacgagccatgggtatcgatttggtcgccggtggtaagaggaagaagaaggtcaggaccgcccccaaatcaaatgatatttacctcaagctcctcgtcaagctgtaccgttttctggtgcggaggaccgggagtaagttcaatgcggtgatactgaggaggcttttcatgagcaaggtcaacaagccacctctatctctctccaagttgattcgttacatggagggcaaggagggtaagattgctgtggttgttgggactgtcaccgatgacattagggtgtatgaggtcccagcagtgaaggttacagccctgaggttcacagagactgcaagagctaggatcgagaaggccggaggagaatgcttgacatttgatcagctggctctaagagctcctcttgggcagaacacggttctccttagaggtcataagaagcgtgaagctgtgaagcactttggacctgctcctggtgtgccacacagccacacaaaaccctatgtacgtgctaaaggaaggaaatttgagagggctagaggaaaaaggaacagcaagggcttcagagtttgagttgctaaacacatgcgtaaacacaattttacttaccaaatctgttcgaatggtgttgcaattgtggttccctttttatgtctttttcatcctctctatggatcagttatctcaagagttttcttttacctttcccttttttcatatggatatcttttctttttagaattaaaatcgtttggatttgaaattctattgggtactttttaagtatagtggttctaaaacatgattcttgaatagtttaaatctgatatttttctaaattgtct

SEQ ID NO: 4478 - DNA, 777 bp, Taraxacum officinale
tcataaccctagctttccaaaatttcgctcgaaaccgcatttctgcagcagcaacagcagtcgcagtaatgggtatagatcttgttgccggtgggaagagtaagagaaccaaaagaaacgccccccgatccgatgatatctacttgaagctccttgtcaagctttataggttcttggtaaggcggacaggaagcaacttcaatgctgttatactgaagaggcttttcatgagcaaagtcaataagcctccgatttccctctctcgtttgattcgttacatgtccggcaaggatgagaagattgcggtggttgtgggcacagttacagatgatgttagggtgcacgaaattccttgtctcaaggtaactgcactgaggtttactgagactgctagggcaaggatcgagaaggctggtggagaatgtttgacctttgaccagctggcacttcgagctcctcttggacagaacacggttcttcttagaggtccaaagaattcacgggaagcagttcggcactttggaaaggctcctggtgtaccacacagccacaccaagccttatgtcagatcaaagggaaggaaatttgagaaggccagaggtagaagaaacagcaggggatttagaaactaaagcctttgtgttatttttctcattttcaaaaaaacctttacttgtttctgtacttgcttatcttgacatccatctttttttcctcaatgaagttgttttgatttttataaacggattttttattatagattcaatgtttacataa

SEQ ID NO: 4479 - DNA, 922 bp, Mesembryanthemum crystallinum
  misc_feature (695)..(695): n is a, c, g, or t
  misc_feature (697)..(697): n is a, c, g, or t
  misc_feature (728)..(728): n is a, c, g, or t
  misc_feature (752)..(752): n is a, c, g, or t
  misc_feature (781)..(782): n is a, c, g, or t
  misc_feature (785)..(785): n is a, c, g, or t
tgactagtctagacgatcgcggccgcgtcgactattttccttggaagaagaagcagaacaagaccatcgcagtcccaaaaccctacccggcgccctcgcaacatcatcaatggggatcgatttgaaggcaggaggtaagtcgaagaagacaaagagaactgcacccaaatccaacgatgtctacctcaaactcctcgtcaagctctaccgtttcctcgttcgtaggactgatagcagcttcaacgccgtcgttttgaagaggctcttcatgtctaagatcaacaaggcaccacttgctctctctcgcctcatcacctacatgaagggcaaggaggacaaaattgcagtgattgtgggaaatgtgaccgatgatgttcgggtttatgaggtgccggcgttgaaggttactgcattgaggtttactgagacggcgagggcgaggattgagaaggctggtggggagtgtcttacttttgatcagcttgctcttagggcaccacttggccagaacactattcttctcagagggccaaggaatgccagagaggctgttaggcattttggaaaggcaccaggtgttccacacagtcacactaagccatacgtgcgatcagatggtagaaagttcgagcgagcaagaggaaggaggaacagcagaggatacaagaactaagccttgaggttgttgtgttgtntnaagttgcagagttttttttgttggagtcagntatgattttgacggtaaacttatnttattgattggatattgtggctattgacnncgnagtttcacaaaatatcatgatgcggcttagcttttgcaaacctttttttacctttttgtgttataacggtggcttgaaaatgtcctttgttttggccaaaatgattgatgaatgcctttggatcttttcaaggcctt

SEQ ID NO: 4480 - DNA, 836 bp, Actinidia deliciosa
  misc_feature (13)..(13): n is a, c, g, or t
  misc_feature (16)..(16): n is a, c, g, or t
  misc_feature (660)..(660): n is a, c, g, or t
  misc_feature (717)..(717): n is a, c, g, or t
  misc_feature (739)..(740): n is a, c, g, or t
tttggtttcggcngcngcagcagcagcagcagcagcagctatgggtatcgatctgaaagccggcggcaagagcaagaagaccaaacgcaccgcccccagatcccaagatatctacctcaagcttctcgtcaagctgtatcggtttctggtgaggaggacgggaagcaagttcaatgcggtgatactgaagaggctgttcatgagcaaaatcaacaaacctcccatctctctctcccgcttgattcgattcacgcagggaaaggagggtaagattgccgtggtggttgggaccattactgatgacattagggtacatgaagttccttgcttgaaggtgactgcactgaggttcactgagacagcgagagcgaggattgagaaagcaggcggtgagtgcctgacatttgaccaactggctctcagagccccacttgggcagaacacggtactccttagaggaccaaagaatgctcgtgaggcagtgaagcactttggtaaggctcctggtgtccctcacagccacacgaagccttatgtgcgttcaaagggaaggaaatatgagcgtgcccgaggaagaagaaacagcagaggcttcagaaactgagttcttgcttatgctttcgatgcagacttatctattcgattctaagcaaaagattnttagttcccccttttcgtattggggtggttccttttgtttttcgccttttctgcatntcaaacatttccaatctctgtnntggcttctcaacaatttccaatatctgtagttgtttggagcttgattttacttgtttctgaaggatttgtttcttttccgaacaaagcgttgaaag

SEQ ID NO: 4481 - DNA, 822 bp, Lactuca sativa
gcggggggttctaaccctagttttttcaattttcccacatttctgcgcaggttgcaaaatcctccgccgctgctatgggtatagatcttgttgccggtgggaagagcaagagaaccaaaagaaactcccccagatcggatgatatctacctgaaactccttgtcaagctctaccggtttttggtaaggaggacaggaagcaacttcaatgctgtgatactgaagaggctcttcatgagcaaagtcaataaacctccgatatccctctctcggctgattcgttacatgtctggaaaggatgagaagattgctgtgattgtgggcacagtgacagacgatgttagggtgcatgaaatcccttgtctgaaggtaactgcactgaggttcactgagactgcaagggcaaggattgagaaggcaggtggagaatgtttgacatttgatcagctggctcttcgagctcctcttggacagaacacggttcttcttagaggtccaaagaattcaagggaagccgtgaggcactttggtaaggctcctggtgtgccacacagccacaccaagccttatgtgagatcaaagggaaggaagtttgaaaaggccagaggtagaaggaacagcaggggatttagaaactaagtcgtcaccagtcccatgttttgtttccctgtgttttttattatatctttacttcttgtttgtgtacttgctattttgacatccatcttttttctcggtaatgaagttagcgatttggacttggatttctccaaaatgtttattgagctgaatgggtttctataattcaagttgctatatttgt

SEQ ID NO: 4482 - DNA, 839 bp, Lactuca sativa
cctttttctttcgttcgtctccttcttctttctgcaggtacacgcagccgtcgccgtcatgggtatagatcttgttgctggtggaaagagcaagaggaccaaaaggaatgctccacgttccgatgatatctaccttaagctcctcgtcaagctttatcggtttttggtgaggaggaccggaagcaacttcaatgcagtgatactgaagaggctctttatgagcaaagtcaataagcctccaatttctctctctcgcttgatccgttacatggctggcaaggacgataagattgctgtggttgttggcacagtaaccgatgatgttagggttgatgaaatcccatgtatcaaggtcactgctctgaggttcaccgagactgcaagggccaggatcgagaaggctggtggtgaatgcttgacttttgaccagttggcccttcgagctcctcttggccagaacacggttcttcttagaggtccaaagaactgcagggaagcagtgaggcactttggaaaagctcctggtgtgccacacagccataccaaaccgtatgtgcgatccaagggaaggaagtttgagaaggcaagaggaagaagaaacagcagaggcttcagaaactaagtgtgttcatcaatggtgggtgtctttgaaatgttgccaaagttctataatctctttttatgctggtgttgtttggattaaagctatgatgaaaattttggtgtttggtaatatgttatatgtagcagcagggagtttttgatttctaatttacccttcacaattgtttaatcgagatcaatttttatcatttatgtttaatggagttcagttttta

SEQ ID NO: 4483 - DNA, 840 bp, Lactuca sativa
cctttttctttcgttcgtctccttcttctttctgcaggtacacgcagccgtcgccgtcatgggtatagatcttgttgctggtggaaagagcaaaaggaccaaaaggaatgctccacgttccgatgatatctaccttaagctcctcgtcaagctttatcggtttttggtgaggaggaccggaagcaacttcaatgcagtgatactgaagaggctctttatgagcaaagtcaataagcccccaatttctctctctcgcttgatccgttacatggctggcaaggacgataagattgctgtggttgttggcacagtcaccgatgatgttagggttgatgaaatcccatgtatcaaggtcactgctctgaggttcaccgagactgcaagggccaggatcgagaaggctggtggtgaatgcttgacttttgaccagttggcccttcgagctcctcttggccagaacacggttcttcttagaggcccaaagaactgcagagaagcagtgaggcactttggaaaagctcctggtgtgccacacagccataccaagccgtatgtgcgatccaaaggaaggaagtttgagaaggcaagaggaagaagaaacagcagaggcttcagaaactaggtgtgttcatcaatggtgggtgtctttgaaatgttgcaaaagttctataatctctttttatgctggtttgtttggattaaagcgatgatgaaaattttggtgtttggtaatatgttatatgtagcctttgatttctaatttactttcaacaattgtttaatggagatcaattttaatcatttatgtttaatggagtttagtttttatataacatcaaa

SEQ ID NO: 4484 - DNA, 821 bp, Lactuca sativa
gcggggggttctaaccctagttttttcattttcccacatttctgcgcaggttgcaaaatcctccgccgctgctatgggtatagatcttgttgccggtgggaagagcaagagaaccaaaagaaactcccccagatccgatgatatctacctgaagctccttgtcaagctctaccggtttttggtaaggaggacaggaagcaacttcaatgctgtgatactgaagaggctcttcatgagcaaagtcaataaacctccgatatccctctctcgtctgattcgttacatgtctggaaaggatgagaagattgctgtgattgtgggcacagtgacagacgatgttagggtgcatgaaatcccttgtctgaaggtaactgcactgaggttcactgagactgcaagggcaaggattgagaaggcaggtggagaatgtttgacatttgatcaactggctcttcgagctcctcttggacagaacacggttcttcttagaggtccaaagaattcacgggaagctgtgaggcactttggtaaggctcctggtgtaccacacagccacaccaagccttatgtgagatcaaagggaaggaagtttgagaaggccagaggtagaagaaacagcaggggatttagaaactaagtcatcaccagtcccatgttttgtttccctatgtttttgattatatctttacttcttgtttgtgtacttgctattttgacatccatcttttttcttgttaatgaagttagagatttggacttggatttctccaaaatgttagctgagtgggtttttatgattcatgttgctatatttgtcgaaa

SEQ ID NO: 4485 - DNA, 712 bp, Liriodendron tulipifera
ttccttccttccaatctctccaggagaagtcgtcaaaagcctaaaatggggatagatctggtggccggaggcaggtgcaagaagacgaagcgaacggctcccagatcgggcgatatctacctcaagcttctcgtcaagctatataggttcttggttaggaggactggcagcaaattcaatgcagttatattgaagagattattcatgagcaaggtcaacaagccaccggtgtcactatctaagttgatcgagttcatgaaagggaaggacgataagattgcagtggtggttggttgcatcactgacgatacccgagtttatgaagtgcctgcattgaaggtgactgctctgaggtttacggagacagctagagctcggattgtgaaagctgggggtgaatgcttgaccttcgatcagcttgctcttagggcacctctgggacagaacacggttcttctgaggggctccaagaaaagagaggcagtcaagcattttggcaaggctccaggtgtgcccggcagccactccaaaccctatgttcgttccaagggcaggaagtttgaaagagcgaggggcaggagaaacagccgtggctttagagtctaatactgccacggcccgcaccagagccatctttgtctccctcatcagtgcagtaggtgctagcttcttcactcttttcatttttgaggtctgacattctatcgaatct

SEQ ID NO: 4486 - DNA, 727 bp, Selaginella moellendorffii
ggactggggctagatttagggttttgcggggactagggcttttcagccgccagggaggaggaggagcagcgctatgggtatcgacatcgaagccggcgggcgcaacaagaagaccaagcggacagcccccaagagtgacaatgtctacctcaagctgctcgtcaagctctaccgcttcttggtcagaaggaccaacagcaaattcaacgctgtgatcctcaagcggctcttcatgagcaaaaccaaccagccgccagtgtccctctcccgcctctccgctagcatggaaaagaagtcgggaaagatcgctgtcctcgttggaacggtcaccgacgatcctagactcgcgacggttcccgcaatgacagtggtggctctgcgcttcacccggactgcccgcgccaggatcaccaacgccggagggaaatgcctcacctttgacgagctcgcgctcctggcacccactggatgcaacacggtacttttgaggggtcgcaagtccgctcgggaggccgtgaagcactttgggccggctcctggtgtgccacacagccacaccaagccgtacgtgcgctccaaggggcgcaagtttgagaaggctcgcgggcgacgtaacagccgaggattcagagtctaggctactgctcctgtatttctctaaagccatcttttttgtgatgttgagcttcagaaaagtatttgaaaactatatgagtcttccaacctc

SEQ ID NO: 4487 - DNA, 746 bp, Selaginella moellendorffii
ggactagggcttttcagccgccagggaggaggaggagcagcgccatgggtatcgacatcgaagccggcgggcgcaacaagaagaccaagcggacagcccccaagagtgacaatgtctacctcaagctgctcgtcaagctctaccggttcttggtcagaaggaccaacagcaaattcaacgctgtgatcctcaagcggctcttcatgagcaaaaccaaccagccgccagtgtccctctcccgcctctccgctagcatggaaaagaagtcgggaaagatcgctgtcctcgttggaacggtcaccgacgatcctagactcgcggcggttcccgcaatgacagtggtggctctgcgcttcacccggactgcccgcgccaggatcaccaacgccggagggaaatgcctcacctttgacgagctcgcgctcctggcacccactggatgcaacacggtacttttgaggggtcgcaagtccgctcgggaggccgtgaagcactttgggccggctcctggtgtgccacacagccacaccaagccgtacgtgcgctccaaggggcgcaagtttgagaaggctcgcgggcgacgtaacagccgaggattcagagtctaggctactgctcctgtatttctctaaagccgtcttttttgtgatgttgagcttcagaaaactatatgagtcttccaacctcagtgctcttggttcaaacattgtagttttcgttaaatttgatctccttttcatgtgaag

SEQ ID NO: 4488 - DNA, 1387 bp, Picea glauca
aaagggatgaaaaaatagagtaattagaaatcatagaaaaccctgaaaaaccttaatgtaatcatcaattcactagttgatgaaatcaagctagaaactaacgctccagttgactaatgcggttaatggagatttataagcaaaacgcagattcaagaaactgatattcattgtcaagttgactccatcagccatccttgcactacaccttttcctctctgcctacgctcttgttcctattgttcgtgaggccttcggaggaacactagggccgagggttcgagagcagcagcgacaatgggtatcgacttaattgccggtggaaagagcaagcagaccaggcgtactgctcctaagagcgaggatatttacctcaagctcctcgtcaagttataccgttttttggtgaggagaaccagtagccgcttcaatgcagtgattttgaagaggctgttcatgagcaaaaccaacaagccaccgctatcgctttctcgtttggctcgttacatgcaggggaaggaagacaagattgcagtggttgtgggcaccattacagatgataatagggtttatgaactgcctcctgtgaagataactgctcttagatttacagagacagcgagagctcgaattttgaaagccggaggggaatgcttaacttttgatcagcttgcactgcgtgcaccacttggacagaacacggtcttgttgcgtggccccaagagccatcgtgaggctgttaagcactttggaagggcaccaggtgttccacacagccacactaaaccatatgttcgatccaagggtaggaaatatgagatggctcgtggtaggagaaatagtcgtggcttcaaggtctagagaatcaaaggactttatggtgattttagtctttctagtgagctcttgctgatttcattaattttactattctgttgctggcaattgtaattggtaactctagaatctagatgtttaatgttttgtttaaaacattctcagattacatggcaaaccattgggatgaaatgtctgttggtttgctatcagatcttctcttcctatgaaagggaggactttcagttttacaacttttttcttactatgaaaggagtaccgagttttacaacttttgacgctgccttaactttctgtgaagggagggtcaccagttttacaacctttgagtcatttctaaaggattttttgagaccatttaatgctagctattttttgatttaatgggttgctgggtttctctcatgtcccggaaatctgcagtgttcattttattttactgatttcattagatttatcacttttggatgtatgaaggaaataatttcattgaatcctaaaaaaagagaagatatcgattaataaaaaa

SEQ ID NO: 4489 - DNA, 755 bp, Helianthus annuus
ttttgtgcagtaggaagcagcctccgccgtcgtcatgggtatcgatcttattgccggtggtaagagcaaacgcaccaaaagaaccgcccctagatccgacgatatctacctcaaactcctcgtcaagctttaccggtttttggtgaggcgaaccggaagcaacttcaatgttgtcattctgaagaggttgttcatgagcaaagttaacaagcctccgatttcactctctcgtttgatccgttacatgtccggaaaggatgataagattgctgtggttgttggaacggttacggatgatgttagggttcatgagattccttgtttgaaggtgactgcattgaggtttactgaaactgctagggctagaattgagaaggctggtggggagtgcttgacttttgaccagctcgctcttcgtgctccgcttggacagaatacggttcttcttagaggaccaaagaattcacgtgaagccgtgaagcactttggtccggctcctggtgtgtcacacagtcacaccaagccatatgtgagatcaaagggaaggaagtttgagaaggccagaggtagaagaaacagcaggggatttagaaactaagctatcatcaatgttttctatccaaatgtctgtttccaggattttcaattttgtgtttttgatggaacttctagatgattttgtttgcatgcttgttatgatgaaaattttgttgttgacattgatcttttatctggtaatgaagttggagattatg

SEQ ID NO: 4490 - DNA, 945 bp, Zamia vazquezii
gctaccggcgtgctcttatttcagctgttctggagtggcgagggagagggactccgagtgattcagaccgacaacaacaatgggtatagatttggttgctgggggtaagagcaagaagaccaaacggacggcccctaagagcgatgatatctacctcaaactcctcgttaagttataccggttcttggtgaggaggaccaacagcagattcaatgcggtggttttgaagaggctgttcatgagtaaggtcaacaggccgcctgtgtctctttctcgattggcccgttacatgaaggggaaggatgataagattgctgtggtcgtagctaccgttaccgatgacattagggtttatgagctgcctcctctgaagattacggctctcaggtttaccgagactgcaagagctcggattttgaaggcaggaggcgaatgctggacctttgatcagcttgctctgcgggcacctctagggcaaaacacggtcctcttgcgtggtccaaagagtcatcgggaggctgtcaagcactttggaaggccacctggtgtacctcatagtcataccaaaccatatgtccggtcgaaagggaggaagtttgagaaggctcgtggaaggagaaagagccgtggcttcaaggtttaaaattttaaagggcattttggaatgcttggggatctttggagagacttgtccagatatttggacgtttagtagtctatgtttggaaattgatattagtgattttaggacagggatgataatatttatatagtttgcgctgaaacttcaggagaaatatctcacttgggattaattctaggtctcttttctatgatgggttctatagccctaaacaagtgtgcacatttttgtatgatgacattttgatggatatttgttgtttttattgattgctttgtatgaaaggttgataaagggggggc

SEQ ID NO: 4491 - DNA, 806 bp, Lactuca sativa
taaccctagttttttcaattttcccacatttctgcgcaggttgcaaaatcctccgccgctgctatgggtatagatcttgttgccggtgggaagagcaagagaaccaaaagaaactcccccagatccgatgatatctacctgaagctccttgtcaagctctaccggtttttggtaaggaggacaggaagcaacttcaatgctgtgatactgaagaggctcttcatgagcaaagtcaataaacctccgatatccctctctcgtctgattcgttacatgtctggaaaggatgagaagattgctgtgattgtgggcacagtgacagacgatgttagggtgcatgaaatcccttgtctgaaggtaactgcactgaggttcactgagactgcaagggcaaggattgagaaggcaggtggagaatgtttgacatttgatcagctggctcttcgagctcctcttggacagaacacggttcttcttagaggtccaaagaattcacgggaagctgtgaggcactttggtaaggctcctggtgtaccacacagccacaccaagccttatgtgagatcaaagggaaggaagtttgagaaggccagaggtagaagaaacagcaggggatttagaaactaagtcatcaccagtcccatgttttgtttccctatgtttttgattatatctttacttcttgtttgtgtacttgctattttgacatccatcttttttcttggtaatgaagttagagatttggacttggatttctccaaaatgttagctgagtgggtttttatgattcatgttgctatatttgt

SEQ ID NO: 4492 - DNA, 852 bp, Lactuca sativa
aaccctaactcctttttctttcgttcgtctccttcttctttctgcaggtacacgcagccgtcgccgtcatgggtatagatcttgttgctggtggaaagagcaagaggaccaaaaggaatgctccacgttccgatgatatctaccttaagctcctcgtcaagctttatcggtttttggtgaggaggaccggaagcaacttcaatgcagtgatactgaagaggctctttatgagcaaagtcaataagcccccaatttctctctctcgcttgatccgttacatggctggcaaggacgataagattgctgtggttgttggcacagtcaccgatgatgttagggttgatgaaatcccatgtatcaaggtcactgctctgaggttcaccgagactgcaagggccaggatcgagaaggctggtggtgaatgcttgacttttgaccagttggcccttcgagctcctcttggccagaacacggttcttcttagaggtccaaagaactgcagggaagcagtgaggcactttggaaaagctcctggtgtgccacacagccataccaagccgtatgtgcgatccaagggaaggaagtttgagaaggcaagaggaagaagaaacagcagaggcttcagaaactaagtgtgttcatcaatggtgggtgtctttgaaatgttgcaaaagttctataatctctttttatgctggtgttgtttggattaaagctatgatgaaaattttggtgtttggtaatatgttatatgtagcagcagggagtttttgatttctaatttaccttcaacaattgtttaatggagatcaattttaatcatttatgtttaatggagtttagtttttatat

SEQ ID NO: 4493 - DNA, 764 bp, Brassica rapa
  misc_feature (582)..(582): n is a, c, g, or t
gcggcaccaccacatccccagggaggccataatgggaattgatttgattgctggaggtaagagcaagaagaccaaaaggacagctcctaagtccgacgatgtctacctcaagcttaccgtcaagctttacaggtttctggtaaggagaacacagagcaagttcaatgcagtgattctgaagaggcttttcatgagcaaagtcaacaaagctcctctctctctctccaggctcgtcgagttcatgactggcaaggaagataagattgctgtcttggttggaaccataaccgatgatttgagggtacacgagatcccagctatcaaggttactgccttgaggttcacggagagagccagagctcgcattgagaaagctggtggtgaatgcttaacctttgaccagcttgctctcagagctcctttgggacagaacactgttcttcttagaggacctaagaactcacgtgaagctgtgaagcattttggtcctgctcctggtgtgccacacagtcactccaagccttatgttcggtccaagggaaggaagttcgagaaggccagaggaaagaggaagagccgtgngtctcctcgagtgttgtttgcttcttacttaattaatttctatcgtaatcggatttttgttagtgaattgttgctgtttcagacaatatttttaagtttcttactctactggaatcatcgtgagttgattactcatttgtgcacttacatgcatttatttaagctttataatatcaaagtct

SEQ ID NO: 4494 - DNA, 1233 bp, Beta vulgaris
  misc_feature (580)..(580): n is a, c, g, or t
  misc_feature (583)..(583): n is a, c, g, or t
  misc_feature (603)..(603): n is a, c, g, or t
  misc_feature (614)..(614): n is a, c, g, or t
  misc_feature (625)..(625): n is a, c, g, or t
  misc_feature (645)..(645): n is a, c, g, or t
gcacgaggcagtccgcaaaaccctaattcggagcagaagcagcgcaacatcaacaatggggatcgatttgaaggcaggaggtaagtcgaagaagacgaagagaacagctcctaaatccaacgatgtttaccttaaactcctcgtcaaactttaccgttttctcgttcgtagaactggtagtagcttcaacggcgtcgttttgaagaggcttttcatgtcaaagatcaacaaagctccactttctctatctcgtctcattacttacatgaagggaaaggaggataaaattgcagtgatagttggggctgtaactgatgatattcgagtgtacgaggttcctgcattgaaagtaacagcattgaggtttactgaaactgcaagagcaaggattgagaaagctggtggtgaatgtctcactttcgatcaacttgctcttagagctcctcttggacagaacactgttcttctcagagggccaaagaatgctagagaggctgttaagcactttggcaaagcacctggtgtcccacacagtcacactaagccatatgtgcgagcaaatggtagaaagtttgagcgngcnagaggtaggaggaacagcangggatacgggnttaagcttgantaccttattttgaaactctngtgtttcctgtcccactattcaagttttggtggagttggtagcattgttaaccaaatttagtttccctaattttctttaaaaatttttggttgtccgggggaaaaaacaaatatatctcctatataggcctaattggttataccttttttaactattttggggggggggccgggcccattcccccttagggaggtttaaaatttctggcgtgttttaaaaggtggcggtaaaaactgtggtacccatttatgcttttgaacatcccttttcgtggggttaaaaaaaaaccccccatttctctcctattgggtccgaaggggagggaaattacgtaattttttaactcggtatttgtaaatcctttttaacttggaatggaatccttactaaaaacttaaggggatttcttagaatacctttatactctctctcggattccttaggtgctcttactctttttgttgttgttcttctctattattgttgattagaatctaagaattcgtgtcttgttatcgtcctacttgttcttcttctctattatttgatattttttcttccttctctttctctttactttttttctc

SEQ ID NO: 4495 - DNA, 1554 bp, Actinidia deliciosa
  misc_feature (491)..(491): n is a, c, g, or t
  misc_feature (506)..(506): n is a, c, g, or t
  misc_feature (582)..(582): n is a, c, g, or t
  misc_feature (605)..(605): n is a, c, g, or t
  misc_feature (616)..(616): n is a, c, g, or t
  misc_feature (626)..(626): n is a, c, g, or t
  misc_feature (661)..(661): n is a, c, g, or t
  misc_feature (666)..(666): n is a, c, g, or t
cagcagcagcagcagcagctatgggtatcgatctgaaagccggtggcaagagtaagaagaccaaacgcaccgcccccagatcccaagatatctacctcaagcttctcgtcaagctgtatcggtttctggtgaggaggacgggaagcaaattcaatgcagtgatactgaagaggctgttcatgagcaaagtcaacaagcctcccatctctctctcccgcttgattcgcttcacacagggaaaggagggtaagattgccgtggtggttgggaccattactgatgacattagggtacatgaagttccttgtttgaaggtgactgcactgaggttcactgagacagcgagagcgaggattgagaaagcaggtggtgagtgcctgacatttgaccagctggctctcagagccccacttgggcagaacacggtactccttcgaggaccaaagaatgctcgtgaggcagtgaagcactttggtaaggctcctggtgtncctcacagccacacnaagccttatgtgcgttcaaagggaaggaaatatgagcgtgcccgaggaagaagaaacagcagaggcttcagaaacngagttcttgcttatgctttcgangcagacttatntattcgattntaagcaaaagattgttagttcccccttttcgtatnggggnggttccttttgtttttcgccttttctgcatttcaaacatttccaatctctgttttggcttctcaacaatttccaatatctgtagttgtttggatcttgattttacttgtttctgacggatttgtttcttttccgaacaaagcgttgaaagtttaattggttggtttagtgaaaaaaaaaaaaaaaaaaaccctcgtgccgaattcggcacgagggttctccccgtccctgcggtctcagcctcagaccgatcttcaatctctcgaagggacaatgagccgttctagcagaacgctctatgttggaaatcttcctggtgacattcgggaacgtgaagtagaagatatcttctacaaatatggaccggtagcccatattgatttgaaaatcccgccgagaccccctggttatgcttttgttgagtttgaagaggctcgtgatgctgaagatgctattcggggtcgtgatggctatgattttgatgggcaccggctgcgggtggagcttgcacatggagggcgtggacattcatcatcaacagatcattacagtaatcacagcagcggccgtggcagcggtcgtggcggagtgtcgaggcgctctgattatcgtgtgttagtctctggattgcctggctctgcttcatggcaagaccttaaggatcacatgcgtcgagcaggggatgtctgtttctcccaagttttccgtgacggaagtggcacaacaggaattgtggattacacaagttatgatgacatgaaatatgcaattaggaaactcgatgactctgagtttcggaatgcttttactcaagcaatagtccgtgtaaaggaatataaatcaagcagaagccggagcaattccaggagccgcagtcgtagtcgttctc

SEQ ID NO: 4496 - DNA, 789 bp, Physcomitrella patens
gaaccgctctttccgagtccccaacgccatcgcagggctccttactcgcgggctcggactcatcggcaaccatgggtatcgacttgaaggccggtggtcgcaacaagaaaaccaagcgtactgctcccaagagccagaatgtctaccttaagcttcttgtgaagctctacaggtttttggtgaggaggacagatgctcccttcaacagcgtcgtcttgaaacgtctgttcatgagcagaatcaacagggctcctctctccatgagccgccttgtcaagtacatggctggaaaggacgacaagattgctgtgttggtaggaaccatcactgacgacgtcaggcagtttgaggttcccgcattgaaggtttgcgctttgcgcttcaccgagaccgctcgtgcccgcatcgtgaaggctggaggggaatgtttgactttcgatcagcttgcactgcgtgcaccaactggtgctaatactgttcttcttcggggtcccaagaatgctcgtgaggcagttaagcacttcggagcacctggtgtaccacaaagtcacgctaaaccctacgtgcgttcgaagggccgcaagtttgagaaggctcgtggtcgtcgtaacagcagaggtttcaaggtttagaaactttgttttttaaattgagtaaatgaaacatttcatccaggtggctggagatcaatttcggctgatttacggatgctgtgtcccattacacctttcagatttctgtggtgatgtttgatttgttactttcccttgaatctaatagataagaaaa

SEQ ID NO: 4497 - DNA, 867 bp, Solanum melongena
attaataagaggcgcccccttcagccatttctccatctctttcagaagagtccagacccaatcagccatgggtatcgatctgaaggccggaggtaagagcaagaagacgaagcgtacagcccctaaatctgacgatgtgtacctcaagctcctcgtcaagctttaccggttcttggcaaggaggaccggaagcaagttcaacgcggtgattcttaagaggctcttcatgagcaagattaacaagccgccactttctctgtcgaggttgatttcttacgccaaaggaaaggaggataagattgttgccattgtgggtactattaccgacgatgttagggcctatgaagttccaaagttgagggtgtgtgccttgaggttcacaaagacagccagggcgaggattgagaaggctggtggtgaatgcttgacattcgatcagttggctctcagggctccgcttggccagaacacgcttctcctcagaggtcctaagaatgcacgtgaagcagtgaaacactttggtccagctccaggtgttccacacagccataccaaaccatatgtccgttctaagggaagaaagtttgagagagctagaggaaagaggaagagcaggggttacaaggtttaatttgttttatctaagaatggttgtttccgtttgtattgtggcagtacaagtttttgcagactctagtatgcagttgcttatgtttacgcctgtcttgttgaggatatttttgatttttatctactttgaaaccaagtttcagttttaattgattgcatcagcttattgctttagcaaatgtcagaaattgtgactcaattgtttttattaatacattgcctatccccgcgttctat

SEQ ID NO: 4498 - DNA, 632 bp, Salvia sclarea
gaagcggcacgcgagagaagaagcagcagcagcagcagcaatgggtatcgacttggtcgccggaggtaaggtcaagaagaccaagcgtacagcgccgaaatccaacgatatctacctcaaactcctcgtgaagttgtaccggtttttggtgaggagaactggaagcaagtttaatgcggttgttctgaagagactattcatgagcaggattaacaggcccccgctctctctctcccgcctcagcgcactcatgaatgggaaggaagataagattgcagtacttgtaggaagtgttaccgatgatattcgtgttcatgacattcctaaaatgaaggttgcggctctcaggttcactgagagagctagggccagaattgagaaagttggtggagaatgtttgactttcgaccagcttgctctaagggctcctcttgggcagaacacggtgctcttgagaggttccaggaatgctcgtgaagctgttaagcactttggcccagctcctggtgttccacacagccacaccaagccttatgttcgagccaagggacgaaagtttgagcgtgccagaggaaacagaaacagcaggggtttcagggtttgagttattcagagctatgatgttttattgc

SEQ ID NO: 4499 - DNA, 739 bp, Salvia sclarea
ctactagaccttggctgtcactcagaatttccctagtctctcaacacactccatcgaagagcaggtgcaggaagcgggagggaagaagccgcagctatgggtattgatttggtcgccggaggtaaggtgaagaagaccaagcgcacagcgccgaagtccaatgatatctatctcaagctcctcgtgaagctgtaccggtttttggtgaggagaactggaagcaagtttaatgcggttgtgttgaagagattgttcatgagcaggattaacaggcctccgctttctctctcccgccttagcgcgctcatgaaggggaaggaagacaagattgcagtgcttgtcggaagtgtcaccgatgatatccgtgttcatgacattcctgccatgaagatcacagctctgcgattcaccgagagagccagggctagaatcgagaaggctggtggcgaatgcttgaccttcgaccagctcgctctaagggctcccctcggacagaacacggtgctcttgagaggatcgaggaatgctcgtgaggccgtgaagcactttgggccggctcctggtgtgccacacagccacaccaagccttacgtccgagccaagggacgcaagtttgagcgtgctagaggaaagcgaaacagcagaggtttcagggtttaagttattcatagctatggagtttgttgccaattttggctggttaagactgctggatacttggtattgctgtagtgctcta

SEQ ID NO: 4500 - DNA, 787 bp, Tragopogon dubius
gttaccacttttcttttgcaggtacaagcaccgccgtcgccgtcatgggtatagatcttgtcgccggtggaaagagcaagaggaccaaaaggaccgctccacgatccgatgatatctacctcaagctcctcgtgaagctttatcggtttctggtaaggaggaccggaagcaacttcagttctgtgatactgaagaggctgtttatgagcaaagttaacaggcctccgatttctctctctcgcttgatccgttacatgtccggcaaggatgagaagattgctgttattgtcggaacagtaaccgatgatgttagggttgatgatatcccatgcctcaaggtcactgctctgaggtttaccgagactgcgagagctaggatcgagaaggctggtggagagtgtttgactttcgaccagttggcactgcgagctcctcttggccagaacacagttcttcttagaggccctaagaactccagggaagcagtgaggcactttggaaaggctcctggtgtgccacacagtcataccaagccatatgttcgatccactggaaggaagtttgagaaggctagaggaagaagaaacagcagaggcttcagaaactaagtccttatcaatggtgggtgttcttgaagtgttgcttaagttttataatctttttatgctgatgttgtttggattaagctatgatgaaagttttgtttttggtaatatgtagaatggagttttgagttcttaatttatctttcagaattgttttggagaactaaaaaaaaaaaaaaaac

SEQ ID NO: 4501 - DNA, 870 bp, Artemisia annua
ggtcaccacttatttttccctgcaggtacacgccgccgtcaccttcaccgtcaaaactcaaaaccatgggtatagatctaattgctggtggaaaaagtaagaggactaaaaggaatgctcctcgttccgatgatatttaccttaagctcctcgtcaagttgtatcgttttctggtgaggaggacaggaagcaacttcaatgcagtgattttgaagaggctcttcatgagcaaagttaacaaacccccaatttcgctatctcgattgacccgttacatgtccggcaaggacgacaagattgctgtgattgttggaactgtcacagatgatgtcagagtggacgaaatcccttgtatgaaggtcactgctttgaggttcaccgagactgctagggccaggattgagaaggctggtggagaatgtttgacttttgaccagcttgcccttcgagctccggttggccaaaacacggttcttctcagaggtccaaagaactgtcgtgaggcaaataggcactttggaaaggctcctggtgttccacacagccacaccaagccatatgtgcgatcaaagggaaggaagtttgagaaggctagaggaaggagaaacagcagaggcttcaggaactaagttatcatcaatgactagactttttgagttgatggttaagttttatagatctggttttatgctgctgttgtttgagttaaagttttgctattataatatttcttgggaatatgtagaatggagttttgtgttttaagttatcatcaagatttgtttaatggagcttaaatttgatggtttttcttggcttaattaatcattcatgcttgtccaagatgacattaattcattgtcatatata

SEQ ID NO: 4502 - DNA, 772 bp, Artemisia annua
cacttattttttttctgcgccgtcaccttcactgtcaaaaccatgggtatagatctaattgctggtggaaaaagtaagcggactaaaaggaatgctcctcgttccgatgatatttaccttaagctccttgtcaagttgtatcgttttctggtgaggaggacaggaagcaacttcaatgcagtgattttgaagaggctcttcatgagcaaagttaacaaacccccaatttcgctatctcgattgacccgttacatgtcgggcaaggacgacaagattgctgtgattgttggaactgtcacagatgatgtcagagtggacgaaatcccttgtatgaaggtcactgctttgaggttcaccgagactgctagggccaggattgagaaggctggtggagaatgtttgacttttgaccagcttgcccttcgagctccggttggccaaaacacggttcttctcagaggtccaaagaactgtcgtgaggcaaataggcactttggaaaggctcctggtgttccacacagccacaccaagccatatgtgcgatcaaagggaaggaagtttgagaaggctagaggaaggagaaacagcagaggcttcaggaactaagttatcatcaatgactagactttttgagttgatggttaagttttatagacctggttttatgctgctgttgtttgagttaaagttttgctattattatatttcttgggaatatgtagtatggagttttgtgttttaagttatcatcaagatttgtttaatggagctt

SEQ ID NO: 4503 - DNA, 813 bp, Artemisia annua
tactcgggggatcgtgtttccatttttccgctcgacaccaatctccgccgccgaaaatgggtatcgatcttattgctggtggtaagagcaagaggaccaaaagaactgctcctcgatccgatgacatctaccttaaactcctcgtcaagttgtataggtttttggtaaggaggacaggaagtaagttcaatgcggtgatattgaagaggttgtttatgagcaaagttaacaagcctcctatttctttgtctcgcttggttcgttacatgtctgccaaggatgacaagattgcggttgttgtcgggactgttacagatgatgtgagggttgatgaaatcccatgtatgaaggtaactgccttgaggtttactgagactgctagagcaaggattgagaaggcaggaggagaatgtttgacctttgatcagcttgctcttcgagctcctgttggacagaacactgttcttcttagaggcccaaagaattgtcgtgaagcagtgaggcactttggtaaggctcctggtgtaccacacagccacaccaagccgtatgtgagatcaaagggaaggaagtttgagaaggccagaggtagaagaaacagcaggggatttagaaactaagatcatcattgatgttttccatgaatttgtttcagtgttctatttcccaggctctcaatatcgtgttttctagtaaacctttagttccattttgcgtacttcccatgactgaaaaatttgtcgttaacacccgtccttttttggtaatgaaattcgagatctggatctggttgagatttcttgttatatgttg

SEQ ID NO: 4504 - DNA, 797 bp, Artemisia annua
  misc_feature (253)..(253): n is a, c, g, or t
atcgtgtttccatttttccgctcgacaccaatctccgccgccgaaaatgggtatcgatcttattgctggtggtaagagcaagaggaccaaaagaactgctcctcgatccgatgacatctaccttaaactcctcgtcaagttgtataggtttttggtaaggaggacaggaagtaagttcaatgcggtgatattgaagaggttgtttatgagcaaagttaacaagcctcctatttctttgtctcgcttggttcgntacatgtctgccaaggatgacaagattgcggttgttgtcgggactgttacagatgatgtgagggttgatgaaatcccatgtatgaaggtaactgccttgaggtttactgagactgctagagcaaggattgagaaggcaggaggagaatgtttgacctttgatcagcttgctcttcgagctcctgttggacagaacactgttcttcttagaggcccaaagaattgtcgtgaagcagtgaggcactttggtaaggctcctggtgtaccacacagccacaccaagccgtatgtgagatcaaagggaaggaagtttgagaaggccagaggtagaagaaacagcaggggctttagaaactaagatcatcattgatgttttccatgaatttgtttcagtgttctatttcccaggctctcaatatcgtgttttctagtaaacctttagttccattttgcgcactttctatgactgaaaaatttgtccttaacatccgtccttttttggtaatgaaattcgagatccggatctggttgagatttcttgttag

SEQ ID NO: 4505 - DNA, 741 bp, Ocimum basilicum
gcgcgagacgagcaacagcagccatgggtatcgatttggtcgccggaggtaaggtgaagaagaccaagcgcacagcgccgaaatcgaacgatatctatctcaagctcctcgtcaagctgtaccgctttttggtcagaagaactggaagcagattcaatgctgtggttttgaagagactgtttatgagcaggattaacagacctccactttctctctcccgcctttccgctctcatgaaggggaaggaagacaagattgcagtacttgttggtagcgttaccgacgatgtacgtgcgcacgacatccctgccattaaggtcacagctctcagattcaccgagagagcgagggctagaatcgagaaggctggtggagaatgcttgactttcgaccagcttgctctcagagctccacttgggcagaatacggtgctgttgagagggtcacgcaacgctcgtgaagctgtgaagcacttcggaccagctcctggtgttccacacagccacaccaagccttacgtccgatccaagggacgcaagttcgagcgtgcacgaggaaagagaaacagcaggggcttcagggtttaagtttcgaattttgtttgtgttggacatttgtcttgtcgttctagtgcttttcatctggtaatcaaatgctgagttctcagattgctattttgggatatgattggtttgtatttgatatatcttgcctctgaaatatcactaaaccatatttact

SEQ ID NO: 4506 - DNA, 795 bp, Cichorium intybus
ccctagcttttctattttccgcccgaaacaacaattctctgcaggtagcagcagcctccgccgctgtcatgggtatagatcttgttgccggtgggaagagcaagagaaccaaaagaacagccccgagatccgatgatatctacctgaagcttcttgtcaagctctatcgatttttggtgagaaggacaggaagcaactttaatgctgtcatactgaagaggctctttatgagcaaagtcaacaagcctccgatttctctctcccggctgattcgttatatgtctggcaaggatgggaagattggtgtggttgtgggcacagttacagacgatgttagggtgcatgaaatcccttgtctcaaggtaactgcactgaggtttacagagactgcgagggcaaggattgagaaggcaggtggagaatgtctgacatttgatcagctggctcttcgagctcctcttgggcagaacacggttcttcttagaggtccaaagaattcacgtgaagctgtgaggcattttggtaaggctcctggtgtgccacacagccataccaagccttatgtcagatcaactggaaggaaatttgagaaggccagaggtagaagaaacagcaggggcttcagaaactaagccatcatcaatcaatccgttcccatgttttgttgccctgatttccaatattatgttcctgattattaatctcttacttcttgattgcgtacttgctatattcacttccatctttttttgggtaatgaagttggaggtttggactccaagtagtttcttgaat

SEQ ID NO: 4507 - DNA, 680 bp, Cycas rumphii
ttggatcgacagcaacaatgggtatagatttgatagctggaggtaagagtaagaagaccaagcggacggcccccaaaagcaatgatatctacctgaagcttctcgtcaagttataccggtttctggtgaggagaaccaacagtaggttcaatgcggtgattttgaagaggctgtttatgagcaggaccaacaaaccgccgctgtccctgtctcggttggttcgtttcatgacgggaaaggacgacaagattgcggtagttgtaggcaccattaccgatgacactagggtttttgagttgcctcctttgaagataacggctcttaaatttaccgagactgcaagagctcgtattttgaaggcgggaggcgaatgctggagtttcgatcagcttgctctgcgggcacctctaggacaaaacacggtcctcttacgtggtccaaagagccatcgggaggctgtcaaacactttggaagggcaccaggtgtgcctcatagtcataccaaaccttatgtccgctcgaaagggaggaagtttgagaaggctcgtggaaggagaaagagccgtggcttcaaggtctaaattttctcagggcattttgaaacacttgggagcttttgaagagacttgtgcggatatcttgaggtttattgttttgtctctggcaattgtaagtagtga

SEQ ID NO: 4508 - DNA, 881 bp, Medicago truncatula
agtattaccagcaacaaccttggtgtagcagtcgggcgtgttgaagaccggaagcagccatgggtatcgatcttaaggcaggaggtaagaacaaaaaaacaaaaagaacagcaccaaaatccaatgatatctatctcaagcttttggtcaagctttatcggttccttgttcggagaactggcagcaatttcaatgctgttatactcaagaggttgtttatgagcaaggttaacaaacctccactatctttgtcaaggttgatcaagtataccaatgggaaggaaggtaaaattgctgtcgtggtgggggctataactgatgatgtccgtgttaatgaagttccagccataaaggttacagcactcaggtttaccgagagggcaagggcaagaatagaaagtgctggtggtgaatgcttgacattcgatcagttggctcttagggcccctctgggacaaaacacggttcttcttagaggcccaaagaatgctcgtgaagcagtgaagcactttggtcgtgctcctggtgtcccacaaagccacaccaaaccttatgttagaggaaagtcaaggaagatcgagaaggctagaggaaagaggaagagcagaggattcagagtttgatgtgatagtatttctttgctggtattattacttttgaaattcagattttgtctacatctaaacagtgttgttatttatgtttgataatgattttcagtatggagattttattccttgctcccttattttctgtggttgtgttttgtgtcgccttagttacagttttgatgttagagaatgggtagttgttaattaaggatgcatggttgtgcattgtgaaattcaaacatgttatggtgcttggctagattttctaaa

SEQ ID NO: 4509 - DNA, 874 bp, Medicago truncatula
  misc_feature (796)..(796): n is a, c, g, or t
  misc_feature (816)..(816): n is a, c, g, or t
  misc_feature (818)..(818): n is a, c, g, or t
ggagcaacaaccttggtgtagcagtcgggcgtgttgaagaccggaagcagccatgggtatcgatcttaaggcaggaggtaagaacaaaaaaacaaaaagaacagcaccaaaatccaatgatatctatctcaagcttttggtcaagctttatcggttccttgttcggagaactggcagcaatttcaatgctgttatactcaagaggttgtttatgagcaaggttaacaaacctccactatctttgtcaaggttgatcaagtataccaatgggaaggaaggtaaaattgctgtcgtggtgggggctataactgatgatgtccgtgttaatgaagttccagccataaaggttacagcactcaggtttaccgagagggcaagggcaagaatagaaagtgctggtggtgaatgcttgacattcgatcagttggctcttagggcccctctgggacaaaacacggttcttcttagaggcccaaagaatgctcgtgaagcagtgaagcactttggtcgtgctcctggtgtcccacaaagccacaccaaaccttatgttagaggaaagtcaaggaagatcgagaaggctagaggaaagaggaagagcagaggattcagagtttgatgtgatagtatttctttgctggtattattacttttgaaattcagattttgtctacatctaaacagtgttgttatttatgtttgataatgattttcagtatggagattttattccttgctcccttattttctggggttgggttttggttgccttagttacagttttgatgttaaaatgggncagttgtaattaaggatgcntnggttatgccgttgggaaattcaaacatgttatggggctggctagatttttaaaaaa

SEQ ID NO: 4510 - DNA, 782 bp, Nicotiana benthamiana
  misc_feature (150)..(150): n is a, c, g, or t
  misc_feature (186)..(186): n is a, c, g, or t
  misc_feature (754)..(754): n is a, c, g, or t
  misc_feature (756)..(756): n is a, c, g, or t
atcgatttgaaggccggaggtaagagtaagaagactaagcgtactgcccctaaatctgacgatgtttacctcaagctactcgtcaagctttaccgattcctggtaaggaggaccggaagcaagttcaatgcggtggttcttaagaggctnttcatgagcaagatcaacaagcctccactttctctntcgaggttgatttcttatgccaaaggaaaggaggataaggttgtggtgattgtgggtactattaccgacgatgttagggcttatgaggttccagcattgaaggtgtgtgctttgagattcactaagactgccagggctaggattgagaaggctggtggcgagtgcttgacattcgatcagctggctctcagggctccacttggccagaacacgcttctcctaaggggtcctaagaatgcacgtgaagcagtgaagcactttggtccagctcctggtgttccacacagccataccaaaccatttgtgcgttccaaaggcagaaagtttgaaagggctcgaggaagaagaaatagcaggggttacaaggcttaggttgatttcagttattaccctcagaatggtttttaccatttgtgttgctacaatataagtttttgcagactctagcatgcaagttgcagcaagttgcttatgtttactcgtctttgtcaaggatatttgagctctatcaactttgatgccaaagttttggtttaaaacgaatgtatctttcagtttgttttagtanangccagaaattatgacttgtttaggca

SEQ ID NO: 4511 - DNA, 1331 bp, Papaver somniferum
  misc_feature (277)..(277): n is a, c, g, or t
  misc_feature (751)..(754): n is a, c, g, or t
  misc_feature (756)..(757): n is a, c, g, or t
  misc_feature (759)..(760): n is a, c, g, or t
  misc_feature (765)..(767): n is a, c, g, or t
ccagagcagaagcagagaagaaaccagagccatgggtatcgatttgattgctggaggtaagagcaagaaaacaaaaagaacagcacccaaatctgatgatatttatctcaagcttctcgtcaagctttaccgattcttgttgaggagaactggtagtaagttcaatggtgttatattgaagagattgtttatgagtaaggtcaacaaagctccactgtctctgtccagattgattaagttcatggataacaagggagagaagattggtgtacttgtnggtacagttactgatgatgtaaggatagtaaaggaagtaccaaaaatgaagattgctgcgttgaggtttactgagactgctagagctaggattgagaaagctggtggagagtgcttgacttttgatcagcttgctctgagagctcctcttggacagaacacggttcttctcagaggtccaaagaactcccgtgaagcagtgaagcatttcggagctcctggcgtgccacacagtcacagcaagccttatgtgcgttccaagggaagaaaattcgagaaagccagaggaaagagaaacagcagaggtttcagagtttaagtggttgtttatcacatgcttttatctcaattcagacttttcaatcccaagtgttaatcctatcttatatacaattttccttttgttgtttttggtggattagtgttaacttttaacaagacatcgatctatgttatatctagatttcttatctgnnnnannannaaaannntcgagacgagagagagatagtctcgagtttttttttttttttttttttttttttacaactggaacgttcaaatttttcattttcaagtggacaaattcgacttacactttgaagttaactaaaaggagttttaacataacactccagatacactcaaaagtaaagatgataacttattcttctaacaatccccttcaatctgatgtagggtgagaacaatacatcagttgacaaacaagattaaagaaagttgtagaggagagtcccttggtaaacagatcagccaattggtgagatgaaagaatgaactgcactgcactgcaactgtatcagcatccatcaagtctcgaacaaagtgatagtccacttcaatatggttagttctagcatgaaaagtaggatttgaatctaagaactgagcatccatattgaagaaaagtaaagttgttgtagttggaggtggaattgctggggcccttcttgctaaatctcttcagttccatgctgatgttgttctttatcgatccgaaggagtattttgagatcacatatgcaaatctgaga

SEQ ID NO: 4512 - DNA, 723 bp, Raphanus sativus
gggtatcgatcttatcgccggaggtaagagcaagaagaccaaaaggacagctccaaagtccgatgatgtctacctcaagcttctcgtcaagctatatcggtttttggtaaggagaaccggaagcaagttcgatgctgtgatcctcaagaggcttttcatgagcaaagtcaacaaggctcctctttcactctccaagctcgttgagttcatgaacgacaaggatggtaagattgctgtgttggttgggacaatcactgatgatctgagagtgcatgagattcctgcaatgaagtttactgccttgaggtttacggagcgagctagggctaggattgagaaagctggtggggagtgcttgacctttgaccagcttgctctcgttgctccattgggacagaacacggttcttcttagaggaccgaagaactctcgtgaggcagtgaagcactttggtccagctcctggtgtgccacacagccactccaagccttatgttaggtctaagggaaggaagtttgagaaagctagaggaaagcgaaagagtcgtggtttcaaggtctaagaaagtcctcaaaactgttttcgagtttgttgtttctttatatggttgctgctttcagaatccaagtttttgtagaccacttttgttactctttgccttttgcagacattgttttgagttttctgtctttctgttctaatcgacaattgaatgttttgctt

SEQ ID NO: 4513 - DNA, 1155 bp, Picea glauca
acacttcatttaatttgatttgcattcgcatccaagttaaaactcagagctcttgaacttttactcatcccacagttttgtcaaaaccctaaaccctgcacacatcactgcctatttttttttctttttcgttcttgttcttattgtttcgtgaggtcttaggaggaacaggagggcgacaatgggtatcgacttaattgccggtggaaagagcaagcagaccaagcgtactgctcccaagagcgaggatatttacctcaagctcctcgtcaagttgtaccgttttttggtgaggagaaccagtagccgcttcaatgcagtaattttgaagaggctgttcatgagcaaaaccaacaagccaccgctatcgctttctcgtttggctcgttacatgcaggggaaggatgacaaggttgcagtggttgtgggcaccattacagatgataatagggtttatgaactgcctcctgtgaaggtaactgctcttagatttacagagacagcaagagctcgaattttaaaagcaggaggggaatgcttaacttttgatcagcttgcactgtgtgcacctcttggacagaacacggtcttgttacgtggtcccaagagccatcgcgaagctgttaagcactttggaagggcaccaggtgttccacacagccacactaaaccatatgttcgatcaaagggtaggaaatatgagatggctcgtggtaggagaaatagtcgtggcttcaaggtctagagaatcaaaggacttgatggtgattttagtctttcttgcgaggtttgcggatttcattagttttactattctgttgctggcaattgtaagtggtaactctagaatctagatgtttaatgttttgtttaaaacaatctcagattacatggcaaaccattgggatctgttggtttgctatcagagcttttcttcctataaaagggaggactgtcagttttacaacttttttcttcctatgaaatgggtactgagttttacaacttttgacgctgccttaactttctgtgaagggagggtcaccagttttacaacgagtcatctctaaagggtttttgagaccatttaatgatagctattttttttaatttaatgacttgaatttttctttctttgtttcccgaggactaaca

SEQ ID NO: 4514 - DNA, 759 bp, Brassica juncea
  misc_feature (136)..(136): n is a, c, g, or t
tgagaggagctgagacgacagagcaaggcaactgctcagcctttgcctccagcgaaacactccctcactgctgtctcaagcgaccaaccatcgtcgaccttctacccggaggtaagagcaagaaaaccaaaggacngctcctaagtccgacgatgtctacctcaagctcactgtcaagctttataggtttttggtaaggagaactcagagcaagttcaatgcagtgatcttgaagaggcttttcatgagcaaagtcaacaaagctcctctttctctatctagactcgtcgagttcatgactggcaaggaagataagattgctgtcttggttggaaccatcaccgatgatttgagagtacacgagattccagctatcaaagtcactgccttgaggttcacggaaagagccagggctcgcattgagaaagctggtggtgaatgcttaacctttgaccagcttgctctcagagctcctttgggacagaacacggttcttcttagaggacctaagaattcacgtgaggctgtgaagcattttggtcccgctcctggtgtgccacacagtcactccaagccatatgttcggtccaagggaaggaagttcgagaaggccagaggaaagaggaagagccgtggtttcaaggtttaagaacattgtctgtgtcactgaacttgattctgttgtgttgttgcttcttaatcactttcataatggggatttttgttagagaattgtgctttttggtgccttgtttcaga

SEQ ID NO: 4515 - DNA, 812 bp, Cynara scolymus
  misc_feature (183)..(183): n is a, c, g, or t
aaacctagcttttcatttttctgcaggtaccctacgccgctctctgggtatagatcttgttgccggtggtaagagcaagaaaaccaaaagaaccgctcctagatccgatgatatctacctgaagctcctcgtcaagctttatcggtttttggtgaggaggacaggaagcagcttcaatgctgngatactgaagaggctctttatgagcaaaatcaacaagcctccaatttctctttctcgtctgattcgttacatggctggcaaggacgataagattgcagtgattgttggcacagtaacagacgatgttagggtgcatgaaatcccctgcctcaaggtaactgcactgagatttactgagactgcaagggcaaggattgaaaaggctggtggagaatgtttgacatttgatcaattggctcttcgagctcctcttggacagaacactgttcttcttagaggaccaaagaattgccgtgaagcagttaggcactttggtaaggctcctggtgtgccacacagccacaccaagccctatgtgagatcaaagggaaggaaatatgagaaggctcgaggtagaagaaacagcaggggatttagaaactaaaatggttctccatgaatcgtttccgaagatttgtctcccagattccctatatcatgttctctatcaaaccttagctgttgtttgctttacttgctatgatgaaaattttgcttttgtactctggattgtgttgaaagatttgttggatgattttagatattgatgtttttatgttcagtatatccaagcttggtacttgatttcg

SEQ ID NO: 4516 - DNA, 1185 bp, Mesembryanthemum crystallinum
  misc_feature (29)..(31): n is a, c, g, or t
  misc_feature (38)..(39): n is a, c, g, or t
  misc_feature (49)..(49): n is a, c, g, or t
  misc_feature (54)..(54): n is a, c, g, or t
  misc_feature (57)..(60): n is a, c, g, or t
  misc_feature (630)..(630): n is a, c, g, or t
  misc_feature (652)..(652): n is a, c, g, or t
  misc_feature (661)..(661): n is a, c, g, or t
  misc_feature (663)..(663): n is a, c, g, or t
  misc_feature (668)..(668): n is a, c, g, or t
  misc_feature (674)..(674): n is a, c, g, or t
  misc_feature (677)..(677): n is a, c, g, or t
  misc_feature (682)..(682): n is a, c, g, or t
  misc_feature (686)..(687): n is a, c, g, or t
  misc_feature (697)..(697): n is a, c, g, or t
  misc_feature (712)..(712): n is a, c, g, or t
  misc_feature (723)..(723): n is a, c, g, or t
  misc_feature (728)..(728): n is a, c, g, or t
  misc_feature (740)..(740): n is a, c, g, or t
  misc_feature (752)..(752): n is a, c, g, or t
  misc_feature (757)..(757): n is a, c, g, or t
  misc_feature (760)..(760): n is a, c, g, or t
  misc_feature (779)..(779): n is a, c, g, or t
  misc_feature (781)..(781): n is a, c, g, or t
  misc_feature (792)..(793): n is a, c, g, or t
  misc_feature (797)..(797): n is a, c, g, or t
  misc_feature (802)..(802): n is a, c, g, or t
  misc_feature (804)..(804): n is a, c, g, or t
  misc_feature (810)..(810): n is a, c, g, or t
  misc_feature (814)..(814): n is a, c, g, or t
  misc_feature (822)..(823): n is a, c, g, or t
  misc_feature (830)..(830): n is a, c, g, or t
  misc_feature (837)..(837): n is a, c, g, or t
  misc_feature (841)..(841): n is a, c, g, or t
  misc_feature (845)..(845): n is a, c, g, or t
  misc_feature (850)..(850): n is a, c, g, or t
tcatgagactcttcgattgcttcgaaccnnngtgctgnnccaattcgcngccgngtnnnngccgatctctcagcagcagcagcagcagaagatcagtttctacaggccacaatgggtattgatttgaaggccggaggtaagagcaagaagacaaagcgcacagcgcccaaatccaacgatgtttacctcaagctcctcgttaagctctaccgtttcctcgttagaagaactggtagcaagttcaatgctgtgattttgaagaggctttttatgagcaagattaacaagcccccactatctctctctaggctcattaagtacatggagggcaaggatggaaggattggtgttttggtgggcacagtgactgatgatgtgagggtgtatgaagtgcctactctcaagatttgcgctttgaggttcactgaaactgccagggctcgcatcgagaaggccggtggcgagtgcctcacttttgatcagctggctcttagagctcctcttggccagaacacggttcttctcagaggccccaagaatgccagggaggcagtcaagcactttggcaaggctcctggtgttccccacagtcacaccaagccttacgttcgtgctaatggcaggaaattngaaagggctagaggtagacgtnacagccgtngntacangaattnagntagtngcanntttgaggcangaatgcttgtttctntcaatgttcanaactngtgctactactnggttctgtgttntcgtntgncagttatatgttgattatnanaccaaaatgtnngctntgcanantttgtntcgngattctanngatcctnttgtatnaatnatgntatantatattcctttatgctctctacctctattcattctctctataataaacctgtggtgtggctttgtaccaattttcctttattgtagtcttatcactcctcattgcgctctttaatcgcttcttgtaaacctttttaccactttatggatgcgtcaattccttctcagcgcctcttctatacttaccttccgtctcatatttctaccttacgtacggtctctctttagtccttattcgtccttatgtctcctacttcctctcttcttcccatcctcctctcctctacttctctctccatctatctctctccatatatatagcttttattcctttcg

SEQ ID NO: 4517 - DNA, 988 bp, Medicago truncatula
aagcagtggtatcaacgcagagtggccattacggccggggagccccatttcactcgttcggccgcagcttgaagcttcttcaccatgggtatcgatttgaaggcaggaggtaagtccaagaagactaaacgtacagcaccaaaatccaatgatatctacctcaagcttctcgttaagctataccgtttccttgttcgaaggactgaaagtaatttcaataaggttatccttaagaggcttttcatgagcaaagtcaacaagccacctttatcactgtctaggttgattcgttacaccaaaggaaaggagggtaagattgctgtagttgttggtgccgtgacagatgatattagggtttatgaagtacctgcaattaaggtaactgctctaaggttcaccgaaaaggccagggctagaattgagaaggctggtggggagtgcctcacctttgatcagctggctcttagagctcctttaggccagaacacggttcttcttagaggtcccaaaaatgctcgtgaggctgtcaagcacttcggacgagctcctggtgtgccacacagcaacactaagccctatgtccgtgggaaaaaatcacgaaaggttgaagccgctagaggaaaaaggaagagcagaggctttaaagtttgagttttggtctcaaacatcaatgccctttcccattatcatatctcattatcattgttctgtattgttttgttttctccctttgtggtgtcttgaacaatttgttttgtttttagcgtccttctcccccaagtggaaaaggaatgaatggatcggctttcgaacaattttgatttagaacaaactttcctgttaactttagacaatcaatgagtaacctgttgttctacagtttacattcttgtgccctcatagtgttgggaagggggagttgaacttgaagcagggtacagtttctgagtttaaattggtaggataaatataaatttaattgcctaaa

SEQ ID NO: 4518 - DNA, 854 bp, Medicago truncatula
aggtacgcggggagccccatttcactcgttcggccgcagcttgaagcttcttcaccatgggtatcgatttgaaggcaggaggtaagtccaagaagactaaacgtacagcaccaaaatccaatgatatctacctcaagcttctcgttaagctataccgtttccttgttcgaaggactgaaagtaatttcaataaggttatccttaagaggcttttcatgagcaaagtcaacaagccacctttatcactgtctaggttgattcgttacaccaaaggaaaggagggtaagattgctgtagttgttggtgccgtgacagatgatattagggtttatgaagtacctgcaattaaggtaactgctctaaggttcaccgaaaaggccagggctagaattgagaaggctggtggggagtgcctcacctttgatcagctggctcttagagctcctttaggccagaacacggttcttcttagaggtcccaaaaatgctcgtgaggctgtcaagcacttcggacgagctcctggtgtgccacacagcaacactaagccctatgtccgtgggaaaaaatcacgaaaggttgaagccgctagaggaaaaaggaagagcagaggctttaaagtttgagttttggtctcaaacatcaatgccctttcccattatcatatctcattatcattgttctgtattgttttgttttctccctttgtggtgtcttgaacaatttgttttgtttttagcgtccttctcccccaagtggaaaaggaatgaatggatcggctttcgaacaattttgatttagaacaaactttcctgttaactttagacaatcaatgagtaacctgttgttctacagtt

SEQ ID NO: 4519 - DNA, 819 bp, Mimulus guttatus
ttcaccactcccatcaaacaagcagcagttgcgcaagcggaggagcaggcagccgtcgtcgaagccatgggtattgatttagtcgccggaggtaagagcaagaaaaccaagcgcaccgcccctcgatccaacgatgtttacatcaaactcctcgtcaagctgtaccgattccttactagaaggaccggaagcagttttaactcgattatactgaagaggcttatcatgagtagggttaacaggccgccgctctctctctcccgcctcagctctctcatgaagggcaaggagggtcagattgcggtacttgttggaagcattacggacgacattcgtgtgcacgaaatccctgccatgaaagttgctgctttgaggtttacggagaccgcgagggctagaatcgagaaggctggtggtgaatgtttgactttcgatcagcttgctctcagggctcctcttggccagaacactgtgctgttgagaggttcaaggaaggctcgtgaagctgtgaggcactttggaccagcacctggtgttccacacagccacaccaagccttacgttcgctccaagggtaggaagtttgagaaggccaggggtaagagaaacagtaaaggatttagagtttaatttactattcttagaaatcgtcgacttttattttcggattttatgtttgccggaggatatttatttgatagttttgtatcccaagtaattagacctgtcgttttgctctcttattgttttgaaagttgttggatactgattttgtctcgtcttttattaaagtggtattgttatttttctctgctgctt

SEQ ID NO: 4520 - DNA, 866 bp, Mimulus guttatus
ataatcccccgtctgtatcactccacacctagcagcggcgctctagcaccatgggtattgatttagtcgccggaggcaagagcaagaagaccaagcgcactaaacccaaatccgatgatatctacatcaaactgctcgtcaagttgtactcatttctggtgaggaggactggtagcaagttcaatgaagttgttcgtaagcgtctgactatgagtcgggttaacaggccccctctttctctctctcgcctcagcgctctcatgaagggcaaggagaaccaaattgcagtccttgttggtagtgtcacggacgacatccgtgttcatgaaatcccagccatgaaggtggctgctctgaggttcaccgagaccgcaagagctcgaatcgagaaggctggtggtgaatgtttgacttttgaccagcttgctcttagggctccacttggacagaacacggtgattctgaggggttcaaggaaggctcgtgaagcagtgaggcactttggtgccgcacctggtgttcctcacagccacaccaagccctatgtgcgctctaagggcaggaagtttgagaaggccagaggtaggcgaaagagcaggggtttcagggtttgatttatttgcgttaccagtcaagtttgtttctcgattttgtgcttttcgaatattatttgatagacttgtactgattagacatgccttttttacgaatctgttgttttgaaaattttgggattgatttctcttctcatatcttgtgtgtgccccttactaatgtgctcttcaagaaattggacaaactttattattcgtcctgagttttgatatttattatacgtggtatgttatctttccttgacgtctcgt

SEQ ID NO: 4521 - DNA, 820 bp, Salvia sclarea
ggggatcgaagagcaggtgcagttgcggcaggcgagagaagcagcagcagcaaaatgggtatcgacttggtcgccggaggtaaggtcaagaagaccaagcgcacagcgccaaagcccaatgatatttatctcaaactcctcgtgaagttgtaccggtttttggtgaggagaacgggaagcaagtttaatgcggtggttctgaagagactattcatgagtaggattaacaggcccccactctctctctcccgtcttagcgcactcacgaaagggaaggaagacaagattgcagtacttgtaggaagtgttactgatgacattcgtgttcatgacattcctgccatgaagatcacagctctgagatttaccgagagagctagggctagaattgagaaggctggtggagaatgtttgacttttgaccagcttgctctaagggctccgcttgggcagaatacggtcctcttgagaggctcaaggaatgctcgtgaagctgtcaagcactttggcccagctcctggtgttccacacagccacaccaagccttacgtccgagccaagggacgcaagtttgagcgcgccagaggaagaagaaacagcagaggtttcagggtttaagttattcatagctatgaagttcattgccaattttggctgttgagactgttggagacttggtattgctgtagtgctctagtttgtgccatgcccttgaaaagttttggacaattttgtttcctgagatattttataaatcattatcctactttgaatattgtgttctccatttgctattttggtatggttgatttgtatttcc

SEQ ID NO: 4522 - DNA, 883 bp, Solanum phureja
atattaatataagaggcgcctcttgcagccatttctccatctctctcagctgagtccaaccagccatgggtatcgatctgaaggccggaggtaagagtaagaagactaagcgtaccgctcctaagtctgacgatgtttacctcaagctcctcgtcaagctttaccgattcttggcaaggaggaccggaagcaagttcaatgcggtgattcttaagaggctcttcatgagcaagattaacaagcctccactctctctctcgaggttgatttcttatgccgaaggaaagggcgataagactgttgtccttgtgggtactgttaccgacgatgttagggcttatgaagttccaaaattgaaggtgtgtgctttgaagttcacaaagacagccagggcaaggattgagaaggctggtggtgaatgcttgacattcgatcagttggctctcagggctccacttggacagaacacgcttctcctcagaggtcctaagaatgcacgtgaagcagtgaagcactttggcccagctccaggtgttccacacagccataccaaaccatatgtccgtgccaagggaagaaagtttgagagagctagaggaaagaggaagagcaggggttacaaggtttaagttgatttctattatttatctaagaatggttgttatttgtatcgtggcagtacaagtttttgcagactctagtatgcagttgcttatgtttactcccgtcttgttgaggatatttgatttttattcactgtgaaaccaacttttagtttaaaaaatgattgtggtgcatcagtttatcgttgagcaaaagtcatataatatgacttaagttttactttcccatcctcatgttctatggattgggttgtttggaa

SEQ ID NO: 4523 - DNA, 708 bp, Antirrhinum majus
  misc_feature (16)..(17): n is a, c, g, or t
  misc_feature (19)..(19): n is a, c, g, or t
  misc_feature (22)..(22): n is a, c, g, or t
cggcacgagagccagnngnagnagatgggtattgatttagttcgcggaggtaagagcaagaagaccaagcgcacagcgcccaaatccaatgatatttacctcaaactcctcgtcaagttgtaccgttttctggtgaggagaactgggagcagcttcaatgcggttgtactgaagaggctgttcatgagtaaggtcaacaaggcccctctttccctatcacgcctcatcgccctcatgaagaacaaggaggacaaggttgcagttcttgttggaactgttaccgatgatattcgggtgcatgaagttcctgctctgaaggtcactgcgttgagattcaccgagacagctagggccagaattgagaaggcaggtggggagtgtctgactttcgatcagcttgctcttagggctccgcttggacagaatacggtactcttgagaggcccgcgaaaggctcgtgaagctgtgaagcactttggtccagctcctggtgttccacacagccacaccaagccttacgtccgagccaaggggaggaagtttgagcgtgctagaggaaaaagaaacagcaagggtttcagggtttaagttacttagaattaatatgaagttttattttagacactatgttcatggaatactaagtgagattttgcctttgcctatttcttgtgcgcttatttcaactttcaggagctcttggaaaca

SEQ ID NO: 4524 - DNA, 802 bp, Antirrhinum majus
tgcaggcacaaagcggcagcaggagccatgggtattgatctagtccgcggaggtaagagcaagaagaccaagcgtaccgcacctaaatccaatgatatttacctcaagctcctcgtgaagttgtaccggtttttggtaaggagaactggaagtagctttaatgctgtggtattgaagaggcttttcatgagtaaggtcaacaaggccccgctctccctgtcgcgtctcatcgctctgatgaagaacaaggaggacaagactgctgtgcttgttggaactgttactgatgatattagggtgcacgaggtccctgctcttaaggtaactgctctgagattcactgagacagccagggctagaattgagaaggcaggtggagaatgtctgactttcgaccagcttgctctgagggctccccttggccagaacacggtactcttgagaggtccaaggaaggctcgtgaagcagtgaagcactttggtccagctcctggtgttccacacagccacaccaagccttacgttcgtgccaaaggtagaaagtttgagcgtgctagaggaaagaggaacagcaagggtttcagggtttgagttattatgtattgttgttatgaagctagatatcagattttatgttggaataccattttgaacattttgcttcccgctcctttagttcttgtgctcttgttcaagaacttctggatgcagctgttaccttcacatatgctcttttatctgttttgccccttgaaaattttgcagaatacttgaacttagaaactttatcttaattttactt

SEQ ID NO: 4525 - DNA, 576 bp, Trifolium pratense
tcctccacaactctaagctacaatggggatcgatcttaaagctggtggtaagagcaaaaaaaccaaacgaacagctccaaaatccaatgatatctacctcaagctactcgtcaagctatatcgctttcttgatcgaaggacggacagcaatttcaattctgtaatactcaagcgcttgttcatgagcaaggtcaaccgacctccaatttctttatcaagggtgatcgagtacttgaaggggaaggatggtaaaattggtgttatcgtcggtgctgtaactgatgatatcagagtatatgaagtcccagcaataaaaatagctgcactcaggtttacagagactgcacgtgcaagaatagagaaagctggtggtgaatgcttaacatttgatcaacttgctcttagggctccccttggacagaacacggttcttctaagaggcccaaagaattctcgtgaagcagtgaaacactttggtcgtgctcctggtgtgccacacagccataccaagccttatgtaagagcgaagggaaggaaatttgagaaggctagaggaaagaggaacagcagaggatt

SEQ ID NO: 4526 - DNA, 781 bp, Lactuca sativa
acacgcagccgtcgccgtcatgggtatagatcttgttgctggtggaaagagcaagaggaccaaaaggaatgctccacgttccgatgatatctaccttaagctcctcgtcaagctttatcggtttttggtgaggaggaccggaagtaacttcaatgcagtgatactgaagaggctctttatgagcaaagtcaacaagcccccgatttctctctctcgcttgatccgttacatggctggcaaggacgataagattgctgtggttgttggcacagtcaccgatgatgttagggttgatgaaatcccatgtatcaaggtcactgctctgaggttcaccgagactgcaagggccaggatcgagaaggctggtggtgaatgcctgacttttgaccagttggcccttcgagctcctcttggccagaacacggtacttcttaaaggtccaaagaactgcagggaagcagtgaggcactttggaaaagctcctggtgtgccacacagccataccaagccgtatgtgcgatccacggggaggaagtttgagaaggcaagaggaagaagaaacagcagaggcttcagaaactaagtgcggtcatcaatggtgggtgtctttgaattgttgcaaaagttctatcatctctttttatgctggtgttgtttggattaaagctatgatgaaaattttggtgtttggtaatatgttatatgtagcagcagggagtttttgatttctaatttaccttcaacaattgtttaatggagatcaattttaatcatttatgtt

SEQ ID NO: 4527 - DNA, 798 bp, Solanum tuberosum
cggggattaatataagaggcgcctcttgcagccatttctccatctctctcagctgagtccaaccagccatgggtatcgatctgaaggccggaggtaagagtaagaagactaagcgtaccgctcctaagtctgacgatgtttacctcaagctcctcgtcaagctttaccgattcttggcaaggaggaccggaagcaagttcaatgcggtgattcttaagaggctcttcatgagcaagattaacaagcctccactctctctctcgaggttgatttcttatgccgaaggaaagggcgataagactgttgtccttgtgggtactgttaccgacgatgttagggcttatgaagttccaaaattgaaggtgtgtgctttgaagttcacaaagacagccagggcaaggattgagaaggctggtggtgaatgcttgacattcgatcagttggctctcagggctccacttggacagaacacgcttctcctcagaggtcctaagaatgcacgtgaagcagtgaagcactttggcccagctccaggtgttccacacagccataccaaaccatatgtccgtgccaagggaagaaagtttgagagagctagaggaaagaggaagagcaggggttacaaggtttaagttgatttctattatttatctaagaatggttgttatttgtatcgtggcagtacaagtttttgcagactctagtatgcagttgcttatgtttactcccgtcttgttgaggatatttgatttttattcactgtgaaaccaacttttagtttaaaaaatgattgtggtg

SEQ ID NO: 4528 - DNA, 671 bp, Solanum tuberosum
ggcgcctcttgcagccatttctccatctctctcagcagagtccagccagccatgggtatcgatctgaaggccggaggtaagagtaagaagactaagcgtaccgcccctaagtctgacgatgtttatctcaagctcctcgtcaagctttaccgattcttggcaaggaggaccggaagcaagttcaatgcggtgattcttaagaggctcttcatgagcaaaattaacaagcctccactttctctctcgaggttgatttcttatgccgaaggaaagggcgataagactgttgtccttgtgggtactgttaccgacgatgttagggcttatgaagttccaaaattgaaggtgtgtgctttgaagttcacaaagacagccagggcaaggattgagaaggctggtggtgaatgcttgacattcgatcagttggctctcagggctccacttggacagaacacgcttctcctcagaggtcctaagaatgcacgtgaagcagtgaagcactttggtccagctccaggtgttccacacagccataccaaaccatatgtccgtgccaagggaagaaagtttgagagagctagaggaaagaggaagagcaggggttacaaggtttaagttgatttctattatttatctaagaatggttgttatttgtatcggggcagtacaag

SEQ ID NO: 4529 - DNA, 812 bp, Solanum tuberosum
atataagaggcgcctcttgcagccatttctccatctctctcagcagagtccagccagccatgggtatcgatctgaaggccggaggtaagagtaagaagactaagcgtaccgctcctaagtctgacgatgtttacctcaagctcctcgtcaagctttaccgattcttggcaaggaggaccggaagcaagttcaatgcggtgattcttaagaggctcttcatgagcaagattaacaagcctccactctctctctcgaggttgatttcttatgccgaaggaaagggcgataagactgttgtccttgtgggtactgttaccgacgatgttagggcttatgaagttccaaaattgaaggtgtgtgctttgaagttcacaaagacagccagggcaaggattgagaaggctggtggtgaatgcttgacattcgatcagttggctctcagggctccacttggacagaacacgcttctcctcagaggtcctaagaatgcacgtgaagcagtgaagcactttggtccagctccaggtgttccacacagccataccaaaccatatgtccgtgccaagggaagaaagtttgagagagctagaggaaagaggaagagcaggggttacaaggtttaagttgatttctattatttatctaagaatggttgttatttgtatcgtggcagtacaagtttttgcagactctagtatgcagttgcttatgtttactcccgtcttgttgaggatatttgatttttatctactttgaaaccaacttttagtttaaaatgattgtggtgcatcagtttatcgttgagcaaaagg

SEQ ID NO: 4530 - DNA, 903 bp, Artemisia annua
  misc_feature (900)..(900): n is a, c, g, or t
ctttgagcccccttcataataaacctaaacaccctctcaaatcttcctttgtgttgaaaaccctagcagcagcttctttttcctaacatttcttttgcaggcacaccaaaaccgccgtcgtcatgggtattgatcttattgcaggaggaaagagcaagaggaccaaaaggaacgcacctaggtctgatgatatctaccttaagcttctcgtcaagctatacaggtttttgtttaggaggactgggagtaagtttaatgcggtgatattgaagaggttgtttatgagcaaaattaacaagcctcctatttctttgtctcgtttggctcgttacatggctggcaaggacgagaagattgctgtgattgttggtacagttactgatgatgttcgtgtgcctgagattccttgcatgaaagttactgctttgaggttcaccgagactgccagagccagaattgagaaggctggtggagagtgcttgacctttgatcagttggctcttagagctcccgttggacagaacacggttcttctaagaggacccaagaactcccgtgaggcagtgaggcactttggaaaggctcctggtgtgccacacgcccacaccaagccgtatgtgcgatccaagggaaggaagttcgagaaggctagaggaagaagaaacagcagaggcttcagaaactaagccattgttaatgtcactgcagtggtactccttgacttcatgtcaagctctatacttctatcttaaaatttggtcatctgttaagctgttagacatacttgatatgatgaaagtttttgttgttaggcatctttttcagtattgtttgggtgttgtggatcttaaacattttcattcagatttctcgtttggttgcacttaaactgaatcttcntta

SEQ ID NO: 4531 - DNA, 756 bp, Ocimum basilicum
  misc_feature (110)..(110): n is a, c, g, or t
  misc_feature (114)..(114): n is a, c, g, or t
  misc_feature (275)..(275): n is a, c, g, or t
  misc_feature (362)..(362): n is a, c, g, or t
  misc_feature (374)..(374): n is a, c, g, or t
  misc_feature (428)..(428): n is a, c, g, or t
  misc_feature (654)..(654): n is a, c, g, or t
gcacccctttaaggggcgcgagacgagcaacagcagccatgggtatcgttttggtcgccggaggtaaggtgaagaagaccaagcgcacagcgccgaaatcgaacgatatntatntcaagctcctcgtcaagctgtaccgctttttggtcagaagaactggaagcagattcaatgctgtggttttgaagagactgtttatgagcaggattaacagacctccactttctctctcccgcctttccgctctcatgaaggggaaggaagacaagattgcngtacttgttggtagcgttaccgacgatgtacgtgcgcacgacatccctgccattaaggtcacagctctcagattcaccgagagagcnagggctagaatngagaaggctggtggagaatgcttgactttcgaccagcttgctctcagagctccncttgggcagaatacggtgctgttgagagggtcacgcaacgctcgtgaagctgtgaagcacttcggaccagctcctggtgttccacacagccacaccaagccttacgtccgatccaagggacgcaagttcgagcgtgcacgaggaaagagaaacagcaggggcttcagggtttaagtttcgaattttgtttgtgttggacatttgtcttgtcgttctagtgcttttnatctggtaatcaaatgctgagttctcagattgctattttgggatatgattggtttgtatttgatatatcttgcctctgaaatatcactaaaccatatttact

SEQ ID NO: 4532 - DNA, 578 bp, Glycyrrhiza uralensis
gagcccccattgtctcgcttcgcttggcttggctgcagaaggaagctccatccacaatgggaatcgacttgaaggcaggaggtaagtccaaaaagaccaaacgaactgcccccaaatccaatgatatttacctcaagctcctcgtcaagctctaccgtttccttgttcggaggactgggagtaacttcaatgccgtcatactcaagcgccttttcatgagcaaagtcaacaggcccccactatccctctctaggttgattcgttacatgaagggaaaggagggtaagatagctgtggttgttgggacagtgaccgatgacattagggtgcacgaagtccctgcactcaaggtaactgccctgaggttcacagaaactgccagagctagaattgagaaggctggtggggagtgcctcacctttgatcaactcgctcttagagcccctcttggccagaacacggttcttcttaggggtcctaagaatgcccgggaggctgtcaagcactttggaccggctcctggtgtgccacatagccataccaagccctatgtccgtgcaaaaggacgaaaatttgag

SEQ ID NO: 4533 - DNA, 1025 bp, Marchantia polymorpha
cctctctctctctccctcgactgcgcaagctcccgcaggatacctgccgagcaaagatgggtatcgacttgaaagccggtgggcgtaacaagaagaccacacgtactgctcccaagagtgacaatgtgtacttgaagcttcttgtgaagctttaccgatttctcgtgagaaggacggacgcttctttcaatgccgttgtcttgaagaggctgttcatgagtaaaacccacagggctcccatttccatgtctcgtctctcccgctacatgaaaggcaaggaagacaagatcgctgtgatcgttggaaccgtcaccgatgacgtgagattgtacgaggtccctgccttgaaggttgctgctcttaggttcactgagacggcccgtgcacgtatcttgaagaatggtggtgaaatctacaccttcgacgagcttgccctcaaggctcctaccggaaccggatgtgtgcttttgagaggacccaagaactcacgcgaagcagtgaagcactttggtagggcacccggagtgccacattcccacacgaagccatatgtccgacataagggtaggaaatttgagaaggccagaggtcgcaggaacagcagaggcttcaaggtctaatacacaattttgggatattgtagccactaatttgaaagtcacttcggcccagaccgaggtcgtttttctcggcggagtgcaaaactgtttgatactttaccctggaatcaagcatattctgtggatcccatggccaacatcgtgtgcttaactagagggggaaagttatcattgtgtcttcaggttctattcaacaattcgtgtagactttggaaatctcacatcacgcactcaaattagagtgtattacttagtcgcaaccaccaagatcaccctgttttgagctggatatatcctggagaagtgttggtctgtccgggagttattgtatagacggccttatgtttgatccagtgtcctgttgtctgaatttaatgcaagctctgattactgtgaaaaaaaaaa

SEQ ID NO: 4534 - DNA, 903 bp, Medicago truncatula
gcaattgaagtagcagtgtgctcatccagaaccctgagctacaatggggatcgatctcaaagctgggggtaagagcaaaaacaccaaacgaacagaacctaaatccaatgatatctacctcaagctcctcgtcaagctatatcgcttccttgtcagaaggactgacagcaatttcaatgcggtaatactcaagcgcttgttcatgagcaaggtcaaccgacctccaatttctctgtcaaagatgatcgagtacatgaaggggaaggacggtaaaattggtgtcgttgtgggggctgtgacagatgatatcagggtatatgaagtcccagtattaaaaattgctgcccttaggttcacagagacggcacgtgctagaatagagaaggcaggtggtgaatgcttaacatttgatcaacttgccctaagagctcccctgggacagaacacggtcctactaagaggcccaaagaatgctagggaagcagtaaaacactttggtcgtgctcctggtgtgccacacagccattccaagccgtatgtaagatcaaagggaaggaaacaagagaaagccagaggaaagaggaagagtagaggatttagggtttgagttgataatttttttaagtgtctttctacagttttgatacttctgaaattcaacttttatcagttttgcatgtgttatatttattgttacatattcagtattattgagattgttatacatggccttgcttttaacttgaatttgatgtctgccaataaatgggtattaagtttttagttatctagttagagagggtctttaaaagatagtgttgctagcattactcttttaccaatcatggttggcaaatgtaatatgttgtgaaatttagagaaataataataacgtgtttgctt

SEQ ID NO: 4535 - DNA, 929 bp, Medicago truncatula
ggaagtagcagtgtgctcatccagaaccctgagctacaatggggatcgatctcaaagctgggggtaagagcaaaaacaccaaacgaacagaacctaaatccaatgatatctacctcaagctcctcgtcaagctatatcgcttccttgtcagaaggactgacagcaatttcaatgcggtaatactcaagcgcttgttcatgagcaaggtcaaccgacctccaatttctctgtcaaagatgatcgagtacatgaaggggaaggacggtaaaattggtgtcgttgtgggggctgtgacagatgatatcagggtatatgaagtcccagtattaaaaattgctgcccttaggttcacagagacggcacgtgctagaatagagaaggcaggtggtgaatgcttaacatttgatcaacttgccctaagagctcccctgggacagaacacggtcctactaagaggcccaaagaatgctagggaagcagtaaaacactttggtcgtgctcctggtgtgccacacagccattccaagccgtatgtaagatcaaagggaaggaaacaagagaaagccagaggaaagaggaagagtagaggatttagggtttgagttgataatttttttaagtgtctttctacagttttgatacttctgaaattcaacttttatcagttttgcatgtgttatatttattgttacatattcagtattattgagattgttatacatggccttgcttttaacttgaatttgatgtctgccaataaatgggtattaagtttttagttatctagttagagagggtctttaaaagatagtgttgctagcattactcttttacaatcatggttggcaaatgtaatatgttgtgaaatttagagaaataataataacgtgtttgcttagatttggtataatttatgcaaacttaaaatc

SEQ ID NO: 4536 - DNA, 763 bp, Solanum tuberosum
gagtccagccagccatgggtatcgatctgaaggccggaggtaagagtaagaagactaagcgtaccgccccaaagtctgacgatgtttatctcaagctcctcgtcaagctttaccgattcttggcaaggaggaccggaagcaagttcaatgcggtgattcttaagaggctcttcatgagcaaaattaacaagcctccactttctctctcgaggttgatttcttatgccgaaggaaagggcgataagactgttgtccttgtgggtactgttaccgacgatgttagggcttatgaagttccaaaattgaaggtgtgtgctttgaagttcacaaagacagccagggcaaggattgagaaggctggtggtgaatgcttgacattcgatcagttggctctcagggctccacttggacagaacacgcttctcctcagaggtcctaagaatgcacgtgaagcagtgaagcactttggtccagctccaggtgttccacacagccataccaaaccatatgtccgtgccaagggaagaaagtttgagagagctagaggaaagaggaagagcaggggttacaaggcttaagttgatttctattatttaagaatggttgttatttgtatcgtggcagtacaagtttttgcagactctagtatgcagttgcttatgtttactcccgtcttgttgaggatatttgatttttatctactttgaaaccaacttttagtttaaaatgattgtggtgcatcagtttatcgttgagcaaaagg

SEQ ID NO: 4537 - DNA, 793 bp, Solanum lycopersicum
gatatattaatataagaggcgcctcctgcagccatttctccatctctctcagcagagtccagccagccatgggtatcgatctgaaggccggaggtaagagtaagaagactaagcgtaccgcccctaagtctgacgatgtttacctcaagctcctcgtcaagctttaccgattcttggcaaggaggaccggaagcaagttcaatgcggtgatacttaagaggctcttcatgagcaagattaacaagcctccactttctctctcgaggttgatttcttatgctgaaggaaagggcgataagactgttgtccttgtgggaactgttaccgacgatgttagggcttatgaagttccaaaattgaaggtgtgtgctttgaagttcacaaagacagccagggcaaggattgagaaggctgggggcgaatgcttgacattcgatcagttggctctcagggctccacttggacagaacacgcttctcctcagaggtccaaagaatgcacgtgaagcagtgaagcactttggtccagctccaggtgttccacacagccataccaaaccatatgtgcgtgccaagggaagaaagtttgagagagctagaggaaagaggaagagcaggggttacaaggcttaagttgatttctattatttatctcagaatggttgttatttgtatcgtggcagtacaagttttgcagactctagtatgcagttgcttatgtttgctcccgtcttgttgagaatactttatttttatctactttgaaaccaacttttagtttaaaatgattgtgg

SEQ ID NO: 4538 - DNA, 856 bp, Solanum lycopersicum
  misc_feature (854)..(854): n is a, c, g, or t
cggccggggattaatataagaggcgcctcctgcagccatttctccatctctctcagcagagtccagccagccatgggtatcgatctgaaggccggaggtaagagtaagaagactaagcgtaccgcccctaagtctgacgatgtttacctcaagctcctcgtcaagctttaccgattcttggcaaggaggaccggaagcaagttcaatgcggtgatacttaagaggctcttcatgagcaagattaacaagcctccactttctctctcgaggttgatttcttatgctgaaggaaagggcgataagactgttgtccttgtgggaactgttaccgacgatgttagggcttatgaagttccaaaattgaaggtgtgtgctttgaagttcacaaagacagccagggcaaggattgagaaggctgggggcgaatgcttgacattcgatcagttggctctcagggctccacttggacagaacacgcttctcctcagaggtccaaagaatgcacgtgaagcagtgaagcactttggtccagctccaggtgttccacacagccataccaaaccatatgtgcgtgccaagggaagaaagtttgagagagctagaggaaagaggaagagcaggggttacaaggcttaagttgatttctattatttatctcagaatggttgttatttgtatcgtggcagtacaagttttgcagactctagtatgcagttgcttatgtttgctcccgtcttgttgagaatactttatttttatctactttgaaaccaacttttagtttaaaatgattgtggtgcatcagtttattgttgagcaaaaatcatataatatgactagttgttacacattcnac

SEQ ID NO: 4539 - DNA, 802 bp, Artemisia annua
aacatttcttttgcaggcacaccaaaaccgccgtcgtcatgggtattgatcttattgcaggaaaagagcaagaggaccaaaaggaacgcacctaggtctgatgatatctaccttaagcttctcgtcaagctatacaggtttttggtgaggaggactgggagtaagtttaatgcggtgatattgaagaggttgtttatgagcaaaattaacaagcctcctatttctttgtctcgtttggctcgttacatggctggcaaggacgagaagattgctgtgattgttggtacagttactgatgatgttcgtgtgcctgagattccttgcatgaaagttactgctttgaggttcaccgagactgccagagccagaattgagaaggctggtggagagtgcttgacctttgatcagttggctcttagagctcccgttggacagaacacggttcttctaagaggacccaagaactcccgtgaggcagtgaggcactttggaaaggctcctggtgtgccacacgcccacaccaagccgtatgtgcgatccaagggaaggaagttcgagaaggctagaggaagaagaaacagcagaggcttcagaaactaagccattgttaatgtcactgcagtgtactccttgacttcatgtcaagctctatacttctatcttaaaatttggtcatctgttaagctgttagacatacttgatatgatgaaagtttttgttgttaggcatctttttcagtattgtttgggtgttgtggatcttaaacattttcattcagatttctcgtttggttgcacttaaa

SEQ ID NO: 4540 - DNA, 697 bp, Triphysaria pusilla
gagcaaggcgggtctgcaggcacaggagctatgggtattgatttggtcgccggaggtaagagcaagaagaccaagcgcacggcgccgaaatccaacgatatctatctgaaacttattgttaagttgtaccgatttttggtgaggagaaccggtagcagcttcaatgcagttgtactgaagcggttgtttatgagcagggtaaacaaagcccctatatcgctctccaagctcgcagctctcatgaagggcaaggagggcaagattgcggtgcttgttgggactgttaccgatgatatccgtttgcaagatgaagtccctgccatgaaggttactgctctaagattcacagaaacagcaagagctaggattgaaaaggccggtggtgaatgtttgacctttgaccagcttgcacttcgagctccccttggacagaacacggtgctcttgagaggttctcctaaggctcgtgaagcagtgaagcattttggaccagctcctggtgttccacacagccacaccaaaccgtatgtgagagcaaagggaaggaagttcgaaaaggcaagaggaaagagaaacagcaagggtttcagagtttgagttatttattaagtaagatctattccccttagtagttatatttttgcccggtttcttgttatgattttatcacttcaacagcttatcaatacctgtagta

SEQ ID NO: 4541 - DNA, 754 bp, Triphysaria pusilla
  misc_feature (250)..(250): n is a, c, g, or t
  misc_feature (748)..(749): n is a, c, g, or t
  misc_feature (751)..(751): n is a, c, g, or t
ctccattgacatttctcacatttcgagcaaggcggggctgcaggcacaggagctatgggtattgatttggtcgccggaggtaagagcaagaagaccaagcgcaccgcgccgaaatccaatgatatctatctgaaactcattgttaagttgtaccggtttttggtgaggagaaccggtagcagcttcaatgcagttgtactgaagcggttgtttatgagcagggtaaacaaagcccctatatcactctccnagctcgcagctctcatgaagggaaaggagggcaagattgcggttcttgttgggactgtaactgatgatatccgtttgcaagatgaagtccctgccatgaaggttactgctctgaggttcacagaaacagcgagggctaggattgaaaaggctggtggtgaatgtttgacctttgaccagcttgcacttcgagctccccttggacagaacacagtgctcttgagaggttctccgaaggcacgcgaagcagtgaagcattttggaccggctcctggtgttccacacagccacaccaaaccgtatgtgagagctaagggaaggaagtttgaaaaggcaagaggaaagagaaacagcaagggtttcagagtttgagttatttattaagtaagatctattacccttgagtagttatacaccgatttcttgttatgattttttcactccaacagcttatggatatttgtagtactcttatttacatgaatcattcaagttttgnngntta

SEQ ID NO: 4542 - DNA, 822 bp, Triphysaria pusilla
gtaaaaccctagctccaacactccattgacattttttcactttgagcaaggcgggcagcaggcacaagagccatgggtattgatttggtcgccggaggtaagagcaagaagaccaagcgcaccgcgcccaaatccaacgacatttatctgaaactcatcgttaagttgtaccgatttttggtgaggaggaccggtagcaaattcaatgcagttatactgaagcggttgtttatgagcaagatcaacaaaccacctctttccctttccaagctttcagctctcatgaatggcaaggaggacaagactgcagtgcttgttgggactgttactgatgatatccgattgcaaggtgaaatcccggccatgaaggttactgctctgaggttcacagaaacagcaagagctaggatcgaaaaggccggtggtgaatgcttgacttttgaccagcttgcacttagagcccctcttggacagaacacagtgctcttgagaggttgtcgtaaggctcgggaagcagtgaggcattttggagcagctcctggtgttccacacagccataccaaaccatatgtgagagctaagggaagaaagtttgaaaaggctagaggaaagagaaacagcaagggtttcagggtttgagattggttatcgtcaaagtcgattccaggttttgttttcgtcggttattatgtgtccacttagtggttatatcgtccccggtttcttattgttatttcattattccaacggcttttcgatatctggagtactctttttatttacaatgatcattcaagttttgataaaaaaaaaaaaaaaaaa

SEQ ID NO: 4543 - DNA, 815 bp, Triphysaria pusilla
gtaaaaccctagctccaacactccattgacattttttcactttgagcaaggcgggcagcaggcacaagagccatgggtattgatttggtcgccggaggtaagagcaagaagaccaagcgcaccgcgcccaaatccaacgacatttatctgaaactcatcgttaagttgtaccgatttttggtgaggaggaccggtagcaaattcaatgcagttatactgaagcggttgtttatgagcaagatcaacaaaccacctctttccctttccaagctttcagctctcatgaatggcaaggaggacaagactgcagtgcttgttgggactgttactgatgatatccgattgcaaggtgaaatcccggccatgaaggttactgctctgaggttcacagaaacagcaagagctaggatcgaaaaggccggtggtgaatgcttgacttttgaccagcttgcacttagagcccctcttggacagaacacagtgctcttgagaggttgtcgtaaggctcgggaagcagtgaggcattttggagcagctcctggtgttccacacagccataccaaaccatatgtgagagctaagggaagaaagtttgaaaaggctagaggaaagagaaacagcaagggtttcagggtttgagttttttatgattggttatcgtcaaagtcgattccaggttttgttttcgtcggttattatgtgtccacttagtggttatatcgtccccggtttcttattgttatttcattattccaacggcttttcgatatctggagtactctttttatttacaatgatcattcaagttttgatca

SEQ ID NO: 4544 - DNA, 572 bp, Panax ginseng
aagaagaagacgcagaagcagccatgggtatcgatctagaagctggtgggaagagcaagaggacaaagagaactgctcccagatccgatgatatttacttgaagctcattgtcaagctgtaccgatttctggtaaggaggactggaagtaagttcaatgcggtgattctgaagcggctctttatgagcaaaatcaacaagcctcccatttctctttcccgtttaattcgtttcatgaccggaaaggaggacaagattgcggtgattgttggtactattaccgatgatattagggtgcatgaagttccttgtttgaaggttactgctttgaggttcacagagactgcaagggcaaggattgagaaggctggtggtgaatgtttaacattcgaccagctggctcttagagctcctcttggacagaatacggtacttcttaaaggtccaaagaatgctcgtgaagcagcgaagcactttggtaaggctcctggtgtgccagacagccacagtaagccctatgtgcgagcgaagggaaggaaatttgagaaggctaggggaagaagaaacagcaga

SEQ ID NO: 4545 - DNA, 712 bp, Petunia hybrida
gcggggaacaccaccagcagcagcaggaggcggagcagccatgggtatcgatctagtcgctggaggtaagtccaaaaaaaccaaacgcaccgccccaaaatcggacgatgtttacctcaagcttcttgtcaagctgtatcggtttcttgtacggaggactgggagccagttcaatgcagttatattgaagaggttattcatgagcaagattaataaagctcctttgtctctatcacgcttggttattttcatgaaaggaaaggaggacaaggttgctgttgttgtagggacaattactgatgatatgcgggtttatgaagtcccttcgattaaggttgctgctttgagattcaccgaaacagctagagctagaattgagaaggctggaggtgaatgtatttcatttgatcagctggctctgagagctcctcttgggcagaacacggtactgcttaggggtccaaagaactctcgggaagctgttaagcactttggtagagctcctggtgtcccacacagccacacaaagccttatgttcgtgcaaagggaaggaagtttgagcgtgcaagagggaaaagaaacagcagaggttacaggtttaatgaagtgtgtttgattgcacaatgatagaaaattcattgagaaggtttttgcaaacctattgttaccatagtggtttctgtttcttgttttcttttttcttacactcca

SEQ ID NO: 4546 - DNA, 638 bp, Triphysaria pusilla
gggtattgatttggtcgccggaggtaagagcaagaagaccaagcgcaccgcgccgaaatccaatgatatctatctgaaactcattgttaagttgtaccggtttttggtgaggagaaccggtagcagcttcaatgcagttgtactgaagcggttgtttatgagcagggtaaacaaagcccctatatcactctccgagctcgcagctctcatgaagggaaaggagggcaagattgcggttcttgttgggactgtaactgatgatatccgtttgcaagatgaagtccctgccatgaaggttactgctctgaggttcacagaaacagcgagggctaggattgaaaaggctggtggtgaatgtttgacctttgaccagcttgcacttcgagctccccttggacagaacacagtgctcttgagaggttctccgaaggcacgcgaagcagtgaagcattttggaccggctcctggtgttccacacagccacaccaaaccgtatgtgagagctaagggaaggaagtttgaaaaggcaagaggaaagagaaacagcaagggtttcagagtttgataagtaagatctattacccttgagtagttatacaccgatttcttgttatgattttttcactccaacagcttat

SEQ ID NO: 4547 - DNA, 693 bp, Triphysaria pusilla
gggtattgatttggtcgccggaggtaagagcaagaagaccaagcgcacggcgccgaaatccaacgatatctatctgaaactcattgttaagttgtaccgatttttggtgaggaggaccggtagcagcttcaatgcagttgtactgaagcggttgtttatgagcagggtaaacaaagcccctatatcgctctccaagctcgcagctctcatgaagggcaaggagggcaagattgcggtgcttgttgggactgttaccgatgatatccgtttgcaagatgaagtccctgccatgaaggttactgctctgagattcacagaaacagcaagagctaggattgaaaaggccggtggtgaatgtttgacctttgaccagcttgcacttcgagctccccttggacagaacacggtgctcttgagaggttctcctaaggctcgtgaagcagtgaagcattttggaccagctcctggtgttccacacagccacaccaaaccgtatgtgagagcaaagggaaggaagtttgaaaaggcaagaggaaagagaaacagcaagggtttcagagtttgataagtaagatctattccccttagtagttatattttgcccggtttcttgttatgattttatcacttcaacagcttatcaatacctgtagtacactttttatttacaaggatcgtccaagttttgctgat

SEQ ID NO: 4548 - DNA, 1471 bp, Zea mays
agttttggcttccctccgccactctcgagagggccacacacaaaaaccccaatgcgagcgcccctggcttgtcggcgtcgcctccttcagccaaaaccctagcttgcatacgcgcccgaacaaagcttcgtctgcgaggggcgtcctcctgccgccagaagctttcaggagcatcagcgatggtgtggttccaatgcgaggactgtggcgagaacctcaagaagcccaaacttgccggccacttccgctcctgctccgcgtacaagctgtcatgcatcgattgcggcgagttattcagccacgacaccgtgcaggggcacacccagtgcatctccgaggccgagaagtacggtcctaagggacagaccaaaccatccaatggtgcacagggtaaggcagataagccaaagccaaatgcagatgtcgatatcaatgttgggctgtcgacacggcctccttggttctgtagcctatgcaagaccactaccacaagtaagcaaactctcttactacatgctgatgggaagaagcatagggcaaaggcgaaagccttccatgtgtctcagaaacaaaaagatggtgcagaacaaactccagatgtgaaggaagctggagttgtacccacaaaagaatctgctcaagtaaatggtggcgtgagtggtgatcatgaaagaaatgaagataaagatgctgggaaaaggaaacgaatggatgacatgaccatagagccaggtaacacaaaaagacagttgacacagtctggagatgagaagtcagaaaacaaagcgaagagtaaggccgatgaactagcaagtggtaccgactgcaaaagtgttcaaaagcaaaagatcaaatggaagaagattattactaaaacattgaaggcgaacgcagatggagttatgaagctaaagaagctacaaaagctagtctccaaggagcttcaggaatgtggtgtctccaaagacaaggaggagctccgtgctaccttgatggataaaatagcttcaagttccagattttatgttgatggcaagaatgttagactggtggccaagaatgaagaagaatcttagaaagaggttgtcagtcatttttttggcattgttgctggtttcattctttggtgtcaactttcagatggcttatagccaagtgttggttaaattgagtccatgaaccatcaattatatccatgacgtgtagacggtatgggaatttagcatctgaattttctcgacaaccgttcaaaagtgaaatgtttactctttatgctgtcaagcaatggcaatgatggttgatagtggcggcgtagtcgcaggggagagatgagagatgatacaaataatgttcattggatttgagtaagggagaagatgttatgtagtgctctgaaccatcgattttgatggtgtgataattctgggtgcaattcgtttggtggatttagtagatattatgagttgagtga

SEQ ID NO: 4549 - DNA, 1662 bp, Zea mays
ctctctttggagtggacaagtcctctttgcgtgcgaatccggcgcaaacggtgaatttcagccactctctagtttcgttctctctgtcttccgaaagtgaagtgcaggaccggaaaacacagcgatttggcagggtaaaaagctccaacagccacagccgtgatcattatatcctatctatctacgctccaggctttgaggtgggtattcgaccgccaagcgccaactgcttagctcactcgtacatcgccacatcggtgaagtggtgtcgtggtgaccatggcgcctggcctcctcgctgccgccgccgtgctggccgcggtggcggcgtccctcgcggcccacgtcgcgctcaactgccccgtgcagccggtgccgtcgcatcgcccgccgcccactccgccgcccaacaacctactacagaggctggagaagctcggggaaggggcgctggacgcgccggaggacgtgtacgtggacgcggcggcgggcggggcgctgtacacggccacgagggacggctggctgcagcggatgatgcaccccaacaacggctcctgggagcggtggcgcttcgtcggcggcacgggcctgctcggggtcgcgccgtccgccgacggcaccatgctcgtctgcgacgccgacaaggggcttttgagggtcggtgacgagggagtgacccttcttgcttcggaggtcgagggctccccgatcaggttcgcggacgcggcgatcgaggcatccgacggcacggtctacttcagtgacgccagcaccaggttcggcttcgaccggtggttccacgacttcctagagttcagctccaccggccgcctgctccggtacgacccgcgcagcggcgagacgtccgtcgtgctcgaccgactcggcttcgccaacggcgttgcgctgccgagggacgaggccttcgtcgtcgtctgcgagaccatgaggttcaggtgcatcaaagtgtggctgaaaggggataaggccggcgaggcagagacgttcgtcgaccttccggggtggccggacaacatccgtctcgggtcagacggtcacttctggattgccgtcctccagctgaggtcgccatggctggacttcatcacccgctggaccttcacgaagagagtggtggcctcgttccccgcgctcagcgagtggagcaagggggcggcgaagggagccatggtcgctcaggtgtccgaggacggcaccatcctccgcgtgctcgacgactcccaggggaaggtgatcaacttcgtcacgtcggtgacggagttcaacggggacatcttcctcggcagcctcgcgaccaacttcgtcggcaaactatctctggcgcgggtggcacagaagcagggagcagtatcttcgtagacgtttgggttcttcatgtcagtttagccctgtttgtttatcctttatattatataatccagtttaaataagttaatagacaaacaaacaaaacaggttattagatgtattgtataatctagatacctagattatgataatacataaacagataattatgtgcttattatataatccataagctagattatataattctgaaaggaaaaaaaaaccttaatcaagggaacatatacacatttgagttcttcatgtgagtttaaatagacactcttagct

SEQ ID NO: 4550 - DNA, 1248 bp, Sorghum bicolor
ggctttgaggtggtatcaactatcaactgcgagctgcttctttggaactaactcgtctattggtgaggaggtggtgtcgtggtgaccatggcgcctggcctcttggccgccgccggcgtggtagccgcggtggcgtcgctcgcggcccacgtcgcgctcaactgccccgtgcagccggtgccgtcgactccgcggccgcccactccgccccccaacaacctcctccagaggcttgagaagctgggggaaggggcgctggacgcgccggaggacgtgtactttgacgcggcggcgggcggggtgctgtacacggccaccagggacggctggctgcagcggatgcacccgaacaacggctcctgggagcggtggcgcttcgtcggcggcacggggctgctcggggtcgcgccgtccgccgacggcaccatgctcgtctgcgatgccgacaagggacttttgagagtcggggaggaaggagtgacccttcttgcgtcggaggtcgagggcaccacgatcaggttcgcggacgcggcgatcgaggcctccgacggcacggtgtacttcagcgacgccagcaccaggttcggcttcgacaggtggttctacgacttcttggagtcccgcgtcaccggccgactcctccggtacgacccgcgcaacggcgagacgtccgttgtgctcgaccgcctcagttgcgccaacggcgtcgccctgtcgagggacgagacatttgtggtcgtctgcgagacgtggaggttcaggtgcctgaaagtgtggctgaaaggggagaaagccggcaaggcagagacgttcgtcgacctcccgggagctccagataacattcgtctcgggtcagacggtcatttctggattgccctccacctgatcagttcgccatggctggatttcatcacgcgctggaccttcacgaagagagtggtggcctcgttccccgtgctcctcaagtggagcaaggcaacgatcaagggtgccatggtggctcaggtgtcggaggatggcaacatcctccgcgtgcttgacgactccgaagggaaggtgatcaactccgtcacatcggttacggagttcaacggggacatcttcctcggaagcctcgcgaccaacttcgtcgggaaattgtctctggtgcagctctgctttgcctgggttgatggctttcaggtgctcatcgatttcagcttctgtcagcactctgaaagttggatcattcgtcctgacaaccccaac

SEQ ID NO: 4551 - DNA, 1558 bp, Sorghum bicolor
ggctttgaggtggtatcaactatcaactgcgagctgcttctttggaactaactcgtctattggtgaggaggtggtgtcgtggtgaccatggcgcctggcctcttggccgccgccggcgtggtagccgcggtggcgtcgctcgcggcccacgtcgcgctcaactgccccgtgcagccggtgccgtcgactccgcggccgcccactccgccccccaacaacctcctccagaggcttgagaagctgggggaaggggcgctggacgcgccggaggacgtgtactttgacgcggcggcgggcggggtgctgtacacggccaccagggacggctggctgcagcggatgcacccgaacaacggctcctgggagcggtggcgcttcgtcggcggcacggggctgctcggggtcgcgccgtccgccgacggcaccatgctcgtctgcgatgccgacaagggacttttgagagtcggggaggaaggagtgacccttcttgcgtcggaggtcgagggcaccacgatcaggttcgcggacgcggcgatcgaggcctccgacggcacggtgtacttcagcgacgccagcaccaggttcggcttcgacaggtggttctacgacttcttggagtcccgcgtcaccggccgactcctccggtacgacccgcgcaacggcgagacgtccgttgtgctcgaccgcctcagttgcgccaacggcgtcgccctgtcgagggacgagacatttgtggtcgtctgcgagacgtggaggttcaggtgcctgaaagtgtggctgaaaggggagaaagccggcaaggcagagacgttcgtcgacctcccgggagctccagataacattcgtctcgggtcagacggtcatttctggattgccctccacctgatcagttcgccatggctggatttcatcacgcgctggaccttcacgaagagagtggtggcctcgttccccgtgctcctcaagtggagcaaggcaacgatcaagggtgccatggtggctcaggtgtcggaggatggcaacatcctccgcgtgcttgacgactccgaagggaaggtgatcaactccgtcacatcggttacggagttcaacggggacatcttcctcggaagcctcgcgaccaacttcgtcgggaaattgtctctggtgcaggtgacacatgagcagggagcagtatcttctttagacgtttgagttctccatgtcagtttatgccagaataaactggggaacatttcggtttagacacacttgactctttaagcgttgtcatacctctgatgtacagtaatcggctccagattaagatttggtaggccttagaagattcagaagactagtagctgagcaagctgctttgtttgtccttcagctctgctttgcctgggttgatggctttcaggtgctcatcgatttcagcttctgtcagcactctgaaagttggatcattcgtcctgacaaccccaacctggaacagtggttacttgttatatatgcttgcattgttcagagcatgatgatggacgaatatgacagcatatcaacagaagttaaaaat

SEQ ID NO: 4552 - DNA, 1256 bp, Saccharum officinarum
aattcgaaagcctccctcctccctccccgtttctcccttccttgcctaggcggcaacgacccccgtgctttataaccgagcggcccctcccgcgtgaggcaaccgagacggggacgagaccagcagacgggtcagcccatccgaaccccgcttcctcctcctccgggttcgcgtgaggttgtgtgctgctggggaggaggcgccggcgccggcgccatggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaagtcatatcggcagtgattgtcgtggccgccggtgttgggatttgtactgtcacggatgtcgaggtcaatgcaaagggattcatctgcgcttgcgttgcagtgttctgcacgtcgcttcaacagattacaattggctcctttcagaagaagtacaacattggatcatttgagctgctgagcaaaactgcaccaattcaggcactttcacttgttatactgggcccctttgtggactactacctaaatggacggtcattgttgaactaccctttttcaggaggggcaactttcttcatactgctttcctgctccctggccgtattctgcaacatgagccaatacctctgcatcggccggttctcagcgacctcattccaggtcctgggccacatgaagaccgtgtgcgtgctgatcctcggctggatcctgtttgactcggccctcaccgtgaagaacatcctcggtatgctgcttgccgtgatgggcatggtggtctacagctgggccgtggaagcagagaagaaggcggcagccccgatcccccggaacaagagcgacatgctcgacggcgaggatgtacccctcaaggccagggtgagtggcgtgcccgcaggcgacctcgaggacggcgagatgaagagctagctgct

SEQ ID NO: 4553 - DNA, 1148 bp, Saccharum officinarum
  misc_feature (1020)..(1020): n is a, c, g, or t
  misc_feature (1044)..(1044): n is a, c, g, or t
cggggacgagaccagcagacgggtcagcccatccgaaccccgcttcctcctcctccgggttcgcgtgaggttgtgtgctgctggggaggaggcggcggcgccggcgccatggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaggtcatatcggcagtgattgtcgtggccgccggtgtcgggatttgcacggtcacggatgtcgaggtcaatgccaagggattcatctgcgcttgcgtggcagtgttctgcacgtcgcttcaacagattacaattggctcctttcagaagaagtacaacattggatcatttgagctgctgagcaaaactgcaccaattcaggcactttcacttgttatactgggcccctttgtggactactacctaaatggacggtcattgttgaactaccctttttcaggaggggcaactttcttcatactgctttcctgctccctggccgtcttctgcaacatgagccaatacctctgcatcggccggttctcagcgacctcattccaggtcctgggccacatgaagactgtgtgcgtgctgatcctcggctggatcctgtttgactcggccctcaccgtgaagaacatcctcgggatgctgcttgctgtgatgggcatggtggtctacagctgggccgtggaagcggagaanaaggcggcagccccgatcccccgnaacaagagcgacatgctcgatggcgaggacgtacccctcaaggccagggtgagcggcgtgcccacggtcgacctcgaggacggcgagatgaagagctagctgct

SEQ ID NO: 4554 - DNA, 1243 bp, Saccharum officinarum
ccctcctccctccccgtttctcccttccttgcctaggcggcaacgacccccgtgctttataaccgagcggcccctcccgcgtgaggcaaccgagacggggacgagaccagcagacgggtcagcccatccgaaccccgcttcctcctcctccgggttcgcgtgaggttgtgtgctgctggggaggaggcgccggcgccggcgccatggaggcggagaagaagacgccggcggtgtccgatgtgggcgcgtgggcgatgaacgtcgtcagctccgtcagtctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggcttctaccagatctccaaattgagcatgattccggtcgtctgcctgatggaatgggtgctgaacagcaagcactacaccactaaagtcatatcggcagtgattgtcgtggccgccggtgttgggatttgtactgtcacggatgtcgaggtcaatgccaagggattcatctgcgcttgcgttgcagtgttctgcacgtcgcttcaacagattacaattggctcctttcagaagaagtacaacattggatcatttgagctgctgagcaaaactgcaccaattcaggcactttcacttgttatactgggcccctttgtggactactacctaaatggacggtcattgttgaactaccctttttcaggaggggcaactttcttcatactgctttcctgctccctggccgtattctgcaacatgagccaatacctctgcatcggccggttctcagcgacctcattccaggtcctgggccacatgaagaccgtgtgcgtgctgatcctcggctggatcctgtttgactcggccctcaccgtgaagaacatcctcgggatgctgcttgccgtgatgggcatggtggtctacagctgggccgtggaagcagagaagaaggcggcagccccgatcccccggaacaagagcgacatgctcgacggcgaggacgtacccctcaaggccagggtgagtggcgtgcccgcaggcgacctcgaggacggcgagatgaagagctagctgct

SEQ ID NO: 4555 - DNA, 1756 bp, Zea mays
gaagctgcaggggaaatgcaccatgcagcgcggctcggccccagcccccagatccaggcacgcaaccgagccgcggcccccctgcgcccttgtcgtcgccgcaccgtccgtccccgcccgcgtcaatccgtcgtcgtcgtcgtctcctcgtcaccccgcgagcttttttcaccgctgccctgccctgcccccgcgcccgttgacgtttccggcccccaattcgaaagcctcgcgctccccgttgctcccttccttgcctaggcggcaacgccctcgtgctttataacccagcggcccctcccgcgtgaggcaaccgagacgggaggagaccagcagcagcagcccatccgacccccgcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatccgcagtcatcgtcgtggccgccggtgtcgggatttgtactgtcacggatgtcgaggtcaatgccaaggggttcatctgcgcttgcgtggcagtgttctgcacgtcgcttcaacagatcacaattggctcctttcagaagaagtacaacattggatcatttgagctgctgagcaaaactgcgccaattcaggcactttcactcattatactgggcccctttgtggactactatctaaatgggcggtcattgttgaactaccctttttcaggaggggcaactttcttcatactgctttcctgctccctggcggtgttctgcaacatgagccaatacctctgcatcgggcggttctcagcgacctcattccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccctcccccgggttcgacgtagatgaaacacacgcgggcaaattgttaggatttttcaggcggggaggtggcgacatgctgttatagatggtgacaagactttatataatggaaatgcaggtgtttttgaggtttcgctgttc

SEQ ID NO: 4556 - DNA, 1563 bp, Zea mays
cagttcgaaagcctccctccctccccgttctcccttccttgcctaggcggcaacgcaacacccccccgtgctttattataacccagcggcccctcccgcatgaggcaaccgagacgggacgagtccagcagccggccaccagcccatccgaaccctgctgcccccctctccgggttcgcgtgaggctgtgtgctgctgggaggagggagggggaagcggcggcggggcgccatggaggccgagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctctctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcggtggttgtcgtggccgccggtgtcgggatttgcaccgtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctccctggccgtcttctgcaacatgagccaatacctctgcatcggccggttctcagcgacctcgtttcaggtcctgggccacatgaagaccgtgtgtgtgctgatcctcggctggatcctgtttgactcggccctcaccgtgaagaacatcctcgggatgctgctcgccgtgatgggcatggtggtctacagctgggccatggaagcggagaagaaggtggcagcccctgtcccccggatcaagagcgaaatgctcgacggggaggacgtacccctcaaggccagggtgagcggcgtgcccgcggtcgacctcgaggacggcgagatgaagagctagctgccgccgccgccgctgattcgttcattcttcttgttcttttgtaactgtgcgcgcgcgatcgctcgatccaaagttgcttgtccgtcagctctcagctatcgacactacactgttaattttggccccttgttggggagagtccagttcctaggtgacgacgaccacccccagttcggcgtagatcaaacacacactagcagaatgcagatttttaggattttttcaggcggcggggtggatccattcattgtcatgttgacaagactcataatagaaatacaggtaacatatgta

SEQ ID NO: 4557 - DNA, 1270 bp, Panicum virgatum
cgcgagaccggcagaggcagaggcagaggcagaggcaggcaggcaggggggagcagcagcccgtccgagccccttcctcctccgggttcgcgtgaggccgcgtgccaccgccgccgggaggagggcgaggcgagatggaggcggagaagaagccgccggcggtgtccgacgttggcgcctgggcgatgaacgttgtcagctccgtcggcatcatcatggccaacaagcagctcatgtcctcgtccggctacgccttcgccttcgccaccacgctgaccgggttccacttcaccgtcacggcgctcgtcgggtggatctccaacgccacgggctactccgtctccaagcacgtcccgctctgggagctcgtctggttctcgctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggttatttccgcggtggtcgttgtggcggccggcgtcgggatttgcacggtcacggatgtcgaggtcaatgccaagggattcctttgcgcgtgtgtggctgtgttctgcacgtcgctgcagcagattaccattggctcctttcagaagaagtacaacattgggtcatttgagctgctgagcaaaactgcaccaattcaagcaatttcacttattatactgggcccctttgtggattactacctcaatgggcgatcattgttgaactacaatttttcaggaggggccactttcttcatactgctttcatgctccctggcggtcttctgcaacatgagccagtacctctgcatcgggcggttctctgcgacctcgttccaggtcctgggccacatgaaaaccgtgtgcgtgctgatcctcggctggatcctgttcgactcggccctcaccgtgaagaacatcctggggatgctgctcgccgtgatgggcatggtggtctacagctgggccgtggagtccgagaagaaggcggccaccccgatcccccggaacaagagtgacatgctggacggcgaggacgttcccctgaaggccagggtgagcggcctgccctcggtcgacctggaggaaggcgagatgaagagctagccggccgtggcagctgtgaagattcattgatttcttcttgttctttttgtgattgtacgcgctcgcctcgatccaagctgctccttcgaagctatcgacgc

SEQ ID NO: 4558 - DNA, 1803 bp, Oryza sativa
agatcccgctctgtcgccgtcgccgctggctgccacccttccccctcccctcctcccctcccccgcgcgtcgtctttctcctctaatctctccttctcttaacccgcctcccctcccgttctccccgcagatcgcagttttttcaccgtcctccgcccgtgcagttgacgcttccgcctcccacactgcgtctgcgtgcgcacacagcaccaattcgaaacccctccccgcactccctccccctcccttccttgccttgcctaggcggcaacgcctcccgtcctttataaccctgcggctcctcccgcgtgaggcaccgaggcccgggtggtagaccgcgggacccgagccgagccgtgccctgccctgcccttcctccgcccagggtcgcagccaggtcgtcgtcgtcgtcggagggggaagagagccgcggcggcgtcaggaggaggaggaggggcgagatggaggcggagaagaagccgccggcggtgtccgacgtcggggcgtgggcgatgaacgtcgtcagctccgtcggcatcatcatggcaaacaagcagctcatgtcctcctccggctacgccttctccttcgccacgacgctgaccggattccacttcacggtcacggcgctcgtcggatggatctccaacgccaccggctactccgtatccaagcacgtcccgctctgggagctcgtctggttctccctcgtcgccaacacgtccatcaccgggatgaaccttagtctcatgctcaactccgtcggtttctatcagatctcgaaattgagcatgatcccggtggtttgcttgatggaatgggtgctcaacagcaagcactacaccaccaaggttatatcggccgtggtcgtcgtggcggcgggtgttgggatttgcacggtcacggatgtggaggtcaatgccaagggattcatctgcgcttgcgtggctgtcttctgcacgtcgcttcaacagattacaattggctcctttcagaagaagtacaacatagggtcatttgaacttctcagcaaaactgcaccaatacaggctgtgtctcttattatacttggtccctttgctgactattacctcaatgggcgatggttattaaactacaacttctcaactggggcaactttcttcatattgctttcttgctccttggctgtcttctgcaacatgagccagtacctctgcatcggccggttctctgcaacttcgttccaggtcctgggccacatgaagaccgtgtgcgtgctgattcttggctggatcctgttcgactcggccctcaccgtgaagaacatcctcgggatgctgctcgccgtgatgggcatggtggtctacagctgggccgtggagaccgagaagaaggcctccgccccaatcccccggaacaagagcgacatgctggacgactccgaggacgttcccctcaaggccagggtgagcggcctcccctcgtccgacctcgaggaaggcgagatgaagagctagctaatgacatattatttattcattcttcttgttcctttcttttttgtacgtgttcaaatccatatattgcccccattctgggggaagttcttgaagctatcggcacttgtgttaattttgcctcctcccttgttcctggggttcatagatgatgatgatgctgatgaaccccagccggtctcgacgtagatgaccattttagaagccatgttcttgatggcgtgttgttattatagatgacaagacttataatggaatacaggtgtttatccgttgtaggatgattctgttgaagctgtcgata

SEQ ID NO: 4559 - DNA, 1588 bp, Triticum aestivum
aacccccccgcacactcccctcccttccgtgcctaggcggcaacgcttcttctcgcctcccctcccatctcctttataaccgagcgggcggcccctcccgcgtgaggcaccgaggacgggggcagaaccgcagcgcagccgagccgagaccagaccagacgaaccgcgccgagccctaccctcctccaccaccgggtctctctgcgagggcggaggagcgacatggagccggccgagaagaagccgccggcggtgtccgacctcggcgcctgggggatgaacgtcgtcagctccgtcggcctcatcatggccaacaagcagctcatgtcctccgccggctacgccttctccttcgccaccacgttgaccgggttccacttcaccgtcacggcgctcgtcgggtggatttccaaggccaccggctactccgcctccaagcacgtccccctctgggagctcgtctggttctcgctcgtcgccaacgcctccatcaccgggatgaacctcagcctcatgctcaactctgtcggcttctatcagatctccaaattgagcatgattccggtggtttgcttgatggagtgggtactcaacagcaagcactacacaaccaaggttatatcggcagtggttgtcgtcgcagcgggcgtcgggatttgcaccgtcaccgatgtggaggtcaatgctaagggcttcatttgtgcttgcgtggctgtgttctgcacgtcgctgcaacagattacaattggctcctttcagaagaagtacaacattgggtcatttgagctgctgagcaaaactgcaccaatacaggcagtgtcacttattatactgggtccctttgtggattactacctaaatgggcgttggctattgaactacagtttttcaacaggggcaactttcttcatactgctttcatgctccttggctgtcttctgcaacatgagccagtacctctgcatcgggcggttctctgcaacctctttccaggtcctgggccacatgaaaacggtgtgcgtgctgatcctcggctgggttctgttcgactcggctctcaccatcaagaacatactcgggatgctgctcgccatcatgggcatggtggtctatagctgggccatggagtctgagaagaaggccacctcagcgatcccgcggaacaagagcgacatgctggacggggaggacgtgcccctcaagtcgagaacgagcggcattccgctgtcctcggaacttgatgaccttgaggaaggcccgatgaagagctagcctgtcgcagttattcattcattcttcttggttcttttgtatgtgtttgatccacaatgtccgccagtccagtcctcgaagctatcgacaatcttgttaattttgccccttgcctgctgggtggagttccatcataggtgatgacgaccccggccggccggccggcctcggcgtagatgaccaccaccttaggaaatttgtcaaggccgatatgggccgagccatggtgattcgtgatggctgttgttatagacgacaacaaattatacttatataatggaatacaggtgttcccccgttgtagcatcccggtgaa

SEQ ID NO: 4560 - DNA, 1419 bp, Leymus cinereus x Leymus triticoides
ccgagacgagacgaaccgtgccgagcccttccctcctccaccgggttcgtgccaggtctccgtgagagcggaggagggagatggagccggccgagaagaagccgccagcggtgtccgacctcggcgcgtgggggatgaacgtcgtcagctccgtcggcctcatcatggccaacaagcagctcatgtcctccgccggctacgccttctccttcgccaccacgttgaccgggttccacttcaccgtcacggcgctcgtcggatggatttccaaggccactggctactccgcctccaagcacgtccccctctgggagctcgtgtggttctccctcgtcgccaacgcctccatcaccgggatgaacctcagcctcatgctcaactctgtcgggttctatcagatctccaaattgagcatgattccggtggtttgcatgatggaatgggtactcaacagcaagcactacacaacaaaggttatatcggcagtggttgtcgtggcagccggcgtcgggatttgtaccgtcaccgatgtggaggtcaatgctaagggcttcatttgtgcttgtgtggctgtgttctgcacctcgcttcaacagattacaattggctcctttcaaaagaagtacaacattgggtcatttgagctgctgagcaaaactgcaccaatacaggcagtgtcacttatcatactgggtccctttgtggattactacctaaatgggcggtggctattaaactacagtttttcaacaggggcaactttcttcatactgctttcatgctccttggctgtcttctgcaacatgagccagtacctctgcatcgggcggttctctgcaacctctttccaggtcctgggccacatgaaaacggtgtgcgtgctgatcctcggctgggttctgtttgactcggctctcaccatcaagaacatacttgggatgctgctcgccattatgggcatggtggtctatagctgggccatggagtctgagaagaaggccacctcagcgatcccgcggaacaagagcgacatgctggatggggaggacgtgcccctcaagtccagaacgagcggcattccgctgtcctcggaacttgacctcgaggaaggcccgatgaagagctagcctgtcgctgttattcattcattcttggttcttttgtatgtgtttgatccacaatgtccgccagtccagttctctaagctatcgacaatcttgttaattttgccccttgctgggtggagttccatcatagttgatgacgaccccggccggcctcggcgtagatgaccaccacctaggaaatttgtcaaggccgatatgggccgagccatgtcaattcgtgatggcgtgttgttatagacgacaacaattatacttctataatggaatacaggtgttcccccgtaaaaaaaaa

SEQ ID NO: 4561 - DNA, 1660 bp, Hordeum vulgare
gaccggcttcccgttgacgtttccgccactgcggggagcagagcacgcacaagcacaattcgaaaccccctcgcacactcccctccccccctccccttccgtgcctaggcggcaacgcctcttctcccctcgcctcacctttataaccgagagagcgggcggcccctcccgcgtgaggcaccgaggacgggggcagacagaagcgcagcgcagcgcagccgaggcgagacgaacccctcccctccctccaccaccgtccaccgggcatccctgacagcggaggagggacatggagccggccgagaagaagccgccggcggtgtccgacctcggcgcctgggggatgaacgtcgtcagctccgtcggcctcatcatggccaacaagcagctcatgtcctccgccggctacgccttctccttcgccaccacgttgaccggcttccacttcaccgtcacggcgctcgtcgggtggatttccaaggccaccggctactccgcctccaagcacgtccccctctgggagctcgtctggttctcgctcgtcgccaacgcctccatcaccgggatgaacctcagcctcatgctcaactctgttggcttctatcagatctccaaattgagcatgattccggtggtttgcatgatggaatgggtactcaacagcaagcactacacaacaaaggttatatccgcagtggttgtcgtggcagccggcgtcgggatttgcaccgtcaccgacgtggaggtcaatgctaagggcttcatttgtgcttgtgtggctgtgttctgcacgtcgcttcaacagattacaattggctcctttcagaagaagtacaacattgggtcatttgagctgctgagcaaaactgcaccaatacaggcagtgtcacttattatactgggtccctttgtggattactacctaaatgggcgttggctattgaactacagtttttcaacaggggcaactttcttcatactgctttcatgctccttggctgtcttctgcaacatgagccagtacctctgcatcggccggttctctgcaacctctttccaggtcctgggccacatgaaaacggtgtgtgtgctgatcctcggctgggttctgttcgactcggctctcaccatcaagaacatactcgggatgctgctcgccatcatgggcatggtggtctacagctgggccatggagtctgagaagaaggccacctcagcgatcccgcggaacaagagcgacatgctggacggggaggacgtgcccctcaagtccagaacgagcggcattccgctgtcctcggaactcgacgacctcgaggaaggcccgatgaagagctagcctgtccctgctattcattcattcttcttggttcttttgtatgtgtttgatccacaatgtccgccagtccagtcctcgaagctatcgacaatcttgttaattttgccccttgcttgctgggtggagtttcatcataggtgatgacgaccccggccggccgtcctcggagtagatgaccaccaccttaggaaatttgtcaaggccgatatgggccgagccatggtgattcgtgatggcgtgttgttatagacggcaacagattatacttataatggaatacaggtgttcccccgttgtaggatcccggtgaatgttttgcga

SEQ ID NO: 4562 - DNA, 1668 bp, Hordeum vulgare
gaccggcttcccgttgacgtttccgccactgcggggagcagagcacgcagaagcacaattcgaaaccccctcgcacactcccctccccccctccccttccgtgcctaggcggcaacgcctcttctcccctcgcctcacctttataaccgagagagcgggcggcccctcccgcgtgaggcaccgaggacgggggcagacagaagcgcagcgcagcgcagccgaggcgagacgaacccctcccctccctccaccaccgtccaccgggcatccctgacagcggaggagggacatggagccggccgagaagaagccgccggcggtgtccgacctcggcgcctgggggatgaacgtcgtcagctccgtcggcctcatcatggccaacaagcagctcatgtcctccgccggctacgccttctccttcgccaccacgttgaccggcttccacttcaccgtcacggcgctcgtcgggtggatttccaaggccaccggctactccgcctccaagcacgtccccctctgggagctcgtctggttctcgctcgtcgccaacgcctccatcaccgggatgaacctcagcctcatgctcaactctgttggcttctatcagatctccaaattgagcatgattccggtggtttgcatgatggaatgggtactcaacagcaagcactacacaacaaaggttatatccgcagtggttgtcgtggcagccggcgtcgggatttgcaccgtcaccgacgtggaggtcaatgctaagggcttcatttgtgcttgtgtggctgtgttctgcacgtcgcttcaacagattacaattggctcctttcagaagaagtacaacattgggtcatttgagctgctgagcaaaactgcaccaatacaggcagtgtcacttattatactgggtccctttgtggattactacctaaatgggcgttggctattgaactacagtttttcaacaggggcaactttcttcatactgctttcatgctccttggctgtcttctgcaacatgagccagtacctctgcatcggccggttctctgcaacctctttccaggtcctgggccacatgaaaacggtgtgtgtgctgatcctcggctgggttctgttcgactcggctctcaccatcaagaacatactcgggatgctgctcgccatcatgggcatggtggtctacagctgggccatggagtctgagaagaaggccacctcagcgatcccgcggaacaagagcgacatgctggacggggaggacgtgcccctcaagtccagaacgagcggcattccgctgtcctcggaactcgacgacctcgaggaaggcccgatgaagagctagcctgtccctgctattcattcattcttcttggttcttttgtatgtgtttgatccacaatgtccgccagtccagtcctcgaagctatcgacaatcttgttaattttgccccttgcttgctgggtggagtttcatcataggtgatgacgaccccggccggccgtcctcggagtagatgaccaccaccttaggaaatttgtcaaggccgatatgggccgagccatggtgattcgtgatggcgtgttgttatagacggcaacagattatacttataatggaatacaggtgttcccccgttgtaggatcccggtgaatgttttgcgattcacaag

SEQ ID NO: 4563 - DNA, 1562 bp, Brachypodium distachyon
cttctgctcttcccgttgacgttctcgccactgcggcagcaaacaattcgaaaccctctcccgcactccccttcccttccgtgcctaggcggcaagcgcttcttctctcctttataacccagcggcccctcccgcgtgaggcaccgaggaggaggtggccaggtgggggtagaagaagaagaagagggccgagccgagacgaaccgcgccgagctcttcttcctcctcctcctcctcctcccgggttcgtgccaggttttggggagatggagccggagaagaagccgccggcggtgtccgacctcggcgcctgggggatgaacgtcgtcagctccgtcggcatcatcatggccaacaagcagctcatgtcctcctccggctacgccttctccttcgccaccacgctgaccgggttccacttcactgtcacggcgctcgtcggatggatctccaaggccactggctactccgcctccaagcacgtccctctctgggagctcatctggttctcgctcgttgccaacacgtccatcaccgggatgaaccttagcctcatgctcaactcagtcggattctatcagatctccaaattgagcatgattccggtggtctgcttgatggaatgggtactgaacagcaagcactacactagcaaggttatatcggcggttgttgttgtggcggcaggtgtggggatttgcactgtcactgatgtggaggtcaatgccaaggggttcatttgtgcttgcgtggctgtgttctgcacatcacttcaacagattacaattggctcttttcagaagaagtacaacattgggtcatttgagctgctgagcaagactgcaccaatacaggcagtgtctcttattatactgggtccctttgtggattactacctcaatgggcgatcgctgttagagtacagtttttcaacaggggcaactttcttcatactgctttcatgctccttggctgtcttctgcaacatgagccagtacctctgcatcggccggttctccgcaacttctttccaggtcctaggccacatgaaaaccgtgtgcgtgctgatcctcggctggattctgttcgactcggctctcaccatcaagaacatattggggatgctgctcgccatcatgggcatggtagtctatagctgggccatggagtccgagaagaaggccaccgcgctgatcccgcggaacaagagcgacatgctggatggggaggatgtgcccctgaagtccagaacgagcggccttcccgcctccgaccttgaccttgacctggaggaaggtggcccaacaaagagctagccggtcaccattatttattcctttcttcttggttcttttgtacgtgtttaatctgcattgtccgcgagtcctcgaagccatcgacacttgtgttaattttgccccttgctgggggttatctcatcataggtgatgaggacgatccccggccggtctcgacgtagatgaccgcttagaaaattcgtcagggccaatataggccggaagccatgtcaattcatgatggcgtgttgttatagatgacaa

SEQ ID NO: 4564 - DNA, 1731 bp, Brachypodium distachyon
atgacaatcacgggagtatggcaccatttgtattacacaaggatttcacgtgagttaagccgagtagaaaaaacaatccccagaaacaatactgccgcagtgtggccggcggcgcccggtaaccagtcgacatccgatcgccaatcatctgagactgccatgcaccccaagaggcccgttggccgtgtggccttccatgatgagggactaccactccaccttgacaagaaaagcttccggttcctcgcgtccttgcttgccacagcaggaaaggccccatttcatccacttgcgcagccatccgggaattcgtacgaagagaagaatacggacattgtgcagctaccaaatgtcgagcaggaactcctccagatttgcacgacgaggttttggggagatggagccggagaagaagccgccggcgtgtccgacctcggcgcctgggggatgaacgtcgtcagctccgtcggcatcatcatggccaacaagcagctcatgtcctcctccggctacgccttctccttcgccaccacgctgaccgggttccacttcactgtcacggcgctcgtcggatggatctccaaggccactggctactccgcctccaagcacgtccctctctgggagctcatctggttctcgctcgttgccaacacgtccatcaccgggatgaaccttagcctcatgctcaactcagtcggattctatcagatctccaaattgagcatgattccggtggtctgcttgatggaatgggtactgaacagcaagcactacactagcaaggttatatcggcggttgttgttgtggcggcaggtgtggggatttgcactgtcactgatgtggaggtcaatgccaaggggttcatttgtgcttgcgtggctgtgttctgcacatcacttcaacagattacaattggctcttttcagaagaagtacaacattgggtcatttgagctgctgagcaagactgcaccaatacaggcagtgtctcttattatactgggtccctttgtggattactacctcaatgggcgatcgctgttagagtacagtttttcaacaggggcaactttcttcatactgctttcatgctccttggctgtcttctgcaacatgagccagtacctctgcatcggccggttctccgcaacttctttccaggtcctaggccacatgaaaaccgtgtgcgtgctgatcctcggctggattctgttcgactcggctctcaccatcaagaacatattggggatgctgctcgccatcatgggcatggtagtctatagctgggccatggagtccgagaagaaggccaccgcgctgatcccgcggaacaagagcgacatgctggatggggaggatgtgcccctgaagtccagaacgagcggccttcccgcctccgaccttgaccttgacctggaggaaggtggcccaacaaagagctagccggtcaccattatttattcctttcttcttggttcttttgtacgtgtttaatctgcattgtccgcgagtcctcgaagccatcgacacttgtgttaattttgccccttgctgggggttatctcatcataggtgatgaggacgatccccggccggtctcgacgtagatgaccgcttagaaaattcgtcagggccaatataggccggaagccatgtcaattcatgatggcgtgttgttatagatgacaatacttataatggaatacagatgttgccccgttgtaggat

SEQ ID NO: 4565 - DNA, 1950 bp, Sorghum bicolor
cctccacagacatccacgcccaccgtcagagtcagggcatcctcctctctccactccgatcacgattcagccgtcgctcgctgcgtaccgcgcggtgagccggtgattcaacgccaacacccggtgcagcagcgggtgcccgcagtaaccgctcccctgccccgcccaaaaatggagaacggcaccagcaacggctccaccggcggcgccgcctgctgcaacggcaacggcgccgtccgcgggccgcacgtggcgatgctggcgacgccggggatgggtcacctgatcccgctagcggagctggcgaagcggctggcgtcgcggcacggcgccacggcgacgctcatcacgttcgcgtccacggcgtcggcgacgcagcgcgcgttcctggcgtcgctcccgcccgcggtgacctcgctctcgctcccgcccgtcgacctctccgacctgccccgcggcgccgccatcgagacgctcatgtccgaggagtgcgcgcgctctgtcccggcgctcacgtccatcctcctcgacctcaagcggaccacggggggccgcctggcggcgttcgtggcggacctgttcggcgccgactccctggacgcggcgcgcgcggccggggtgcggcggcggtgcatcttcttccccaccaacctccacgcgctcacgctcatgctccacctccccgagctcgacgcctcggtgtcgtgcgagttccgggacctcccggagccgctgcggctccccgggtgcgtgcctatcccggggcccgacatcctgatgccgctgcaggacaaggccaacccgtgctaccgctggatggtgcaccacggcggcaagtaccgggacgccgacgccatcctcgtcaactccttcgacgccgtcgagccgggccccgccaagatcctgcgccagccggcggcggaccaccgccccgtggtgtacccgatcggcccgctcatccacgccgacggacgggaggacgacaaggacgcgctgtgcctggagtggctggaccggcagccggcgaggtcggtgatgttcgtgtcgtttggttccggcggcgcgctgccgacggaggagatgcgggagctggcgctggggctggagctcagcgggcagcggttcctgtgggtggtgcggagccccagcgacgagggcgccgtcaacgacaactactacgacgccgagagcaagaaggaccccttcgcctacctcccggagggattcgtggaccgcgtcaccgccaccggcgtggggctggtcgtcccgtcctgggcgccgcagaccaaggtgctggcgcacgccgccacgggcgggttcctcacccactgcggctggaactccgtgctcgagagcctcgtctacggcgtgcccatggtggcgtggccgctcttcgccgagcagcggcagaacgccgtgatgctctccgacggcgtcggcgccgcgctccgagtgcccgagtcgtccaaggggagggaggagatcgcggccacggtgcgggaggtgatgcagggggaagggaagggcgccgcggtcagggcgaaggtggccgagctgcagaaggccgccgctgagggcctccgcgacgggggcgccgccgccaccgcgctggccgaggtggtggaagggtggacgacgacaggtggacaagaggaggaggactaggtggtgatggtgatgctgacgcgattggcgcctagcgatgctcctcgtcatcctcctacttgggccgggcccaccgtttattttggcccttgtgtatgtcttgtcttgggtcttgtaattttggttcacatgctttaatttgctgtatgtaaaaagcaaatgtaactttcctctgcagtcctgctcttccgtagttaggctagtcgcaatgagaattttattagagtttcatgtacattaatatgttaatatgtcattgtattaataaagagagattaaattggg

SEQ ID NO: 4566 - DNA, 1939 bp, Sorghum bicolor
agacatccacgcccaccgtcagagtcagggcatcctcctctctccactccgatcacgattcagccgtcgctcgctgcgtaccgcgcggtgagccggtgattcaacgccaacacccggtgcagcagcgggtgcccgcagtaaccgctcccctgccccgcccaaaaatggagaacggcaccagcaacggctccaccggcggcgccgcctgctgcaacggcaacggcgccgtccgcgggccgcacgtggcgatgctggcgacgccggggatgggtcacctgatcccgctagcggagctggcgaagcggctggcgtcgcggcacggcgccacggcgacgctcatcacgttcgcgtccacggcgtcggcgacgcagcgcgcgttcctggcgtcgctcccgcccgcggtgacctcgctctcgctcccgcccgtcgacctctccgacctgccccgcggcgccgccatcgagacgctcatgtccgaggagtgcgcgcgctctgtcccggcgctcacgtccatcctcctcgacctcaagcggaccacggggggccgcctggcggcgttcgtggcggacctgttcggcgccgactccctggacgcggcgcgcgcggccggggtgcggcggcggtgcatcttcttccccaccaacctccacgcgctcacgctcatgctccacctccccgagctcgacgcctcggtgtcgtgcgagttccgggacctcccggagccgctgcggctccccgggtgcgtgcctatcccggggcccgacatcctgatgccgctgcaggacaaggccaacccgtgctaccgctggatggtgcaccacggcggcaagtaccgggacgccgacgccatcctcgtcaactccttcgacgccgtcgagccgggccccgccaagatcctgcgccagccggcggcggaccaccgccccgtggtgtacccgatcggcccgctcatccacgccgacggacgggaggacgacaaggacgcgctgtgcctggagtggctggaccggcagccggcgaggtcggtgatgttcgtgtcgtttggttccggcggcgcgctgccgacggaggagatgcgggagctggcgctggggctggagctcagcgggcagcggttcctgtgggtggtgcggagccccagcgacgagggcgccgtcaacgacaactactacgacgccgagagcaagaaggaccccttcgcctacctcccggagggattcgtggaccgcgtcaccgccaccggcgtggggctggtcgtcccgtcctgggcgccgcagaccaaggtgctggcgcacgccgccacgggcgggttcctcacccactgcggctggaactccgtgctcgagagcctcgtctacggcgtgcccatggtggcgtggccgctcttcgccgagcagcggcagaacgccgtgatgctctccgacggcgtcggcgccgcgctccgagtgcccgagtcgtccaaggggagggaggagatcgcggccacggtgcgggaggtgatgcagggggaagggaagggcgccgcggtcagggcgaaggtggccgagctgcagaaggccgccgctgagggcctccgcgacgggggcgccgccgccaccgcgctggccgaggtggtggaagggtggacgacgacaggtggacaagaggaggaggactaggtggtgatggtgatgctgacgcgattggcgcctagcgatgctcctcgtcatcctcctacttgggccgggcccaccgtttattttggcccttgtgtatgtcttgtcttgggtcttgtaattttggttcacatgctttaatttgctgtatgtaaaaagcaaatgtaactttcctctgcagtcctgctcttccgtagttaggctagtcgcaatgagaattttattagagtttcatgtacattaatatgttaatatgtcattgtattaataaagagagattaaat

SEQ ID NO: 4567 - DNA, 1905 bp, Saccharum officinarum
  misc_feature (39)..(39): n is a, c, g, or t
  misc_feature (41)..(41): n is a, c, g, or t
  misc_feature (161)..(161): n is a, c, g, or t
  misc_feature (204)..(204): n is a, c, g, or t
  misc_feature (280)..(280): n is a, c, g, or t
  misc_feature (332)..(332): n is a, c, g, or t
  misc_feature (443)..(443): n is a, c, g, or t
  misc_feature (756)..(756): n is a, c, g, or t
  misc_feature (1069)..(1069): n is a, c, g, or t
  misc_feature (1198)..(1198): n is a, c, g, or t
agcccaccatcaccattcaccacacacagccaccacccncntcaggcgtcgctgcccattcaacaccacccggagaaaaggccgcccccaccgcccaaaaatggagaacggcagcagcaacggctccgccaccgccgcctgctgcaacggcaacggcaacngcaccgccgccggctccggctccgtccggcgccgcccgcgggncgcacgtggcgatgctggcgacgcccgggatggggcacctgatcccgctggcggagctagcgaagcggctggcgtngcggcacggggccacggcgacgctcatcacgttcgcgtccacggcgtcggcnacgcagcgcgcgttcctggcctcgctgccgcccgcggtgacctcgctctcgctcccgcccgtcgacctctccgacctgccccgcggcgccgccatcgagacgctcatgtcngaggagtgcgcgcgctcggtgcccgcgctgacgaccatcctcctcgacctgaagcggagcacgggggggcggctggcggcgttcgtggcggacctcttcggcgccgactcccttgacgcggcgcgcgcggccggggtgaggcggaggtgcatcttcttccccaccaacctccacgcgctcacgctcatcctccacctcccggagctggacgcgtccgtgccgtgcgagttccgggacctgcccgagccgctgcgcctgcccgggtgcgtgcctatcccggggcccgacatcttgatgccgctgcaggacaagnccgacccctgctaccgctggatggtgcaccacggcgccaagtaccgggaggccgacgccatcctcgtcaactccttcgacgccgtcgagccgggccccgccaagatcctgcgccagccggcggaccaccaccccgcggtgtacccgatcggcccgctcatccacgccgacggacgcaaggacgataaggacgcgctgtgcctggagtggctggaccggcagccagcgaggtcggtgatcttcgtgtcgttcgggtccggcggcgcgctgccgacggagcagatgcgggagctggcgctggggctggagctcancgggcagcggttcctgtgggtggtgcggagccccagcgacgagggcgccgtcaacgacaactactacgacgccgagagcaagaaggatcccttcgcttatctcccggagggcttcgtcgagcggaccancggcgttgggctggtggtcccgtcctgggcgccgcagaccaaggtgctggcgcacgagtccacgggcggcttcctcacccactgcggctggaactccgtgctggagagcctcgtctacggcgtgcccatggtggcgtggccgctctacgccgagcagcgccagaacgccgtgatgctctccgacggcgtcggcgccgcgctccgggtgcccgagtcgaaggtcagggagaagatcgcggcgacggtgcgggaggtgatgcagggcgaagggaagggcgccgcggtcagggccaaggttgccgagctgcagaaggccgccgccgagggcctccgcgacgggggcgccgccgccgccgcgctggccgaggtggtgcaagggtggacggcgacgacaggtggacaagaggaggattaattagggtgatctggatgctgacgcgattggcgcctagcgatccacctcatcctccaacttgggccgggcccgccatttattttggcccatgtgcatgtcgtgtccttggtcttgttgtcttgtaaaaactttggttgtactcttccctaatcacatgccgctcgctgtatgtagactgaatccaatgcagactgcagtcctgctcttcggtagtagtttattagtagagtatatagataggtaaattcgtgtggttatgataattattagataagaaggctaccatttttat

SEQ ID NO: 4568 - DNA, 1909 bp, Panicum virgatum
caccaccaccggatcagctgctagcttcctcctcccacatcaggcggcgccagccgaggacaccgtcggagcccacaaccacccacccgaataaggcacccgcacaccccacctccggccggccggaaacaccgcgcgcccggaatggagaacggcaacggcgcgtcgccgtgctgcaacggcaacggcaacggcaacggcgcggcggcggcggcgccgccgccgcacgtggcgatgctggtgacgccggggatgggccacctgatcccgctggcggagctggccaagcggctggcgcggcggcacggcgcgacggcgacgctcctcacgttcgcgtcggcggcgtcggccacgcagcgcgcgttcctggcgtcgctgccgcccgccgtcacctccctggcgctcccgcccgtcgacctctccgacctgccccgcggcgccgccatcgagacgctcatgtccgaggagtgcgcgcgcagcgtgccggcgctcaccgacatcctccgggacctgcggcggcgcacccgcctcgtcgccttcgtcgccgacctcttcggcgccgactcgttcgacgccgcgcgcgccgcgggggtcgcccggcggtacctcttcttccccaccaacctccacgcgctcacgctcttcctccacctcccggagctcgacgccgccgtgcccggcgagttccgcgacctcgccgagccgctgcgcctccccgggtgcgtgcccatcccggggcccgacgtgctcatgccgctgcaggacaagtccaacccctgctacaggtggatggtccaccacggcgccaagtaccgcgaggccgacgccatcctcgtcaactccttcgacgccgccgagccgggccccgccaagatcctccggcagccggcgcccgggcgccccgccgtgttccccgtcggcccgctcatccaggccgaccgcggcggcagcgacgggccgtgcccgtgcctcgagtggctcgaccggcagccggcccggtcggtcatcttcgtctccttcggctccggcggcgcgctgccggccgagcagatgcgggagctcgcgctcgggctggagctcagcgggcagcgcttcctgtgggtggtgcggagccccagcgacgagggcgccgtcaacgacaactactacgacgccgagagcaagaaggaccccttcgcgtacctgcccgagggcttcgtcgaccggacccgcgacgtgggcctcgtggtgccctcgtgggccccgcagataaaggtcctggcccacggggccaccggcgggttcctgacgcactgcgggtggaactcggtgctggagagcctcgtgtacggcgtgcccatggtggcgtggccgctctacgccgagcagcggcagaacgcggtgatgctgtcggagggggtcggcgccgcgatccgcgtccccgagtccaaggggcgggagaagatcgcggcggcggtgcgggaggtgatggagggtgagggcagaggcgccgcagtgcgggccaaggtggcggagctgcagaaggccgcggcggaggggctccaggaaggcggcgccgccacggcggcgctcgccgaggtggtggagaagtggacgtgcgaggagaactagagatgatgctgagctgagtgtgcagctgccaatccatcccattcacagctactatcctccccctccagcaccaccatctttggggcctagccggctccatggtttgtccgtttgtaaattattccaaacttttgatttgtattttgtatcttatcatacaacctgtaactatccatgcatgtcctactccattggtaggtaggagtatactaataaggtagctttgtgcgtatcaagatgctattctatttcgccacttttatttgcaaatttatttaaaatctaagatttggataaa

SEQ ID NO: 4569 - DNA, 1260 bp, Saccharum officinarum
catgacagccatgccccaccgcctcgtccccttcctcctcctcctcgccgccaccggagccggcgcggccaacccgcggcagctgtttctcgtgagccagccgcccgtcacgctcaccaaccaccacgggcagctgctgacgggcaactactccgtcaacctgctctggtacgggcgcttcacgccggcgcagcgcgccgtggtggccgatttcatcctgtccctctcgggtccggggccggcctccgcctcggcgccaccgtccgtggcggcgtggtgggccacgacggcgcgctaccacccaggcgcggcgcggctgtcgctggggcggcaggtgctggacccgacgctgtccctgggccgccgcctctcggagtcctcgctggcgtccctggcggcgcgcctgggcccgcaccgggacaccgtggcggtggtggtgacggcgccggacgtgctggtggacgggttctgcctctcccgctgcggcctgcacgcgtccgcgagccccccggcgccggccagcagcgcccacgggggccgcgggcggttcgcgtacgcgtgggtggggaacccggcggagcagtgcccgggggagtgcgcgtggccgttccaccagccgccgtacggcccgcaggcggcgccactggtgtccccgaacgcggacgtcgggatggacggcgcggtgatcacgctggcgacgctgctggcgggcgcggtgaccaacccgtacggcggcgggttcttccagggccccgcggaggcgccgctggaggccgtgtcggcgtgcgcgggcgtgttcggcgccggcgcgtacccggggtacccgggccaggtgcgcgtggacgccgccacgggcgcgagctacaacgccgtcggggtggctgggcgcaggttcctgctgccggccatgtgggaccccgcgacggcgcagtgctccacgccgctcgtgtagtcgagtcgagtggagcggtgggagtggaagggaagttccggcgatggccgactcgagagagtcgagtcggtggtagtggtgcactggggttgccgtgttggtgtccggagcccggactccggtttctggtgtcgtgctcacattgtacatatccatttcgttcgtggtcacaacttgaaaaccaaaaaaaaatgttgggaagaaaatcagccgcaggtcattagtgtaatgtactaccatggagtattactgtgctcctagtggcagtcaccatcagtaataataataaaaatactgaggctttgttt

SEQ ID NO: 4570 - DNA, 1625 bp, Saccharum officinarum
  misc_feature (22)..(22): n is a, c, g, or t
  misc_feature (25)..(28): n is a, c, g, or t
  misc_feature (34)..(34): n is a, c, g, or t
  misc_feature (43)..(43): n is a, c, g, or t
  misc_feature (565)..(565): n is a, c, g, or t
  misc_feature (955)..(955): n is a, c, g, or t
  misc_feature (1216)..(1216): n is a, c, g, or t
catgacagccatgccccaccgnctnnnncccttnctcctcctnctcgccgccaccggagccggcgcggccaacccgcggcagctgtttctcgtgagccagccgcccgtcacgctcaccaaccaccacgggcagctgctgacgggcaactactccgtcaacctgctctggtacgggcgcttcacgccggcgcagcgcgccgtggtggccgatttcatcctgtccctctcgggtccggggccggcctccgcctcggcgccaccgtccgtggcggcgtggtgggccacgacggcgcgctaccacccaggcgcggcgcggctgtcgctggggcggcaggtgctggacccgacgctgtccctgggccgccgcctctcggagtcctcgctggcgtccctggcggcgcgcctgggcccgcaccgggacaccgtggcggtggtggtgacggcgccggacgtgctggtggacgggttctgcctctcccgctgcggcctgcacgcgtccgcgagccccccggcgccggccagcagcgcccacgggggccgcgggcggttcgcgtacgcgtgggtngggaacccggcggagcagtgcccgggggagtgcgcgtggccgttccaccagccgccgtacggcccgcaggcggcgccactggtgtccccgaacgcggacgtcgggatggacggcgcggtgatcacgctggcgacgctgctggcgggcgcggtgaccaacccgtacggcggcgggttcttccagggccccgcggaggcgccgctggaggccgtgtcggcgtgcgcgggcgtgttcggcgccggcgcgtacccggggtacccgggccaggtgcgcgtggacgccgccacgggcgcgagctacaacgccgtcggggtggctgggcgcaggttcctgctgccggccatgtgggaccccgcgacggcgcagtgctccacgccgctcgtgtagtcnagtcgggtggggcggtgggagtggaagggaagttccggcgatggccgactcgagagagtctcgagtcggtggtagtggtgcactggggttgccgtgttggtgtccggagtccggactccggtttctggtgtcgtgctcacattgtacatatccatttcgttcgtggtcacaacttgaaaaccaaaaaaaaatgttgggaagaaaatcagccgcaggtcgttagtgtaatgtactaccatggagtattactgtgctcctagnggcagtcaccatcagtaataataataaaaatactgactgtattaagaatagagtttagttttaaaaaaaaaaaaaaataaagggcgggccgttttagaggatccaaatctaccttacgcgtgcattgcactgtaataatttttttttgtgggcacctaaatttatataactggcccgcgttttaacaagtctttaattgggaaaaccttgggtgtaacccaatttaattggcctttgtagacaaacacccttttatacaactgtacttattattagaaatatggccctctccgaatctccactgtataaaattatttcctcgcctcgatagtgtataatagaactcctctctctgaaccgatattatctatacaacaattttatccattatagtttctcacccctcatt

SEQ ID NO: 4571 - DNA, 1564 bp, Zea mays
ttgctcttccaaaacgttaaccaccaaccctccggagtagtagtagtaagccacaaacgaaatggttggtgagtggtatatccacaatgcgagggaggggacacgagaaagaaagtaagaaacagcagcaccgacactcgactccaccacagtcatgcacggcggcacgggcatctatctatctatctagtccagcggcgtggagcactgcgctgtttcggggtcccacatggccggcagcaggaagcgtcggccggcgatccccacggcgttgtagctggcgcccgtggcggcgtccacgcgcagctgccccgggtacccctggtaggcgccggccccgaacacgcccgcgcacgccgtgacggcctccatcggcgcctccgcggggccctggaagaagccgccgccgtacgggttggtcaccgcgcccgccagcagcgtggccagcgtgatcaccgcgccgtccatcccgacgtccgcgttcggggccaccagcggcgccgccgccggctgcgggccgtagagcggctggtggaagggccatgcgcactcccccgggcactgctccgcggggttccccacccacgcgtacacgtaccgcccgcggccacgcccgcgggtggcgttcggggtcggggacgacgcgtggaggccgcagcgggagaggcagaacccgtccacgagcacgtccggcgccgtcaccacgaccgccacggagccgcggtgcggggccaggcgcgtcgccagggacgctagcgacgactccgagaggcggcggcctagggagcgcgacgggtccagcacctgtcgccccagcgacagccgtgctgcgccaggatggtaccgcgacgtcgtggcccaccacgccgccacggaccccggccccgtccccgagagggagaggatgaagtcggccaccacggcgcgctgcgccggcgtgaaacgcccgtaccagagcaggttgacggagtagttgcccgtcagcagctggccgtggtggttggtgagcgtgatgggcggccggctcacgaggaacagctgccgcggcgtggccgcgctggcttgcgcggcggcgaggaggacgacgagcaggaagagactgtggggcatggctgcctttgctttgctgggacgagacgagatggactggtccctgccaagcggacgtgactagtcgagaggttttatagggagagggtttcgcttccgtcgcgtgtgcccgggccgggacgaagcggaaagacggggtagaccactgagcagggcacgacttttcatgatttttttttgagagggggcctcctgcagcaatgtacgtatacgtactgggccggacacacagacaaagcattttttggtccttgtggcgggtggggcccagcgtcgtaaggggctccttgcgtgagaagagacgtgcgcgtgggttttgaataatttgagcgttcatccagcattcgacgggcttttttttgccttttgtccttttgtgaaagattttcacaactattcccttcttggtttgaattcaaaaaattgattcttacctcggtgccgtcattattgg

SEQ ID NO: 4572 - DNA, 1384 bp, Zea mays
acctctcgactagtcacgtccgcttggcagggaccagtccatctcgtctcgtcccagcaaagcaaaggcagccatgccccacagtctcttcctgctcgtcgtcctcctcgccgccgcgcaagccagcgcggccacgccgcggcagctgttcctcgtgagccggccgcccatcacgctcaccaaccaccacggccagctgctgacgggcaactactccgtcaacctgctctggtacgggcgtttcacgccggcgcagcgcgccgtggtggccgacttcatcctctccctctcggggacggggccggggtccgtggcggcgtggtgggccacgacgtcgcggtaccatcctggcgcagcacggctgtcgctggggcgacaggtgctggacccgtcgcgctccctaggccgccgcctctcggagtcgtcgctagcgtccctggcgacgcgcctggccccgcaccgcggctccgtggcggtcgtggtgacggcgccggacgtgctcgtggacgggttctgcctctcccgctgcggcctccacgcgtcgtccccgaccccgaacgccacccgcgggcgtggccgcgggcggtacgtgtacgcgtgggtggggaaccccgcggagcagtgcccgggggagtgcgcatggcccttccaccagccgctctacggcccgcagccggcggcggcgccgctggtggccccgaacgcggacgtcgggatggacggcgcggtgatcacgctggccacgctgctggcgggcgcggtgaccaacccgtacggcggcggcttcttccagggccccgcggaggcgccgatggaggccgtcacggcgtgcgcgggcgtgttcggggccggcgcctaccaggggtacccggggcagctgcgcgtggacgccgccacgggcgccagctacaacgccgtggggatcgccggccgacgcttcctgctgccggccatgtgggaccccgaaacagcgcagtgctccacgccgctggactagatagatagatagatgcccgtgccgccgtgcatgactgtggtggagtcgagtgtcggtgctgctgtttcttactttctttctcgtgtcccctccctcgcattgtggatataccactcaccaaccatttcgtttgtggcttactactactactccggagggttggtggttaacgttttggaagagcaacagcaatggagcagccagcagagcctctgcatggaaaagtagcgaaaggcaatggcaaggacaggcatggcagcaggagggagcgtcctgtccgtgctgccgtgcacagggcaccgcacactgtgcccttccccgagcgagaagagagagagagagggcaacagggtcggagggcgtacgggaggcgtcccgtgggcctgt

SEQ ID NO: 4573 - DNA, 2363 bp, Zea mays
atccactagctgcccggccggccggctagcggagaaacagcccgcccgctcgcctctgcctctgcccctgcacgcccaagatcctcaggccgggccggccgcgtggcagtgccgcgcgcgcgcgagagcgagagggatccatgggcgtctccgaggaggcggcgcgggtgtgggcggagctgcccgtgcgggtggactgggcggccgcggcggcgcaatgcgcgtccctgtgggcgcacgcgcgcgcgctgctggtcgcgccagcggtgcgggtcctggtgctcctgtcgctggcgatgaccgtgatgatactggcggagaagctgttcgtctgcgccgtgtgcctcgccgtgcgggcgctccggctcggcccggaccggcgctaccgctgggagcccatcggcggcggagtcggagacgaggaggaggagtccgggtccggccacggcgccaagtaccccatggtgctcgtgcagatccctatgtacaacgagcgggaggtgtacaagctgtcgatcggggcggcatgcgagctggagtggccgtcggagcgcttcatgatccaggtgctggacgactccacggaccccgttgtaaaggatttggtggagacggaatgccaaagatggaagagcaaaggcgtgaatataaagtacgaggtgagggggaaccggaaggggtacaaggccggcgcgctcaaggaaggactgaagcatgactacgtcgaagactgcgagtacatcgccatgttcgatgctgacttccagcccgagcctgatttcctcctaagggctgtcccattccttgtgcataacccggagatcgccctcgtccaagctcgctggaaattcgttaattctggtgagtgtctgctgacgagattccaagaaatgtccttggactaccatttcaagtatgagcaagaggcaggctcctcactgcattcattctttggcttcaatgggacagccggtgtctggaggattgcagctatcgatgacgccgggggctggaaggaccggacgacggtggaggatatggacctggctgtccgtgcgatgctgcagggctggaagtttgtttacgtcggcgacataaaagtcaagagtgaattgcctagcacgttcaaggcataccggtttcagcagcacaggtggtcttgtggaccggcaaacctgttcaagaaaatgatggtagagattttagaaaacaagaaagtgtcattgtggagcaaaatctacttatggtacaatttcttcttcgttgggaaggtcgctgcccacacggtgacattcatctactactgctgtgcgatccccgtgtctgttttgcttcctgagattcagatacctctctggggagttgtctatatcccgacgctcataaccctcttgaaggctcttggcacaccaagttcgtttcacctggtgatcctctgggttctgtttgagaatgtcatgtcactgcaccggattaaagctgcagcaagtggtcttctggatgctggtggacgagtcaatgagtgggttgtcaccgagaagttgggcgacaccagcaaggcaaagcctggcgccaatggatcagatgatgtaaaggtgatagatgtaaagctaacagaacccctcgttcccaagctagtgaagaggcgagcaagattttgggagaggtacaactgctcagaacttttcgttggaacctgcatacttctgtgtggtttctatgacttgctttttgcaaagaagggatactacatttttctcttccttcaaggcacggctttccttgttgttggctttgggtatgtcggcacactacctcattgcaatgcataagctggcatggacaattcatataccttcttactagaaacagatcaagcaaagttcctctctcctgcccatatggaacttcaatgatagttgagcaatattcccatgatcagtcttggccagacatgattcactgccaagaaggttgttcagatgtcgtcgtcactcttctgtcagtctttattgtcaagaaggccattcaaatagtgtcaccgttccaaatttataataacagtgtttactgaagcatcatgacatacaagaatgattggtgcagcagcatttagtaaacatcccgtagagatgcagttcacagtcgtgaaagaactgcagctgctgtaaatggaatagcaccagttgccaatttctgtagatctccgaacttttttttggaaattttgtgatattactcagagttcagatcaataatggaagattgttggcttcctcagttcataacctgtgtatgcttaaaacttgtaaatgtaaattgtcattgacactaataattttgtcgaacccaggcagttcttg

SEQ ID NO: 4574 - DNA, 2060 bp, Panicum virgatum
agctgccctccgcatcccacacagtcacacacgccaggaagagctgctgttacttcggaggacgtcaaggacagcggcggccggcggttcttctcatagcttgaaggcaacaccttcaccagtaaggcaatagtataatattggccggccttcttcctggtgtgagctatctttgcagaaaccaataattaagtttcattcatgggctcttcaagtcatcagaaaggcagaattcgtaccaaaaagcccttgggaattcaactttttgagtgtgtccagggaagtcctatctccttcagatcatgccaggctcttgtattagtattgacgttcttatcatatgccagctaccatgccactagaaaaactacaagcattgttaagagtgttcttgatcctaagacaaacctaggtatgttgcactggcccagccatctctatcttcaaaatttgaaaggctctgagaacaatacactctctagtggctgggctccattcaacgccaaagatggtactgcattgcttggcgagattgacttggcttttcttggtgtatatgcaattggcatgttctttgctgggcatttgggcgaccgggtggatctgaggatccttctcactattggtatgataggaactggattgttcactgctgctttcggagccggctactggttcaatatacacagcttctactactttctgggcatgcagatgatggctgggcctgtttcagtcatctggatggccttcagtagttgcagtggttggcaattggtttgggaagagcaagagggggctgataatgggaatttggaatgctcacacatctgtaggaaacatatctggctctctgattgctgctgcaatgttgaagtatggatggtcctggtcctttgctgtgcccggtatcatgatcgcactagtcgggctcacggtgttcctgttgttgcctgttaatcctgatgtgattggaattcaggaggatctccatttgaaggactctgaaaagactgacatggacacccctttgttggagcggcgctcagaagcaaaagagaaggcagttggatttattgaggcctggagaattcctggtgtagctcctttcgctctctgccttttcttctgcaagcttgtggcctatacgttcctgtattggcttcccttttatatcagccacacagccattggcggtcaatacttgtcagactcctcggccggcgtgttgtcaacgctgttcgatgtgggtggcgttgtaggcggcatcctcgccggccatatctccgaccacctcgacgcccgggcgctgacggccgcgagcttcaccttctccgcgatcccggcgctcttcttctaccgcatctacgggagcgtctcgctgacgtggaacatcgtgctcatgttcatcacggggatgctggtgaacggcccctacgcgctgatcacgacggccgtgtccgcggacctcggcacgcacagctccctgaacggcaactcccgggcgctggccaccgtgacggccatcatcgacggcacgggctccatcggcgcggcggtgggcccgctgctgacggggtacatctccgccaggagctggagcgccgtgttcacgatgctgatggcgtcggcgctcgtcgcggggctgctgctgacgaggctggtggtggcggaggtggtcgccaagatggagtcccggagggcgcccgcccacactgccggcgacctgcccgtgtccaccaccatcatggatgaaccttaggctgtcgtggagactgggagaactggaatggcggcgggagactcggagaacagaccacctctggtctgacaagaactgtgggatcttgctcatggtcggtgtgtcgtggttgttgtgcgtcatggtatatgtatatggaatgactggctgtggtcggcgatgaggatgaaatgtggtcgggctgcagcgcggggagtttgcatctcttctgctcttctgttggagctgcactgaacatccaccggccatagtcacacgatctttgtataagcaaatgcaactccagaattgagtgcag

SEQ ID NO: 4575 - DNA, 1765 bp, Saccharum officinarum
gcctccctcacggctcctccgcgcagcaaggaacagctctgccgttcccttggaaaaccttcaaggacagcagcggcggctggcaccacttctcctagcttcaaggtggtggcagcaccgacaccgctaaggcaatttcgtaacatcggccggccttcttcctgacttgagctatctttgcaggaaaaatcagttcagtttcattcatgggctcctcaagtcatcagaaaaacaaaatgtgtagcagaaagcccttgggaattcaactttttgagtgtgtccgggggagtcccatctccttcagatcatgccaggctcttgtgctactactgacgttcttatcatacgccagctaccatgccaccagaaaaactacaagcattgttaagagtgttcttgatccaaagaaaaacctaggtatgttgcattggcccagtcatctctatcttcaaaatttgaaaggtgcagagaacaatacaactctctccagcggttgggctccgttcaacgctgaagatggcactgcattacttggcgagattgacttggcttttcttggtgtatatgcaattggcatgttctttgctggccatttgggcgatagggtggatctgaggatcctgctgactataggaatgataggaactggattgttcaccgccgcctttggagccggctactggttcgatgtacacaacttctactactttctgggcatgcagatgatttctggcctgtttcagtcatctggatggccttcagtggttgcagtagttggcaactggtttgggaagagcaagaggggactgataatgggaatatggaatgctcacacatccgtaggaaacatatctggctctctgattgctgctgccatgctgaagtatgggtggtgctggtcctttgcggtgcccggtatcatgatcgcactggtcgggctcacggtgttcctcttcttgcctgttgggcctgatgtgattggaatccaggaggatctccatttgaaggattatgagaagagtgacacggacactcccctgttggaacgacgctcatcagatgtaaaagaaaaggcagttggatttattgaggcgtggagaattcctggtgtagctccttttgccctctgccttttcttctgcaagcttgtggcctatacgttcctgtattggcttcccttttatatcagccacacagctatcggtggacaatacttgtcagactccgaagccggggtactgtcaactctgttcgacgtgggtggcgttgttggcggcatcctcgccggccacatctccgaccacctggacgcccgggcgctgacggccgcgagcttcaccttctccgcgataccggcgctcttcttctaccgcatctacgggaacgtctcgctggcgtggaacatcgcgctcatgttcgtcaccgggatgctggtgaacgggccctacgcgctgatcacgacggccgtgtccgcggacctcggcacgcacagctccctcaacggcaactcccgcgcgctggccaccgtgacggcgatcatcgacggcacggggtcgatcggcgccgccgtcggcccgctgctgacggcgtacatctccgccaggagctggagcgccgtgttcacgatgctgatggcgtcggcgctcgtcgcggggctgctgctgtcgaggctggtggtggcggacgtagccgccaaaatggagtcccggaagacgcccgcccccggtgctagcgaccctgcccgggttctccatggaagaaaccg

SEQ ID NO: 4576 - DNA, 1910 bp, Saccharum officinarum
  misc_feature (1226)..(1226): n is a, c, g, or t
  misc_feature (1238)..(1238): n is a, c, g, or t
  misc_feature (1362)..(1362): n is a, c, g, or t
  misc_feature (1604)..(1604): n is a, c, g, or t
  misc_feature (1701)..(1701): n is a, c, g, or t
cagaaagctgccctccgcctccctcacggctcctccgcgcagcaaggaacagctctgccgttcccttggaaaaccttcaaggacagcagcggcggctggcaccacttctcctagcttcaaggtggtggcagcaccgacaccgctaaggcaatttcgtaacatcggccggccttcttcctgacttgagctatctttgcaggaaaaatcagttcagtttcattcatgggctcctcaagtcatcagaaaaacaaaatgtgtagcagaaagcccttgggaattcaactttttgagtgtgtccgggggagtcccatctccttcagatcatgccaggctcttgtgctactactgacgttcttatcatacgccagctaccatgccaccagaaaaactacaagcattgttaagagtgttcttgatccaaagaaaaacctaggtatgttgcattggcccagtcatctctatcttcaaaatttgaaaggtgcagagaacaatacaactctctccagcggttgggctccgttcaacgctgaagatggcactgcattacttggcgagattgacttggcttttcttggtgtatatgcaattggcatgttctttgctggccatttgggcgatagggtggatctgaggatcctgctgactataggaatgataggaactggattgttcaccgccgcctttggagccggctactggttcgatgtacacaacttctactactttctgggcatgcagatgatttctggcctgtttcagtcatctggatggccttcagtggttgcagtagttggcaactggtttgggaagagcaagaggggactgataatgggaatatggaatgctcacacatccgtaggaaacatatctggctctctgattgctgctgccatgctgaagtatgggtggtgctggtcctttgcggtgcccggtatcatgatcgcactggtcgggctcacggtgttcctcttcttgcctgttgggcctgatgtgattggaatccaggaggatctccatttgaaggattatgagaagagtgacacggacactcccctgttggaacgacgctcatcagatgtaaaagaaaaggcagttggatttattgaggcgtggagaattcctggtgtagctccttttgccctctgccttttcttctgcaagcttgtggcctatacgttcctgtattggcttcccttttatatcagccacacagctatcggtggacnatacttgtcagnctccgaagccggggtactgtcaactctgttcgacgtgggtggcgttgttggcggcatcctcgccggccacatctccgaccacctggacgcccgggcgctgacggccgcgagcttcaccttctcngcgataccggcgctcttcttctaccgcatctacgggaacgtctcgctggcgtggaacatcgcgctcatgttcgtcaccgggatgctggtgaacgggccctacgcgctgatcacgacggccgtgtccgcggacctcggcacgcacagctccctcaacggcaactcccgcgcgctggccaccgtgacggcgatcatcgacggcacggggtcgatcggcgccgccgtcggcccgctgctgacggngtacatctccgccaggagctggagcgccgtgttcacgatgctgatggcgtcggcgctcgtcgcggggctgctgctgtcgaggctggtggtggcggangtagccgccaaaatggagtcccggaagacgcccgcccccggtgctagcgaccctgcccgggttctccatggaagaaaccgaaaattccctttttgtttgccccctcttgggggtctttgtgggtgaccttggaaatgggtggccgggaacccgaaaaaaaaaggccccccttctatttttaagacctccagggtttagggggaaccccg

SEQ ID NO: 4577 - DNA, 2290 bp, Oryza sativa
tataagaccagtaattcctcggaagccacggtcgaggcgactccagaaagcttcccctccgcggtccgctcgcctcctcacggcgccaaagcagccaggaagaagaagaaccacgctgtttctaggacgattcctggaacagccaacttctgaacctctatctgcaagactgcagacagtataatacttcttcctggttgcagccgcctcagcggaaaaaccaaattcagcttcattcatgggttccccaagcaaaacacgtcggatgaagccattggggattcagctatatgagtgtgcccgggggagtcctatctccttcagatcatgccaggctcttgtattgatactgacgttcttatcctatgctagctatcatgccactaggaagactacaagcattgtcaagagtgttcttgatcctaagacagaaaacctaggtatgttgcattggccgagccatctgtatcttcaggatttaagagatgcacagggcaacatgacggctctctatagcggctgggctccgtttaatgccgacgatggtactgcattgctcggggagatcgacttggcatttctcggagtatatgcaatcggcatgttcttcgctggccatttgggtgatcgggtggatctcaggatacttctgaccatcggaatgataggcactggatttttcactgctgcctttggtgccggcaactggctcaacatacacaacttctactactttctgggtgttcagatgatggctggcctgtttcagtcatccggctggccatctgtggttgcagttgttggtaattggtttggaaagagcaaaagagggctgataatgggaatctggaatgctcatacatctgtgggaaacatatctggttccttaattgcagctgcaatgttgaagtttggatggtcatggtcgtttgcagtccctggagtgatgatcgcagtcgttgggcttgcagtgtttctgttcttgcctgtcggtccggagatgattggaatcgaggaggatatccatgagaaggatgctgagaaggatgacatgagtgcacctctgttggaagaacgatcggcatcaaaagaaaaggcagtcgggttcattcaggcttggagaattcctggtgtagcgccatttgctctctgccttttcttctgcaagcttgtggcttacacattcctgtattggcttccgttttatatcagccacacagcaatcggtggagtgtacttgtcagacaccgcagccggtgtactgtcaactctgttcgacgtgggtggcgttgtcggcggcatccttgccggccacatctccgaccgcctcgacgcacgggcgctgacggcggcgagcttcacgttctcggcgatcccggcgctcttcttctaccgcatatacggcagcttctcgctgtactcgaacatcgccctcatgttcgtcaccgggatgctcgtcaacgggccgtacgccctcatcaccaccgccgtctccgccgacctcggcacgcacagctccctgaacggcaactccagggcgctcgccaccgtcacggcgatcatcgacgggacggggtcgatcggcgccgcggtcggcccgctgctgacggggtacatctctgccaagagctggagcggcgtgttcacgatgctcatggcgtccgctttcgtcgcggggctgctcctgtcgaggctggtcatggcggagatctccgcgaagatggagtcccggaggcctgacgctgctgctagtgatctgccagtgtcctccatggaacaatcttaggctccattagacactttggaaattgtgtccctggtgaaatgctgagaaattttacaagcgaaaaagcctgaaaatggagacttgagaggtgtggcaggaagagcaaacccctcacaaattcccttttttttttacacctgaggagcaaggtgctctctccagccccaggattgcatcttggctatgagcgatttctgttgcttgtgatgtgtatatggaactcctaccgtatgaagtgatgattgtcaactctagctgttgacaaaggcgcgcgtgtggaatgcgggaggttttccggatttctgtatagcgagttataatcgggctcttaaagcttgtgcgagaatgcagcagaagtgttggttcctatcagatgctaatgtaatcttgctgattcaccggtgaaacagctggagaggagactggaggtgtaattcgaagaggggacaatctccttttgacctgcaatttgaagcacacgtggtactagacggtccactagaa

SEQ ID NO: 4578 - DNA, 2105 bp, Brachypodium distachyon
ggccgaggcgcctcagaaagctgccttccacggcccgctccccacgaaagcgcgaggtcaaggaccgccgccgacaagaacagactctgtttcgtggacgacttttcaggcaggcacttcctcagataaggcaataataccagccggccttcttcctggctgcagttatagttgtggcgaaaccaaattcagattcactcatgggctcctcaagtggatgcagaagcaaaatgggcaccacaaaacccttggggattcaactattcgagtgtgtccgagggggtcctctgtccttcagatcatcccaggctctcgtgttgatactgaccttcctgtcgtacgctagctaccatgccacgaggaaaactacgagcattgtcaagagtgttcttgatcctaagacagcaaatgtaggcatgttgcactggccaagcaatctgtatctccaacatctaaacaaagcagagaacaacaacactgctatccacaatggctgggctccgtttaatggcgacggtggcaccgcgttgctcggcgagatcgacctggctttccttggggtctatgcgattggcatgttcttcgctggccatttgggtgaccgagtggatctgaggatccttctgaccatcggaatggtaggaaccgggctgttcaccgctgctttcggagccggctactggttcaacatacacagcttctactacttcctgggcgtccagatgatcgccggcctgtttcagtcatccggctggccttccgtcgtcgccgtagtcggcaactggtttgggaagagcaagaggggcctgatcatggggatctggaacgctcatacatctgtgggaaacatatccgggtctctgatcgcggccgcgatgctcaagttcggatggtgttggtcgttcgcagtgcccggcgccatgatcgctttggttgggatcgccgtgtttctcttcttgcccgtcggtccagaggtgattgggatcgaggaggatcgccgtgtgaaggattccgagaaggatgacatggatgccccgctgctggaaaaaagacaatcagatgcaagagacgaggcagtggggttcattcaggcatggagaatccctggcgtcgctccgtttgctctctgcctcttcttctgcaagcttgtcgcctacaccttcctgtactggctccccttttatctcagccacacagcgattgggggcgaatatctgtcggactctgccgcgggggtgctgtcgaccctgttcgacgtgggcggcgtcgtaggcggcatcctggcgggccacatctcggaccgcctggacgcgcgggcgctgacggcggcgagcttcaccttctcggcgatcccggcgctcttcttctaccggatctacgggagcgtctcgctggcctggaacgtggcgctcatgttcctgacgggggtgctggtgaacgggccgtacgcgctcatcacaacggccgtctccgccgacctcggcacgcacagctcgctcaacggcaactcccgcgcgctggccaccgtgacggcgatcatcgacgggaccgggtccatcggcgccgcggtcgggccgctgctgacggggtacatctctgcgaaaagctggagcggcgtgttcacgatgctcatggcgtcggcgctcatcgccgggctgctgctgtcgaggctcgtcgtggcggagatctccgcgaagatggagtcacggagggctgctgatcatgctagtgatctgcccgtgtcctccttggaggaagcttaggcgctggagatggttggacacttgggactgtctcgatcgatctgctgtgtgctttacatggaggagtggacacggccgacgggctgtgaactttcgaggcgtgacaggaggaagagggaactactctcctctgatttgacaacaggggtgtagggcaggcgctctactcttcagtgtctgaactgcagcacctctggcttctgatgtgcttgtgttgtactgtctgtgcataggggagtggttactaaattcgattggaagtgcggataattgcacggtctgttcgtcgacgtcgagccgtccatcggctatctaatgaaaatgaaacggttacaagacctc

SEQ ID NO: 4579 - DNA, 1587 bp, Brachypodium distachyon
aaaccaaattcagattcactcatgggctcctcaagtggatgcagaagcaaaatgggcaccacaaaacccttggggattcaactattcgagtgtgtccgagggggtcctctgtccttcagatcatcccaggctctcgtgttgatactgaccttcctgtcgtacgctagctaccatgccacgaggaaaactacgagcattgtcaagagtgttcttgatcctaagacagcaaatgtaggcatgttgcactggccaagcaatctgtatctccaacatctaaacaaagcagagaacaacaacactgctatccacaatggctgggctccgtttaatggcgacggtggcaccgcgttgctcggcgagatcgacctggctttccttggggtctatgcgattggcatgttcttcgctggccatttgggtgaccgagtggatctgaggatccttctgaccatcggaatggtaggaaccgggctgttcaccgctgctttcggagccggctactggttcaacatacacagcttctactacttcctgggcgtccagatgatcgccggcctgtttcagtcatccggctggccttccgtcgtcgccgtagtcggcaactggtttgggaagagcaagaggggcctgatcatggggatctggaacgctcatacatctgtgggaaacatatccgggtctctgatcgcggccgcgatgctcaagttcggatggtgttggtcgttcgcagtgcccggcgccatgatcgctttggttgggatcgccgtgtttctcttcttgcccgtcggtccagaggtgattgggatcgaggaggatcgccgtgtgaaggattccgagaaggatgacatggatgccccgctgctggaaaaaagacaatcagatgcaagagacgaggcagtggggttcattcaggcatggagaatccctggcgtcgctccgtttgctctctgcctcttcttctgcaagcttgtcgcctacaccttcctgtactggctccccttttatctcagccacacagcgattgggggcgaatatctgtcggactctgccgcgggggtgctgtcgaccctgttcgacgtgggcggcgtcgtaggcggcatcctggcgggccacatctcggaccgcctggacgcgcgggcgctgacggcggcgagcttcaccttctcggcgatcccggcgctcttcttctaccggatctacgggagcgtctcgctggcctggaacgtggcgctcatgttcctgacgggggtgctggtgaacgggccgtacgcgctcatcacaacggccgtctccgccgacctcggcacgcacagctcgctcaacggcaactcccgcgcgctggccaccgtgacggcgatcatcgacgggaccgggtccatcggcgccgcggtcgggccgctgctgacggggtacatctctgcgaaaagctggagcggcgtgttcacgatgctcatggcgtcggcgctcatcgccgggctgctgctgtcgaggctcgtcgtggcggagatctccgcgaagatggagtcacggagggctgctgatcatgctagtgatctgcccgtgtcctccttggaggaagcttaggcg

SEQ ID NO: 4580 - DNA, 2050 bp, Zea mays
agaaagctggcctcctccgcctttctttccttcctccctcggggctccgcgcgcgcagcagccaggaacagctccgctgcctgctcccttgcccttggggcttggggaaaaaaaaacttcaagaacagcggcggtcgcctcttctccaatcctgcttcaaggctgcaccgaccggctctatttgagctatatctctgcaggaaagctcagttcagatccattcacttcactcatgggctcatcctcgggccatcagagaagcaaaacgcgcagcaggaacaggaagcccttgggaattcagctcttcgagcgggtccgtggcagtggcagccccatctccttcagatcatgccaggctctcgtgctagtgctcacgttcctatcctacgccagctaccacgccaccaggaaaaccacgagcatcgtcaagagcgtcctcgacccaaagacgaagacgaacctaggcacgtcgtcggcgcattactggccccctagccacctcttctatctccagaacctcaaaggtgcggacagcaacagcacggctctctccagcggcggcggcggctgggctccgttcaacgcggcggaagacggcacggcgttgctgggcgagatcgacctggcgttcctcggcgcgtacgcggccggcatgttcttcgcgggccacctgggcgacagggtggacctgagggtcctcctcgccgtagggatggtggggaccgggctcttcaccgccgccttcggggccgggtactggctcgacgtgcacagcttctactacttcctggccgtgcagatggtggccggcctgttccagtcgtccgggtggccgtcggtggtcgcggtggtcggcaactggttcgggaagagcaagagggggctcatcatgggggtgtggaacgcccacacctccgtggggaacatttccggctcgctggtcgccgctgccatgttgaggtacgggtggtgctggagctttgtggtgcccggtgtcgtcatcgcgctggtcgggctcgccgtgttcctgctcttgcctgttgcgcctgatgtgattggagtccaggaggatctctgtttgaaggacgctccattgcttgaacgacgacgcgcagatgtagaggaaaaggcggttgggtttattgaggcgtggaggatccctggtgttgcccctttcgccctctgccttttcttctgcaagcttgtggcgtatacgttcctgtactggcttcccttctatatcagccacacagctatcggtggagaatacttgtcggactccgcagccggggtactgtcgacgctgttcgacgtgggcggcgtcgtgggcggcatcctcgccggccacatctccgaccacctggacgcccgggcgctgacggccgcgagcttcaccttctcggcgataccggcgctcttcttctaccgcgtctacgggaacgtctcgctggcctggaacatcgccctcatgttcgtcacggggatgctggtgaacggcccctacgcgctgatcacgacggccgtgtccgcggacctcggcacgcacagctcgctcaacggcaactcccgcgcgctggccaccgtcacggcgatcatcgacggcacggggtccatcggcgccgccgtcggcccgctcctcacgggctacatctccgccaggagctggagcgccgtgttcacgatgctgatggcgtccgcgctcgtcgcggggctgctgctgtccaggctcgtggcggcggaggtggtcgccaagatggagtcccggaggacgcccgcccctgctgcgagcgacctgctgcccgtgtcctcctcctccatggacgaaccgtagatcgcttctagctgcgccccggctgtggtctcctggtgacatggaatggtggcgggagagtagatcacctgtgattttaggcctggtgggactgtggcagcaggtgcgcagtgcgcttctgtcccggaactgtgggatcttgctcctgccgtgccgtgcttcaccgcttctggttcgtcatggtatatatgtatatggaatgtcttctggttgccgacg

SEQ ID NO: 4581 - DNA, 2158 bp, Zea mays
agaaagctggcctcctccgcctttctttccttcctccctcggggctccgcgcgcgcagcagccaggaacagctccgctgcctgctcccttggggaaaaaaaacttcaagaacagcggcggtcggctcttctccaatcctgcttcaaggctgcaccgaccggctctatttgagctatatctctgcaggaaagctcagttcagatccattcacttcactcatgggctcatcctcgggccatcagagaagcaaaacgcgcagcaggaacaggaagcccttgggaattcagctcttggagcgggtccgtggcagccccatctccttcagatcatgccaggctctcgtgctagtgctcacgttcctatcctacgccagctaccacgccaccaggaaaaccacgagcgtcgtcaagagcgtcctcgacccaaagacgaagacgaacctaggcacgtcgtcggcgcattactggccccccagccacctcttctatctccataatctcaaagatgcggacaacagcagcgccggcggctctctctccagcggcggcggcggcggctgggttccgttcaacgaggcggaagacggcacggcgttgctgggcgagatcgacctggcgttcctcggcgcgtacgcggccggcatgttcttcgcgggccacctgggcgacagggtggacctgagggtcctcctcaccgtagggatggtggggaccgggctcttcaccgccgccttcggagcgggctactggctcgacgtgcacagcttctactacttcctggccgtgcagatggtggccggcctgttccagtcgtccgggtggccgtcggtggtggcggtggtcggcaactggttcgggaagagcaagagggggctcatcatgggggtgtggaacgcccacacctccgtggggaacatttccggctcgctggtcgccgctgccatgttgaggtacgggtggtgctggagctttgtggtgcccggtgtcgtcatcgcgctggtcgggctcgccgtgttcctgctcttgcctgttgcgcctgatgtgattggagtccaggaggatctctgtttgaaggacgctccattgcttgaacgacgacgcgcagatgtagaggaaaaggcggttgggtttattgaggcgtggaggatccctggtgttgcccctttcgccctctgccttttcttctgcaagcttgtggcgtatacgttcctgtactggcttcccttctatatcagccacacagctatcggtggagaatacttgtcggactccgcagccggggtactgtcgacgctgttcgacgtgggcggcgtcgtgggcggcatcctcgccggccacatctccgaccacctggacgcccgggcgctgacggccgcgagcttcaccttctcggcgataccggcgctcttcttctaccgcgtctacgggaacgtctcgctggcctggaacatcgccctcatgttcgtcacggggatgctggtgaacggcccctacgcgctgatcacgacggccgtgtccgcggacctcggcacgcacagctcgctcaacggcaactcccgcgcgctggccaccgtcacggcgatcatcgacggcacggggtccatcggcgccgccgtcggcccgctcctcacgggctacatctccgccaggagctggagcgccgtgttcacgatgctgatggcgtccgcgctcgtcgcggggctgctgctgtccaggctcgtggcggcggaggtggtcgccaagatggagtcccggaggacgcccgcccctgctgcgagcgacctgctgcccgtgtcctcctcctccatggacgaaccgtagatcgcttctagctgcgccccggctgtggtctcctggtgacatggaatggtggcgggagagtagatcacctgtgattttaggcctggtgggactgtggcagcaggtgcgcagtgcgcttctgtcccggaactgtgggatcttgctcctgccgtgccgtgcttcaccgcttctggttcgtcatggtatatatgtatatggaatgtcttctggttgccgacgaagatgaatgcggttggctactcacgctgcaatactccggctgcggacgggcgtttcctggctccgacagcgcccggaggagagggactggctagatgtgccccataatagttgcaacc

SEQ ID NO: 4582 - DNA, 1208 bp, Sorghum bicolor
gtcttcggcggcggcgcccgccggcgaggcgtccacctcggagcccgcagcgaaggggaagcccatcgtcgtgcgggtcaagcgcaagccctcgcagacccgcccggacgctttctggctagagattaatgagaggccggcgaagaaggccatgctcgatttctccagcctctccatctccgacccaccctcctcttcctccgccgccagtgctaaagcttcagaggaaccacgagttaagaaacttcttgtccagcacatcgagacagtacaccattctgaggctgttgaagatgtgttacactcacttttgcttgctgacttgaattccaaggagataaagagcaagacaaaggagtggaatgacagaatcaagcaagacaaaaaaccagaggagctacgatcagcagccagacagaggcatgaggatatgggtagaaatgctcgctttgcacaaatatggaagagtcgaaaaggagaaaataatgatgctgatgactcattgagagaaatatgccatctttatgatgctgtccaagtagatcacgatgacgagaagcatccagcagaaccacggattacctctttcgaagagggtgctgttctatgcaactttcttccgcttatacgggagtacttgccatcagctgcagaggaaattgagtcagatataatttcactggcacaatcagaagattctgaagtttatgatatctatactgtcaaggaggtggatgatacaaacatggaggccacgtcagcagcttcatatccaaggctacaagtggacgatggagaagatgaatgttacgacgatgactatccatatgacacggatgattcaaatgccgaagacaatccactttttgattatcccgatgaattgtccgaggatgaggatgatggtagcaatgatgaggatccttttggagacgaagaaggttctgacactgagtatgagaaggaagaagtagaagcggaagaggatgaataatgatgactaggaattgcaatggagcgcgcgattgtagatgctggggagactagcctgtgaactgaatgtaatgtttgacgatgagataggttcggagctgactgatgaatgtctgttgctaatgctgaaaaaaaaagagaggagaaatggagctgtgtaacagttagcattgtacatcgcgtgcgtcacttgaaggaagaattcaaaaaatatt
